US011872256B2

(12) United States Patent
Dubar et al.

(10) Patent No.: US 11,872,256 B2
(45) Date of Patent: Jan. 16, 2024

(54) BACTERIOPHAGE COMPOSITION AND METHOD OF PREVENTING BACTERIAL INFECTIONS IN LIVESTOCK

(71) Applicant: SYNTBIOLAB INC., Lévis (CA)

(72) Inventors: Rodrigue Dubar, Québec (CA); Simon Labrie, Québec (CA)

(73) Assignee: SYNTBIOLAB INC., Lévis (CA)

( * ) Notice: Subject to any disclaimer, the term of this patent is extended or adjusted under 35 U.S.C. 154(b) by 628 days.

(21) Appl. No.: 16/647,445

(22) PCT Filed: Sep. 14, 2018

(86) PCT No.: PCT/CA2018/051141
§ 371 (c)(1),
(2) Date: Mar. 13, 2020

(87) PCT Pub. No.: WO2019/051603
PCT Pub. Date: Mar. 21, 2019

(65) Prior Publication Data
US 2021/0008133 A1 Jan. 14, 2021

Related U.S. Application Data

(60) Provisional application No. 62/558,924, filed on Sep. 15, 2017.

(51) Int. Cl.
*A61K 35/76* (2015.01)
*A23K 10/18* (2016.01)
*A61P 31/04* (2006.01)
*C12N 7/00* (2006.01)

(52) U.S. Cl.
CPC .............. *A61K 35/76* (2013.01); *A23K 10/18* (2016.05); *A61P 31/04* (2018.01); *C12N 7/00* (2013.01); *C12N 2795/00032* (2013.01); *C12N 2795/00051* (2013.01)

(58) Field of Classification Search
None
See application file for complete search history.

(56) References Cited

U.S. PATENT DOCUMENTS

2016/0030495 A1 2/2016 Serwer

FOREIGN PATENT DOCUMENTS

| CN | 104994740 A | 10/2015 |
|---|---|---|
| CN | 105308179 A | 2/2016 |
| CN | 106574251 A | 4/2017 |

OTHER PUBLICATIONS

Carvalho, C.M., et al., The in vivo efficacy of two administration routes of a phage cocktail to reduce numbers of *Campylobacter coli* and *Campylobacter jejuni* in chickens. BMC Microbiol. 2010. vol. 10, 232, pp. 1-11.
Chan, B.K., et al., Phage cocktails and the future of phage therapy. Future Microbiol. 2013., vol. 8, No. 6, pp. 769-683.
Clark, J. R. et al., Bacteriophages and biotechnology: vaccines, gene therapy and antibacterials. Trends Biotechnology 2006, vol. 24, 5. pp. 212-218.
Clavijo, V., et al., The gastrointestinal microbiome and its association with the control of pathogens in broiler chicken production: a review. 2018. Poult. Sci., vol. 93, No. 3, pp. 1006-1021.
Costa, J. Increased production of biofilms by *Escherichia coli* in the presence of enrofloxacin. 2012. vol. 45(9), pp. 1076-1085.
Del Casale, A., et al., Extent and variation of phage-borne bacterial 16S rRNA gene sequences in wastewater environments. 2011. Appl. Environ. Microbiol., vol. 77, No. 15, pp. 5529-5532.
Hamdi, S., et al., Characterization of five Podoviridae phages infecting *Citrobacter freundii*. 2016. Front. Microbiol., vol. 7, Article 1023, pp. 1-18.
Huff, W. E. et al., Bacteriophage Treatment of a Severe *Escherichia coli* Respiratory Infection in Broiler Chickens. 2003. Avian Diseases, vol. 47, pp. 1399-1405.
Johnson, R. P. et al., Bacteriophages for prophylaxis and therapy in cattle, poultry and pigs. 2008. Animal Health Research Reviews, vol. 9, pp. 201-215.
Kutter, E. et al., Phage Therapy in Clinical Practice: Treatment of Human Infections. 2010. Current Pharmaceutical Biotechnology, 11, pp. 69-86.
Labrie, S. J., et al., Bacteriophage resistance mechanisms. 2010. Nat. Rev. Microbiol., vol. 9, pp. 317-327.
Oliveira, A., et al., In vivo efficiency evaluation of a phage cocktail in controlling severe colibacillosis in confined conditions and experimental poultry houses. 2010. Vet. Microbiol., vol. 146, pp. 303-308.
Saini, V. et al., Antimicrobial resistance profiles of common mastitis pathogens on Canadian dairy farms. 2012. Journal of Dairy Science, vol. 95, pp. 4319-4332.
Summers, W. C. et al., Bacteriophage Therapy. 2001. Annual Review of Microbiology, vol. 55, pp. 437-451.
Weber-Dabrowska, B., et al., Bacteriophage procurement for therapeutic purposes. 2016. Front. Microbiol., vol. 7, Article 1177, pp. 1-14.
Liao, W. et al., "T4-Like Genome Organization of the *Escherichia coli* 0157:H7 Lytic Phage AR1," Journal of Virology, vol. 85; No. 13; 6567-6578 (2011).
Lupo, D. et al., "The T7 ejection nanomachine components gp15-gp16 form a spiral ring complex that binds DNA and a lipid membrane," Virology, vol. 486; 263-271 (2015).
Maffei, E. et al., "Systematic exploration of *Escherichia coli* phage-host interactions with the BASEL phage collection," Institute of Medical Microbiology, University of Zürich, Zürich, Switzerland; 79 pages (2021).
McPartland J. and Rothman-Denes, L.B., "The Tail Sheath of Bacteriophage N4 Interacts with the *Escherichia coli* Receptor," Journal of Bacteriology, vol. 191; No. 2; 525-532 (2009).

(Continued)

*Primary Examiner* — Jennifer E Graser
(74) *Attorney, Agent, or Firm* — Hamilton, Brook, Smith & Reynolds, P.C.

(57) ABSTRACT

The present invention provides new bacteriophages, their selection, compositions, cocktails and formulations thereof, and their administration for the prevention of opportunistic infections in livestock, such as Avian Pathogenic *E. Coli* (APEC) infections in poultry.

18 Claims, 12 Drawing Sheets

Specification includes a Sequence Listing.

(56) References Cited

OTHER PUBLICATIONS

Yu, F. and Mizushima, S., "Roles of Lipopolysaccharide and Outer Membrane Protein OmpC of *Escherichia coli* K-12 in the Receptor Function for Bacteriophage T4," Journal of Bacteriology, vol. 151; No. 2; 718-722 (1982).

Kebede, F., "Pseudomonas infection in chickens," Journal of Veterinary Medicine and Animal Health, vol. 2; No. 4; 55-58 (2010).

Merabishvili, M. et al., "Quality-Controlled Small-Scale Production of a Well-Defined Bacteriophage Cocktail for Use in Human Clinical Trials," PLOS One, vol. 4; No. 3; e4944; 10 pages (2009).

Oliveira, A. et al., "In vivo efficiency evaluation of a phage cocktail in controlling severe colibacillosis in confined conditions and experimental poultry houses," Veterinary Medicine, vol. 146; 303-308 (2010).

Silva, J.B. et al., "Host receptors for bacteriophage adsorption," FEMS Microbiology Letters, vol. 363; 11 pages (2016).

Extended European Search Report issued in EP Application No. 18856077.5, entitled: "Bacteriophage Composition and Method of Preventing Bacterial Infections in Livestock," dated May 6, 2021; 12 pages.

Supplementary European Search Report issued in EP Application No. 18856077.5, entitled: "Bacteriophage Composition and Method of Preventing Bacterial Infections in Livestock," dated May 26, 2021; 1 page.

International Preliminary Report on Patentability for International Application No. PCT/CA2018/051141, entitled: "Bacteriophage Composition And Method Of Preventing Bacterial Infections In Livestock," date completed: Dec. 19, 2019.

International Search Report and Written Opinion for International Application No. PCT/CA2018/051141, entitled: "Bacteriophage Composition And Method Of Preventing Bacterial Infections In Livestock," dated Nov. 30, 2018.

Brown, P.K. and Curtis, R., "Unique chromosomal regions associated with virulence of an avian pathogenic *Escherichia coli* strain," Proc. Natl. Acad. Sci., vol. 93; 11149-11154 (1996).

Gaukler, S.M. et al., "*Escherichia coli, Salmonella,* and *Mycobacterium avium* subsp. *paratuberulosis* in Wild European Starlings at a Kansas Cattle Feedlot," Avian Diseases, vol. 53; 544-551 (2009).

Gill, J.J. and Hyman, P., "Phage Choice, Isolation, and Preparation for Phage Therapy," Current Pharmaceutical Biotechnology, vol. 11; 2-14 (2010).

Wyrsch, E. et al., "Comparative genomic analysis of a multiple antimicrobial resistant enterotoxigenic *E. coli* O157 lineage from Australian Pigs," BMC Genomics, vol. 16; 165; 11 Pages (2015).

Xing-Shu, M. et al., "Research Progress on Avian Pathogenic *Escherichia coli,*" Animal Husbandry and Veterinary in China, Issue 2, 169-174 (2013)—English Abstract Attached, only reviewed English abstract; full text no translation.

| | APEC-A | APEC-B | APEC-C | APEC-D | APEC-E | APEC-F | X7122 | Poulvac |
|---|---|---|---|---|---|---|---|---|
| 1 | 3 | 0 | 0 | 0 | 0 | 0 | 3 | 0 |
| 2 | 3 | 0 | 0 | 0 | 0 | 0 | 3 | 0 |
| 3 | 3 | 0 | 0 | 0 | 0 | 0 | 3 | 0 |
| 4 | 0 | 3 | 0 | 0 | 0 | 0 | 0 | 0 |
| 5 | 0 | 3 | 0 | 3 | 0 | 0 | 0 | 0 |
| 6 | 0 | 3 | 0 | 3 | 0 | 0 | 0 | 0 |
| 7 | 0 | 3 | 0 | 3 | 0 | 0 | 0 | 0 |
| 8 | 0 | 3 | 0 | 3 | 3 | 0 | 1 | 0 |
| 9 | 0 | 3 | 0 | 3 | 0 | 0 | 0 | 0 |
| 10 | 0 | 0 | 0 | 0 | 0 | 0 | 0 | 0 |
| 11 | 0 | 2 | 3 | 0 | 0 | 0 | 0 | 0 |
| 12 | 0 | 3 | 0 | 3 | 0 | 0 | 0 | 0 |
| 13 | 0 | 3 | 0 | 0 | 0 | 0 | 0 | 0 |
| 14 | 0 | 3 | 0 | 0 | 0 | 0 | 0 | 0 |
| 15 | 0 | 3 | 0 | 0 | 0 | 0 | | 0 |
| 16 | 0 | 3 | 0 | 1 | 0 | 0 | 0 | 0 |
| 17 | 0 | 0 | 2 | 0 | 0 | 0 | 0 | 0 |
| 18 | 0 | 0 | 2 | 0 | 0 | 0 | 0 | 0 |
| 19 | 0 | 0 | 2 | 0 | 0 | 0 | 0 | 0 |
| 20 | 0 | 0 | 2 | 0 | 0 | 0 | 0 | 0 |
| 21 | 0 | 0 | 3 | 0 | 0 | 0 | 0 | 0 |
| 22 | 0 | 0 | 3 | 0 | 0 | 0 | 0 | 0 |
| 23 | 0 | 0 | 3 | 0 | 0 | 0 | 0 | 0 |
| 24 | 3 | 3 | 3 | 3 | 0 | 3 | 3 | 2 |
| 25 | 1 | 3 | | | 0 | 3 | 3 | 3 |
| 26 | 3 | 3 | | | 0 | 3 | 3 | 3 |
| 27 | 0 | 0 | 1 | | 0 | 0 | 0 | 0 |
| 28 | 3 | 3 | 3 | | 0 | 3 | 3 | 3 |
| 29 | 3 | 3 | 3 | | 0 | 3 | 3 | 3 |
| 30 | 3 | 3 | 3 | | 0 | 3 | 3 | 3 |
| 31 | 0 | 3 | 3 | | 0 | 0 | 0 | 0 |
| 32 | 3 | 3 | 3 | | 0 | 3 | 3 | |
| 33 | 2 | 3 | 0 | | 3 | 0 | 0 | 3 |
| 34 | 0 | 3 | 0 | | 1 | 0 | 0 | 0 |
| 35 | 0 | 3 | 0 | 3 | 0 | 0 | 0 | 0 |
| 36 | 0 | 3 | 0 | 3 | 0 | 0 | 0 | 0 |
| 37 | 0 | 3 | 0 | 3 | 0 | 0 | 0 | 0 |
| 38 | 0 | 3 | 0 | 3 | 3 | 0 | 0 | 0 |
| 39 | 3 | 3 | 0 | 3 | 3 | 0 | 0 | 3 |
| 40 | 0 | 3 | 0 | 3 | 1 | 0 | 0 | 0 |
| 41 | 0 | 2 | 0 | | 0 | 0 | 0 | 0 |
| 42 | 3 | 2 | 0 | | 2 | 0 | 2 | 3 |
| 43 | 3 | 2 | 0 | 1 | 2 | 0 | 2 | 3 |
| 44 | 0 | 2 | 0 | 1 | 0 | 0 | 0 | 0 |
| 45 | 3 | | 0 | 1 | 3 | 0 | 2 | 3 |
| 46 | 3 | | 0 | 1 | 3 | 0 | 2 | 3 |
| 47 | 3 | | 0 | 1 | 3 | 0 | 2 | 3 |
| 48 | 3 | | 0 | 1 | 3 | 0 | 2 | 3 |
| 49 | 1 | | 0 | | 3 | 0 | 1 | 2 |
| 50 | 3 | | 0 | | 3 | 0 | 1 | 2 |

*Figure 7*

BACTERIOPHAGE COMPOSITION AND METHOD OF PREVENTING BACTERIAL INFECTIONS IN LIVESTOCK

This application is a national stage application under 35 U.S.C. § 371 of International Application No. PCT/CA2018/051141, filed Sep. 14, 2018, entitled "Bacteriophage Composition and Method of Preventing Bacterial Infections in Livestock," which claims priority to U.S. Provisional Patent Application No. 62/558,924, filed Sep. 15, 2017, the contents of all of which are hereby incorporated herein in their entirety by reference for all purposes.

SEQUENCE LISTING

The instant application contains a Sequence Listing, which has been submitted in ASCII format via EFS-Web, and is hereby incorporated by reference in its entirety. Said ASCII copy is named "20200527_Amended_Sequence_Listing_18385_6_ST25.txt", and is 5,291,869 bytes in size.

FIELD OF THE INVENTION

The present invention relates to a composition comprising bacteriophages and its use for the prevention of bacterial infections, namely for the substitution of antibiotherapy in livestock, such as poultry or pigs.

BACKGROUND OF THE INVENTION

Infections of livestock cause tens of billions of dollars of losses per year, including 5-10 billion dollars from food-borne illness. These infections are primarily caused by six pathogens, *Salmonella enterica*, *Listeria monocytogenes*, *Escherichia coli* (such as APEC or ExPEC), *Campylobacter jejuni*, *Staphylococcus aureus* and *Clostridium perfringens*.

Avian pathogenic *Escherichia coli* (APEC) strains cause systemic and localized infections in poultry, jointly termed colibacillosis. Avian colibacillosis is responsible for significant economic losses to the poultry industry due to disease treatment, decrease in growth rate and egg production, and mortality. APEC are also considered a potential zoonotic risk for humans. Designing successful strategies against their infections and their transmission is therefore a need for human health and economic viability of the industry.

Extraintestinal pathogenic *Escherichia coli* (ExPEC) possess virulence traits that allow it to invade, colonize, and induce disease in bodily sites outside of the gastrointestinal tract. Human diseases caused by ExPEC include urinary tract infections, neonatal meningitis, sepsis, pneumonia, surgical site infections, as well as infections in other extraintestinal locations. ExPEC-induced diseases represent a large burden in terms of medical costs and productivity losses. In addition to human illnesses, ExPEC strains also cause extraintestinal infections in domestic animals and pets. A commonality of virulence factors has been demonstrated between human and animal ExPEC, suggesting that the organisms are zoonotic pathogens. ExPEC strains have been isolated from food products, particularly from raw meats and poultry, indicating that these organisms potentially represent a new class of foodborne pathogens.

Prior attempts with phage therapeutic have failed and modern approaches to these failures have now revealed that phages used for antibacterial therapies in certain specific situations are highly efficient, which makes this new type of treatment very attractive and useful. The bacteriophage preparations, however, must be so selected that virulent, non-toxic, host-specific cocktails are prepared.

Against such a background, there is a need to develop host-specific, non-toxic and virulent bacteriophage preparations that can be used to effectively prevent bacterial infections in livestock.

Embodiments of this invention are directed generally to disease prevention in livestock, particularly in the poultry industry. Certain aspects are directed to prophylactic compositions comprising bacteriophages and methods of using the same.

SUMMARY OF THE INVENTION

A main aspect intended to be addressed by the present invention is to provide phage prophylaxis implemented alone, or as a mixture of phages (cocktail). The phages in such a composition can be optimized for the bacteria targeted.

Alternatively, the use of a cocktail may maximize the range of bacterial targets and minimizes the emergence of bacterial resistance.

This invention relates to a method for preparing a strain of bacteriophage specific to selected opportunistic bacteria, bacteriophage strains obtained in this way and the application of bacteriophages to manufacture a preparation for preventing and fighting infections of livestock, especially poultry, with pathogenic strains of bacteria sensitive to these bacteriophages.

This invention helps provide a production technology for an antimicrobial preparation suitable for use as a food- or feed-additive for livestock, such as for example, poultry, beef and pigs, which at the same time is specific to opportunistic bacteria, such as for example, pathogenic strains of *E. coli* that cause incidence of disease or death.

The present invention helps provide a preparation that could replace the currently used antibiotics in livestock.

With the aim of providing an alternative source of antibacterial compositions for the prevention of opportunistic or pathogenic bacteria, there is provided an isolated bacteriophage (i.e. bacteriophage strain) specific against an opportunistic bacterial infection in livestock, wherein the bacteriophage has an absence of a gene coding for an integrase.

According to a particular embodiment, the bacteriophage strain further has at least one of: an absence of toxin gene; an absence of antibiotic resistance gene; and an absence of 16S RNA pathogenic gene marker.

According to a particular embodiment, the bacteriophage strain further has at least one of: a stability at a temperature between 4° C. and RT; a stability at pH 4; and a burst size greater than 10 against the opportunistic bacterial infection.

In accordance with a further aspect of the invention, there is provided a method for selecting a bacteriophage for preventing an opportunistic bacterial infection in livestock, the method comprising: a) isolating a plurality of bacteriophage strain from an environmental sample; b) characterizing the bacteriophage strain based on an absence of integrase gene, and optionally at least one of: bacterial host range; burst size; toxin gene; antibiotic resistance gene; and 16S RNA gene; c) selecting at least one of the characterized bacteriophage strain based on an absence of integrase gene, and optionally at least one criteria selected from: absence of toxin gene; absence of antibiotic resistance gene; and absence of 16S RNA pathogenic gene marker. Particularly, the method further comprises the selection of the bacteriophage based on at least one of: stability between 4° C. and RT; stability at pH 4; and a burst size greater than 10 against the opportunistic bacterial infection.

According to a particular embodiment, the method further comprises: c) selecting at least two of the characterized strain based on: having different or complementary host ranges against at least 2 different bacterial strain; and d) combining the at least two selected bacteriophage strain to form a cocktail.

In accordance with a particular aspect of the present invention, there is provided a cocktail comprising at least two bacteriophage strains as defined herein, having complementary host ranges against at least 2 different opportunistic bacterial strain.

DETAILED DESCRIPTION OF THE INVENTION

Description of the Figures

FIG. 4. Host range of a first set of phages against 35 APEC strain. The lysis efficiency was measured on a scale of 0 to 3 (0: no lysis, 1: turbid lysis, 2: partial lysis; and 3 complete lysis).

FIG. 5. Host range of a second set of phages against 8 APEC strain. The lysis efficiency was measured on a scale of 0 to 3 (0: no lysis, 1: turbid lysis, 2: partial lysis; and 3 complete lysis).

FIG. 7. Scheme illustrating the dilution methodology for precise titration of phages.

ABBREVIATONS AND DEFINITIONS

Abbreviations

Figure 1:
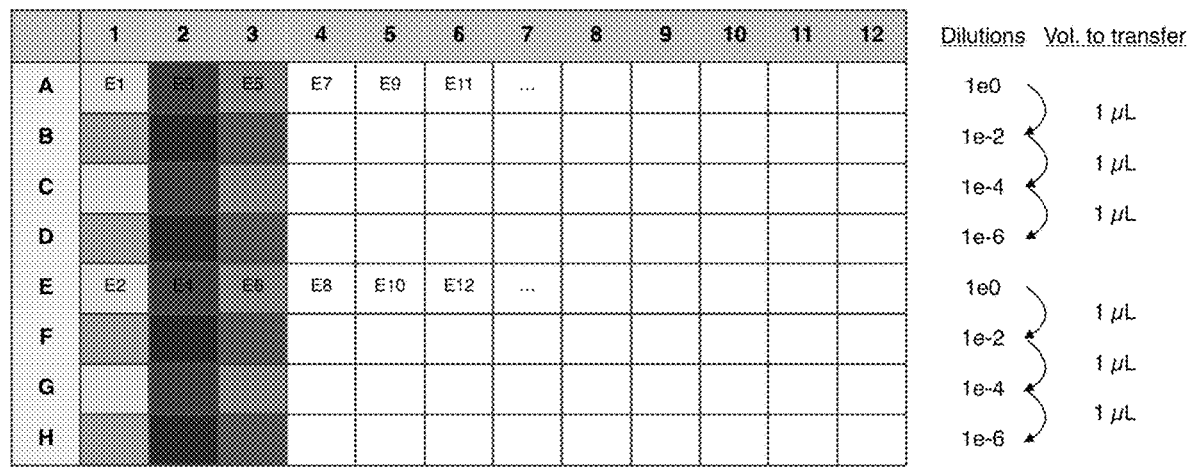
FIG. 1. Picture of dilution methodology for enrichment of phages.

APEC A: *Escherichia coli* QT217=*Escherichia coli* X7122; APEC B: *Escherichia coli* QT4438=*Escherichia coli* MT78; APEC C: *Escherichia coli* QT3694=*Escherichia coli* 598; APEC D: *Escherichia coli* QT2550=*Escherichia coli* TK3; APEC E: *Escherichia coli* QT2551=*Escherichia coli* CH9; APEC F: *Escherichia coli* CH14; 4805A: *Escherichia coli* 4805A; 4813A : *Escherichia coli* 4813A; 4824A: *Escherichia coli* 4824 A; 4806A: *Escherichia coli* 4806A; 4815A: *Escherichia coli* 4815A; 4817A: *Escherichia coli* 4817A; 4819A: *Escherichia coli* 4819A; 4821 A: *Escherichia coli* 4821 A; 4829: *Escherichia coli* 4829; 4818: *Escherichia coli* 4818; 4823A: *Escherichia coli* 4823A; 4828B: *Escherichia coli* 4828B; 4809A: *Escherichia coli* 4809A; 481 1 A: *Escherichia coli* 481 1 A; 4816A: *Escherichia coli* 4816A; 4825A: *Escherichia coli* 4825A; 4826A: *Escherichia coli* 4826A; 4831 A: *Escherichia coli* 4831 A; 4820A: *Escherichia coli* 4820A; 4832A: *Escherichia coli* 4832A; 4833A: *Escherichia coli* 4833A; 4830A: *Escherichia coli* 4830A; 4822: *Escherichia coli* 4822; 4812: *Escherichia coli* 4812; 4814A: *Escherichia coli* 4814A; 4827A: *Escherichia coli* 4827A; 4807A: *Escherichia coli* 4807A; 4808A: *Escherichia coli* 4808A; 481 OA: *Escherichia coli* 481 OA.

Definitions

As used herein the singular forms "a", "and", and "the" include plural referents unless the context clearly dictates otherwise. Thus, for example, reference to "a cell" includes a plurality of such cells and reference to "the culture" includes reference to one or more cultures and equivalents thereof known to those skilled in the art, and so forth. All technical and scientific terms used herein have the same meaning as commonly understood to one of ordinary skill in the art to which this invention belongs unless clearly indicated otherwise.

The terms "about" or "around" as used herein refers to a margin of +or −10% of the number indicated. For sake of precision, the term about when used in conjunction with, for example: 90% means 90% +/−9% i.e. from 81% to 99%. More precisely, the term about refers to +or −5% of the number indicated, where for example: 90% means 90% +/−4.5% i.e. from 86.5% to 94.5%. When used in the context of a pH, the term about means +/−0.5 pH unit.

As used in this specification and claim(s), the words "comprising" (and any form of comprising, such as "comprise" and "comprises"), "having" (and any form of having, such as "have" and "has"), "including" (and any form of including, such as "includes" and "include") or "containing" (and any form of containing, such as "contains" and "contain") are inclusive or open-ended and do not exclude additional, un-recited elements or method steps.

As used herein, the terms "disease" and "disorder" may be used interchangeably or may be different in that the particular malady or condition may not have a known causative agent (so that etiology has not yet been worked out) and it is therefore not yet recognized as a disease but only as an undesirable condition or syndrome, wherein a more or less specific set of symptoms have been identified by clinicians.

The term "subject" or "patient" as used herein refers to an animal, preferably a mammal, and most preferably a human who is the object of treatment, observation or experiment.

"Mammal" includes humans and both domestic animals such as laboratory animals and household pets, (e.g. cats, dogs, swine, cattle, sheep, goats, horses, rabbits), farm animals such as livestock, poultry etc. and non-domestic animals such as wildlife and the like.

The term "isolated" is used herein to indicate that the bacteriophage exists in a physical milieu distinct from that in which it occurs in nature. For example, the isolated phage may be substantially isolated (for example enriched or purified) with respect to the complex cellular milieu in which it naturally occurs, and other bacteriophage strain with which it is found in nature. In some circumstances, the isolated bacteriophage forms part of a composition (for example containing many other substances) or buffer system, which may for example contain other components.

The bacteriophages(s) described herein can be formulated as pharmaceutical compositions by formulating with carrier such as food- or feed-acceptable carrier, especially veterinary food- or feed-acceptable carriers or excipients, in particular, for poultry or chicks.

As used herein, the term "food- or feed-acceptable" refers to molecular entities and compositions that are physiologically tolerable and do not typically produce an allergic or similar unwanted reaction, such as gastric upset, dizziness and the like, when administered to mammals. Preferably, as used herein, the term "food- or feed-acceptable" means approved by regulatory agency of the federal or state government for use in mammals, and more particularly in poultry.

The term "carrier" refers to a diluent, adjuvant, excipient, or vehicle with which the compounds of the present invention may be administered. Sterile water or aqueous saline solutions and aqueous dextrose and glycerol solutions may be employed as carrier, particularly for injectable solutions. Suitable pharmaceutical carriers are described in "Remington's Pharmaceutical Sciences" by E. W. Martin.

The term "effective amount" means an amount effective, at dosages and for periods of time necessary, to achieve the desired therapeutic or prophylactic result. An "effective amount" of an anti-bacterial agent, in reference to decreasing bacterial cell growth, means an amount capable of decreasing, to some extent, the growth of targeted bacteria. The term includes an amount capable of invoking a growth inhibitory, cytostatic and/or cytotoxic effect and/or killing of targeted bacteria. Particularly, the term effective amount means a decrease by 10%, 20%, 30%, 40%, 50%, 60%, 70%, 80%, 90%, 95%, 98% and/or 99% of the original bacterial count.

The terms "inhibiting," "reducing," or "prevention," or any variation of these terms, when used in the claims and/or the specification includes any measurable decrease or complete inhibition to achieve a desired result. Particularly, the term "inhibiting" or "reducing" means a decrease by 10%, 20%, 30%, 40%, 50%, 60%, 70%, 80%, 90%, 95%, 98% and/or 99% of the original bacterial count.

DETAILED DESCRIPTION OF PARTICULAR ASPECTS OF THE INVENTION

Bacterial infections are most frequently treated by the administration of antibiotics. However, antibiotic treatment is sometimes not effective, especially when the infection is biofilm-based, and in some cases, antibiotics promote the formation of biofilms (Costa et al., *Vet Microbiol* (2012), 160, 488-90). Furthermore, the continued use of antibiotics over many years has led some of these bacteria to become resistant to multiple antibiotics (multi-antibiotic resistant) (Saini et al., *J Dairy Sci* (2012), 95, 4319-32).

Historically, antibiotic therapy was predicated by therapies that employed bacterial viruses (bacteriophages or phages) as agents to kill pathogenic bacteria (Summers, *Ann Rev Microbiol* (2001), 55:437-51; Huff et al., *Avian Diseases* (2003), 47:1399-1405; Johnson et al., Animal Health Res Rev (2008), 9:201-15; Clark and March, TRENDS Biotechnol (2006), 24:212-18; Kutter et al., *Curr Pharmaceut Biotechnol* (2012), 11:69-86). This phage therapy has also been used to treat farm and ranch animals such as chickens, hogs, and cattle (Summers, *Ann Rev Microbiol* (2001), 55:437-51; Huff et al., Avian Diseases (2003), 47:1399-1405; Johnson et al., *Animal Health Res Rev* (2008), 9:201-15). In some cases, for example in the treatment of typhoid fever, phage therapy was dramatically effective.

However, it was not always effective for treatment of farm/ranch animals or humans (Summers, *Ann Rev Microbiol* (2001), 55:437-51; Huff et al., Avian Diseases (2003), 47:1399-1405; Johnson et al., *Animal Health Res Rev* (2008), 9:201-15; Clark and March, *TRENDS Biotechnol* (2006), 24:212-18; Kutter et al., *Curr Pharmaceut Biotechnol* (2012), 11:69-86). Most early studies on phage therapy were not rigorously controlled.

Other than some isolated success with the treatment of *E. coli*-caused diarrhea in calves, advances in phage therapy have been incremental and largely disappointing. More effective phages are needed, more rapid methods for isolating and recognizing effective phages, and potentially, more effective multi-phage-containing cocktails. These methods must be combined to improve the phage therapy and prophylaxis of the infectious diseases of both farm and ranch animals.

In accordance with the needs identified herein, the present invention provides compositions directed to disease prevention in livestock, particularly in the poultry industry. Certain embodiments are directed to prophylactic compositions comprising bacteriophages and methods of using the same.

Selecting and Isolating Bacteriophage Strains

With the aim of providing an alternative source of anti-bacterial composition for the prevention of opportunistic or pathogenic bacteria, there is provided a method for manufacturing a bacteriophage/bacteriophage strain/bacteriophage composition for the prevention of an opportunistic bacterial infection in livestock, the method comprising: a) isolating a plurality of bacteriophages from an environmental sample, b) characterizing the bacteriophages based on absence or presence of an integrase gene; and c) selecting one or more bacteriophage strain having an absence of integrase gene for making the composition.

Thus, in accordance with a particular embodiment of the invention, there is provided an isolated bacteriophage strain specific against an opportunistic bacterial infection in livestock, wherein the bacteriophage strain has an absence of a gene coding for an integrase.

Further Selection of Bacteriophage Strains

In accordance with a further embodiment, the bacteriophage strain is further characterized by being at least one of: directed towards a plurality of bacterial hosts; and/or a burst size greater than 10.

In accordance with a further embodiment, the bacteriophage strain is further characterized by being at least one of: stable between about 4° C. and RT and stable at pH about 4.

In accordance with a particular embodiment of the invention, the bacteriophage is further characterized as having at least one of: an absence of toxin gene; an absence of antibiotic resistance gene; and an absence of 16S RNA gene marker.

Particularly, the bacteriophage is further characterized as having at least two of: a target pattern directed towards a plurality of bacterial hosts; a burst size greater than 10 against at least one of the bacterial hosts; an absence of toxin gene; an absence of antibiotic resistance gene; and an absence of 16S RNA gene marker; stability at a temperature between 4° C. and RT; and stability at pH 4.

More particularly, the isolated bacteriophage strain is characterized by: an absence of a gene coding for an integrase, and optionally as having at least three of: a target pattern directed towards a plurality of bacterial hosts; a burst size greater than 10 against at least one of the bacterial host; an absence of toxin gene; an absence of antibiotic resistance gene; and an absence of 16S RNA gene marker; stability at a temperature between 4° C. and RT; and stability at pH 4.

Most particularly, the isolated bacteriophage strain is characterized by: an absence of a gene coding for an integrase, and optionally as having all of: a target pattern directed towards a plurality of bacterial hosts; a burst size greater than 10 against at least one of the bacterial host; an absence of toxin gene; an absence of antibiotic resistance gene; and an absence of 16S RNA gene marker; stability at a temperature between 4° C. and RT; and stability at pH 4.

Still, most particularly, the isolated bacteriophage strain is characterized by: an absence of a gene coding for an integrase, and having all of: a target pattern directed towards a plurality of bacterial hosts; a burst size greater than 10 against at least one of the bacterial host; an absence of toxin gene; an absence of antibiotic resistance gene; and an absence of 16S RNA gene marker; and optionally, having: stability at a temperature between 4° C. and RT; and stability at pH 4.

Method for Production

Alternatively, there is provided a method for producing a bacteriophage/bacteriophage strain/bacteriophage composition for the prevention of an opportunistic bacterial infection in livestock, the method comprising: a) isolating a plurality of bacteriophage strain from an environmental sample; b) characterizing the bacteriophage strain based on at least one of: bacterial host range; burst size; toxin gene; antibiotic resistance gene; and 16S RNA gene; c) selecting at least one of the characterized bacteriophage strain based on at least two criteria selected from: i) absence of toxin gene; ii) absence of antibiotic resistance gene; and iii) absence of 16S RNA gene.

According to a particular embodiment, the method is carried out wherein the bacteriophage strain is further characterized and selected based on c) at least one criterium selected from: plurality of bacterial host; and a burst size greater than 10.

Particularly, the method further comprises: c) selecting at least two of the characterized bacteriophage strains based on having different or complementary host ranges against at least two different opportunistic bacterial strains; and d) combining the at least two selected bacteriophage strains to form a bacteriophage cocktail composition.

According to an alternative embodiment, there is provided the method as defined above, wherein the bacteriophage strain is further characterized and selected based on at least one of: b) characterizing toxin gene or antibiotic resistance gene or 16S RNA gene; and c) selecting is further based on at least one criteria selected from: absence of toxin gene; absence of antibiotic resistance gene; and absence of 16S RNA gene marker.

Particularly, the method comprises further characterizing the bacteriophage strain based on at least one of: b) temperature stability; stability at pH 4; and c) further selecting said characterized bacteriophage specie based on at least one criterion selected from: being stable at RT and/or pH 4.

According to a particular embodiment, the method further comprises: c) selecting at least two of the characterized strain based on: having different or complementary host ranges against at least 2 different bacterial strain; and d) combining the at least two selected bacteriophage strain to form a bacteriophage cocktail composition.

According to a particular embodiment of the method of the invention, the bacteriophage strain chosen for the prophylactic composition may be selected based on at least 3 or more criteria defined in step c). More particularly, the bacteriophage strain may be selected based on all criteria defined in step c).

In accordance with a particular embodiment of the present invention, the method as defined herein further comprising, in step d), combining at least 3 bacteriophage strains to form a bacteriophage cocktail composition. Alternatively, the method further comprises, in step d), combining at least 5 bacteriophage strains to form a bacteriophage cocktail composition.

Composition/Formulation/Cocktail

In accordance with a particular embodiment of the invention, there is provided the bacteriophage strain as defined herein and selected from the group consisting of: SEQ ID Nos: 1, 2,3, 4, 5, 6, 7, 8, 9, 10, 11, 12, 13, 14, 15, 16, 17, 18, 19, 20, 21, 22, 23, 24, 25, 26, 27 and 28. Particularly, the bacteriophage strain is selected from the group consisting of SEQ ID Nos: 9, 11, 13, 14, 21, 25 and 28.

Alternatively, the bacteriophage strains are defined by deposits filed at the International Canadian Depository Authority (IDAC) on Sep. 7, 2018, bearing numbers #: 070918-02; 070918-03; 070918-04; 070918-05 and 070918-06.

In accordance with a particular embodiment of the invention, there is provided a composition comprising at least one of the bacteriophages as defined herein, optionally in admixture with a physiologically acceptable carrier. Particularly, the physiologically acceptable carrier may be an excipient, such as water or a feed-compatible excipient.

In accordance with a particular embodiment, the bacteriophage of invention is suspended in a liquid. Alternatively, the composition is the bacteriophage is in dried form, such as a powder obtained after drying, such as for example, spray-drying or lyophilization.

In accordance with a particular embodiment of the invention, there is provided a cocktail composition comprising at least two bacteriophage strains as defined herein. Particularly, there is provided a bacteriophage cocktail comprising at least 2, 3, 4, 5, 6, 7, 8, 9, 10 or more bacteriophage strains as defined herein. More particularly, the cocktail composition comprises two, three, four or five or more bacteriophage strains as defined herein. Most particularly, the cocktail composition comprises five bacteriophage strains as defined herein.

Most particularly, the cocktail comprises at least two of the bacteriophage strains selected from the group consisting of SEQ ID Nos: 9, 11, 13, 14, 21, 25 and 28. Still, most particularly, the cocktail comprises all of the bacteriophage strains as defined by SEQ ID Nos: 9, 11, 14, 21 and 28.

Particularly, the cocktail of the present invention comprises bacteriophages having complementary host ranges against at least two different bacterial strains. More particularly, the cocktail comprises bacteriophages have complementary target specificity on at least two bacterial hosts.

Most particularly, the cocktail comprises bacteriophages directed against bacterial hosts that are selected from the group consisting of: APEC-A, APEC-B, APEC-C, APEC-D, APEC-E and APEC-F.

Alternatively, the cocktail comprises all bacteriophage strains deposited at the IDAC on Sep. 7, 2018, under numbers: 070918-02; 070918-03; 070918-04; 070918-05 and 070918-06.

In accordance with a particular embodiment, the present invention provides a formulation comprising the bacteriophage, composition or cocktail as defined herein, in admixture with a food, or feed or a food- or feed-acceptable carrier. Particularly, in the context of the present formulation, the carrier is water. Alternatively, the formulation is a food- or a feed-additive for livestock. Particularly, the formulation is in the form of a powder. Alternatively, the formulation is a food or a feed for livestock.

In accordance with a particular embodiment, the composition is formulated as a food or feed, and the carrier is a food- or feed-ingredient. Alternatively, the carrier is water, and the formulation is drinking-water for livestock.

In accordance with a particular embodiment, the composition is formulated as food- or feed-additive for livestock. Particularly, the preparation of the bacteriophage/composition/cocktail/formulation complies with strict safety requirements for food, feed, food- or feed-additives.

In accordance with a particular embodiment, there is provided a feed for livestock comprising anti-infection effective amount of the bacteriophage, composition, cocktail, or formulation, all as defined herein.

Method of Manufacture

In accordance with a further embodiment of the invention, there is provided a method of the manufacture of a feed for livestock comprising the step of: admixing the feed as defined herein with the bacteriophage/composition/cocktail/formulation as defined herein.

Uses

In accordance with a further embodiment of the invention, there is provided a use of the bacteriophage, composition, cocktail, or formulation as defined herein, for the prevention of opportunistic or pathogenic infections in livestock.

In accordance with an alternative embodiment of the invention, there is provided the bacteriophage, composition, cocktail of formulation as defined herein, for use in the prevention of opportunistic or pathogenic bacterial infections in livestock.

In accordance with an alternative embodiment, the present invention provides the use of at least one of the bacteriophage strains as defined herein for the manufacture of a composition for preventing opportunistic or pathogenic bacterial infections in livestock.

In accordance with an alternative embodiment, the present invention provides the use of at least two or more of the bacteriophage strains as defined herein for the manufacture of a cocktail for preventing bacterial infections in livestock.

Particularly, there is provided the use of the bacteriophage or cocktail as defined herein for the manufacture of a composition for preventing opportunistic or pathogenic bacterial infections in livestock.

In accordance with an alternative embodiment of the invention, there is provided a use of the bacteriophage as defined herein, or the composition as defined herein, or the formulation as defined herein, for the manufacture of a feed for livestock for preventing opportunistic or pathogenic infections in livestock.

Particularly, in accordance with the use, the bacteriophage is in the form of a powder, and the powder is mixed with foodstuff during the manufacture of feed, or the bacteriophage is added to the drinking water. Alternatively, the bacteriophage is in a liquid form, and the liquid is sprayed on foodstuff during the manufacture of feed, or the bacteriophage is added to the drinking water.

Method of Treatment

More particularly, there is provided a method for preventing an opportunistic or pathogenic bacterial infection in a livestock comprising administering a bacterial growth-inhibiting concentration of the bacteriophage/cocktail/composition/formulation (i.e. bacteriophage alone or in the form of a composition, a cocktail or a formulation) as defined herein to said livestock. Particularly, the administration is oral. Most particularly, the administration is carried out by way of drinking water, food or feed.

In accordance with a particular embodiment, the invention provided a method for preventing APEC infections in poultry comprising adding the bacteriophage/composition/cocktail/formulation as defined herein to drinking water or to feed for consumption by chicks.

In accordance with an alternative embodiment of the invention, there is provided a method for preventing APEC infections in poultry comprising orally administering an anti-infection effective amount of the bacteriophage/composition/cocktail/formulation to chicks by way of drinking water or feed.

In accordance with a further embodiment of the invention, there is provided a method for preventing APEC infections in poultry comprising orally administering to chicks the bacteriophage/composition/cocktail/formulation as defined herein, wherein the bacteriophage is in liquid phase and sprayed on chick's feed, or on the chicks themselves.

According to a further embodiment, the invention provides a method for preventing APEC infections in poultry comprising orally administering to chicks the bacteriophage/composition/cocktail/formulation as defined herein, wherein the bacteriophage is in powder form and is added to chick's feed during manufacture.

Opportunistic/Pathogenic Bacteria

According to a particular embodiment, the invention provides the method as defined herein, where the opportunistic bacterial infection being targeted is caused by bacteria selected from: *Salmonella enterica, Listeria monocytogenes, Escherichia coli, Campylobacter jejuni, Staphylococcus aureus* and *Clostridium perfringens*.

More particularly, the opportunistic bacterium is pathogenic, most particularly, the pathogenic bacterium is *E. coli* such as 0157:H7, still most particularly: an extra-intestinal pathogenic *E. coli* (ExPEC) or an Avian Pathogenic *E. coli* (APEC). Most particularly, the pathogenic bacteria prevented by the bacteriophage of this invention may be one or more of: APEC-A, APEC-B, APEC-C, APEC-D, APEC-E and APEC-F.

Livestock

Particularly, the livestock benefitting from this preventive/curative treatment is selected from: poultry, pigs, beef or veal. More particularly, the livestock is chicken, turkey or pigs. Most particularly, the livestock is a broiler chick from 1 to 34 days old.

Still, most particularly, the pathogenic bacteria stain is an APEC and the livestock is poultry, such as broiler chicks.

The following examples are put forth to provide those of ordinary skill in the art with a complete disclosure and description of how to make and use the present invention and are not intended to limit the scope of what the inventors regard as their invention nor are they intended to represent that the experiments below are all or the only experiments performed. Efforts have been made to ensure accuracy with respect to numbers used (e.g. amounts, temperature, etc.) but some experimental errors and deviations should be accounted for. Unless indicated otherwise, parts are parts by weight, molecular weight is weight average molecular weight, temperature is in degrees Centigrade, and pressure is at or near atmospheric.

EXAMPLES

Isolation, Purification, Characterization and Use of Phages Against E. Coli APEC The present examples describe the methods used to isolate environmental phages against the avian pathogenic Escherichia coli (APEC) and their use to prevent infection and losses in the poultry industry.

Example 1—Isolation of Bacteriophages

Concentration of the Phages from Environmental Samples

This step allows the concentrating of phages from environmental samples prior to the enrichment step that follows. To isolate the phages, 6-8 L environmental samples were collected from different environments (Beauport river [46°51'35.7"N 71°11'48.6"W; 46°52'02.0"N 71°12'34.8"W] from Beauport, and Boyer river [46°47'15.9"N 70°55'24.9"W] near Saint-Charles-de-Bellechasse). Big debris were removed from the sample using paper filters. Polyethylene glycol (PEG—M.W. 8000) and sodium chloride (NaCl) were added to the samples to a final concentration of 10% and 0.5M respectively. The samples were then incubated for 16 h at 4° C. with gentle agitation. The viral suspension was then centrifuged at 12,000 g for 15 min at 4° C. The supernatant was discarded, and the pellet, mainly composed of PEG 8000 and viruses, was gently resuspended in 4 mL of phage buffer (50 mM Tris-HCl pH7.5, 100 mM NaCl and 8 mM MgSO$_4$). Adding 10% of chloroform to the final suspension and incubating 16 h at 4° C. removed residual bacterial contamination to obtain viral concentrates.

ENRICHMENT OF PHAGES FROM THE CONCENTRATE

The enrichment step allowed increasing the concentration of viruses targeting selected bacterial strain.

First Enrichment

All work was carried out under biosafety level 2.

Bacterial strains (APEC A, B, C, D, E and F, etc.) were inoculated and incubated at 37° C. for 16 h on solid LB medium (per L of solid LB medium: 10 g of Bacto Tryptone, 5 g of yeast extract, 10 g of NaCl and 1% agar) the day prior to the enrichment. The day of the experiment, the bacterial strains were inoculated in 2 mL LB medium (per L of LB medium: 10 g of Bacto Tryptone, 5 g of yeast extract and 10 g of NaCl) and pre-incubated at 37° C.

The bacterial cultures were allowed to recover in fresh media by incubating the tubes at 37° C. for 1 h. In the meantime, the viral concentrates were centrifuged at 10 000×g for 10 min to separate the chloroform from the viral suspension. Only the upper phases were kept. Then, 2 mL of the phage concentrates were added to the bacterial culture and incubated 4 h at 37° C. If several bacterial strains were targeted, the concentrate was diluted to enable enrichments with the required number of strains. The first enrichments were kept at 4° C.

Second Enrichment

The targeted bacterial strains were inoculated in 2 mL of LB medium pre-incubated at 37° C. The bacterial cultures were allowed to recover in fresh media for 1 h at 37° C. In the meantime, the first enrichments were centrifuged at 10 000×g for 10 min to pellet remaining bacterial cells and debris. Then, 2 mL of the supernatants were added to the bacterial culture and the mix was incubated 4 h at 37° C.

Third Enrichment

The same steps described in the second enrichment were repeated. Between each enrichment, the phage titer was evaluated using the spot test method described below.

Titration of the Phages Using the Spot Test Assay

The spot test assay allowed rapid estimation of the phage titer in the enrichment steps and was designed for high-throughput screening. First, the bacterial strains were inoculated in 5 mL of sterile saline (0.85% NaCl) to obtain an optical density of 0.05-0.1 at 600 nm (O.D.$_{600\ nm}$). The cell suspensions were used to obtain a confluent bacterial lawn on solid LB medium. To do so, 2 mL of the suspension was deposited on the surface of a LB Petri dish. The suspension was allowed to spread and cover the entire surface of the medium. Then the excess culture was removed with a pipet and tilting the Petri allowed to remove most of the excess. The Petri were then dried close to an open flame for 30 min. This was repeated for each strain and several Petri dishes were prepared to titrate the enrichments on each strain (it is possible to titer 6 enrichments per Petri). One-hundred (100) μL of the enrichments was transferred into a 96 well plate according to the disposition shown in FIG. 1. Ninety-nine (99) μL of phage buffer was then transferred in rows B, C, D, F, G, and H. The enrichments were then diluted 1:99 μL by transferring 1 μL of the enrichments to 99 μL of phage buffer as shown in FIG. 1 (this can be done using a multichannel pipet P10).

Figure 2:
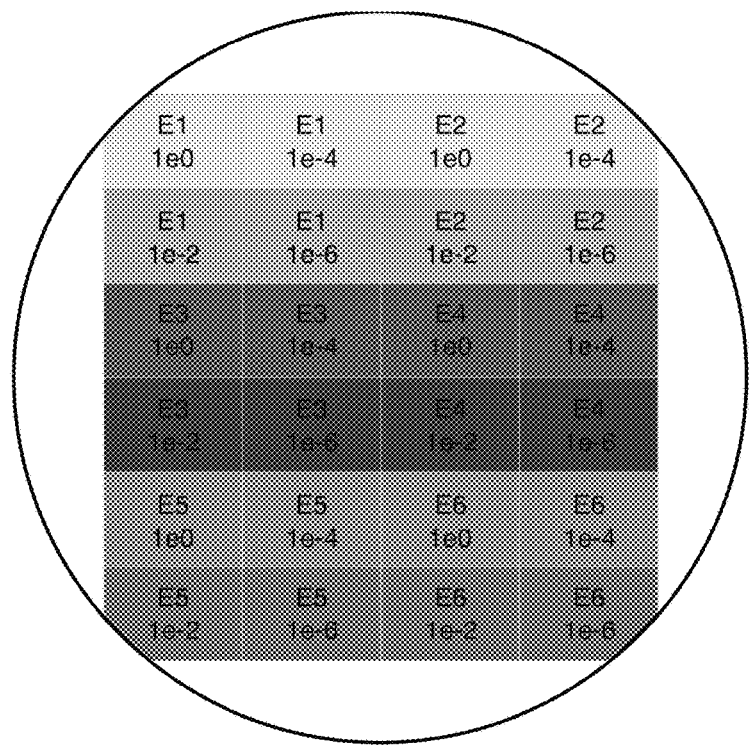
FIG. 2. Disposition of phage dilutions on Petri dish.

To deposit the dilutions on the Petri dish, a box of tips was prepared where each other row was kept empty. Then using the multichannel P100, 5 μL of the dilutions was taken from the plate, starting with B1, D1, F1 and H1 and the drop placed on the Petri dish previously inoculated with the selected bacterial strain according to the disposition shown in FIG. 2. Without changing tips, 5 μL of the dilutions A1, C1, E1 and G1 were taken and each drop placed on the Petri dish according to the disposition shown in FIG. 2. If the dilutions were to be tested against many strains, it was possible to use the electronic multichannel pipet P100 and dispense 5 μL of the dilutions rapidly on many Petri dishes.

The drops on the Petri were left to dry and be completely absorbed in the medium before incubation at 37° C. for 16 h.

When the phage titer reached 1e7 plaque forming units (PFU)/mL, enrichment was stopped, and the purification steps were undertaken as described in Example 2.

Example 2—Purification of Phages Against E. Coli APEC

Purification of Phages

If the titer of phages was high enough (>$10^5$ PFU/mL), the purification procedure was initiated. Purification of phages was carried out with a protocol very similar to the phage titration except that 8 dilutions of the same phage were tested instead of only 4. The phage enrichments were purified on each sensitive strain. This procedure allowed to obtain a single phage specie in solution instead of a mixed population.

First Round of Isolation

First the bacterial strains were inoculated in 5 mL of sterile saline (0.85% NaCl) to obtain an optical density of 0.05-0.1 at 600 nm (O.D.600 nm). The cell suspensions were used to obtain a confluent bacterial lawn on solid LB medium. To do so, 2 mL of the suspension were deposited on the surface of an LB Petri dish. The Petri was tilted to spread the liquid and cover the entire surface of the medium. Then the excess culture was removed with a pipet—tilting the Petri allowed removing most of the excess. The Petri dishes were then dried close to an open flame for 30 min. This was repeated for each strain and several Petri dishes were prepared, in sufficient numbers to make sure there was enough to titrate the enrichments on each strain to be tested (it is possible to titer 6 enrichments per Petri). Meanwhile, 100 μL of the enrichments were transferred into row A of a 96 well plate (again see FIG. 1 for disposition of the enrichments in the 96 well plate). Then, 90 μL of phage buffer were added in the remaining rows. Finally, the enrichments were serially diluted 1:9 to a final dilution factor of 1e-7.

Using the multichannel P100, 10 μL of the dilutions were deposited on the Petri dishes inoculated with the host strains, starting with B1, D1, F1 and H1. Wthout changing tips, 10 μL of the dilutions A1, C1, E1 and G1 were transferred on the same Petri. If the dilutions were tested against many strains, an electronic multichannel pipet P100 was used to dispense 10 μL of the dilutions on many Petri rapidly. The drops on the Petri dishes were left to dry and be completely absorbed in the medium before incubation at 37° C. for 16 h.

Second and Third Round of Isolation

Figure 7:
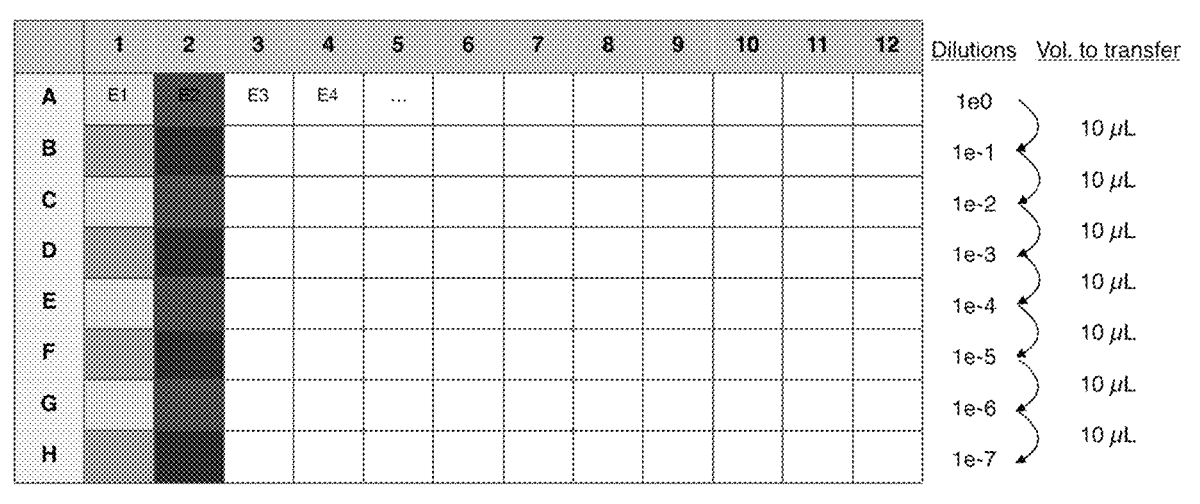

The bacterial lawns were prepared as previously described. Isolated lysis plaques were picked with a truncated pipet tip and transferred to row A of a 96 well plate that was previously filled with 90 μL of phage buffer. The lysis plaques were allowed to diffuse for 30 minutes at room temperature. The phage suspension was then serially diluted 1:9 to a final dilution factor of $10^{-7}$ and 10 μL of the dilutions were transferred on the bacterial lawn as previously described. The same protocol was repeated for the third round of isolation (FIG. 7).

First Amplification of the Purified Phages

After the last round of purification, the isolated lysis plaques were picked with a truncated tip and transferred in a 96 well plate that was previously filled with 200 μL of LB medium inoculated at 1% from an overnight culture of the bacterial host strain. The $OD_{600\ nm}$ was monitored in a plate reader set to incubate at 37° C. When lysis of the bacterial host was observed, the plaque was kept at 4° C. for the second amplification.

Second Amplification of the Purified Phages

The bacterial host strains were first inoculated at 1% in 5 mL of LB medium and incubated at 37° C. until the $O.D._{600\ nm}$ reached 0.1. Then 50 μL of the purified phages were added to the bacterial cultures and incubated until lysis. The phage lysates were centrifuged for 10 min at 5 000×g and filtered through 0.45 μM syringe filters before titration.

Example 3—Characterization E. Coli APEC Bacteriophages

Restriction Profile

The phages' DNA was isolated using standard protocol routinely used in phage research. Briefly, the phage lysates were treated with DNAse and RNAse to remove contaminating host nucleic and ribonucleic acids. Then the proteic capsid was destabilized with a strong detergent to release the viral genomic DNA. Proteins were then removed by precipitation with potassium acetate and centrifugation. Nonetheless, the supernatant still contained traces of proteins that was eliminated with a phenol-chloroform extraction, followed by an ethanol-precipitation of DNA. The final DNA pellet was dissolved in sterile distilled water.

Figure 3:
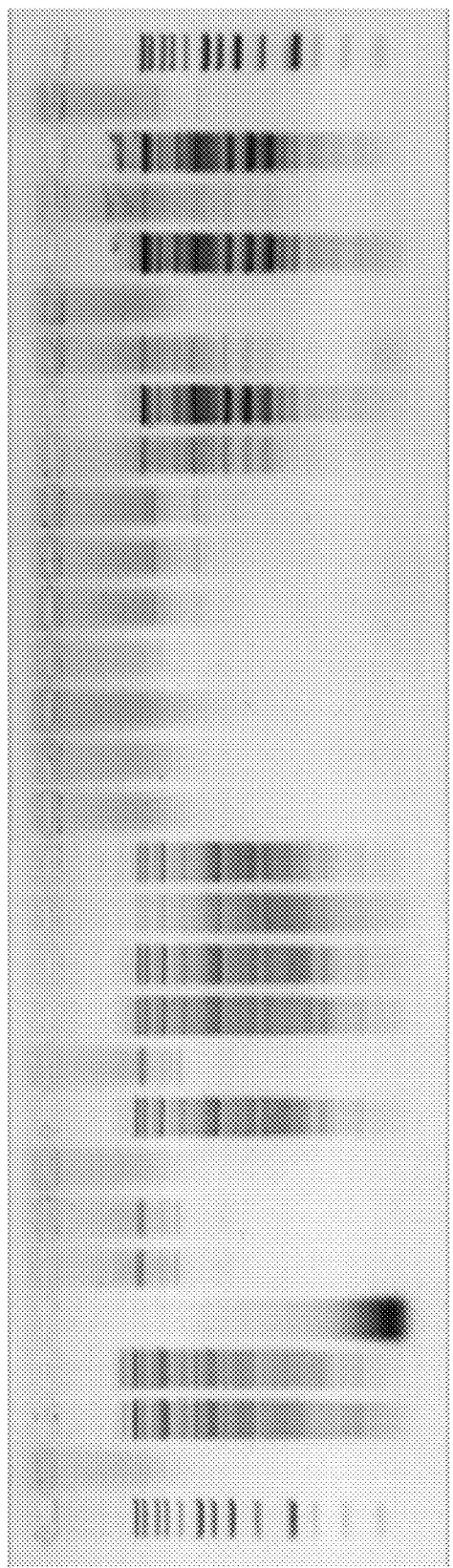
FIG. 3. Ssp1 restriction profile of bacteriophage strain.

The DNA concentration was verified by agarose gel electrophoresis and samples containing enough DNA were digested with restriction enzyme: BamH III or Ssp1. The restriction profile (FIG. 3) of the phages allowed visual identification of unique phages that were selected for further characterization.

Host Range

The host range was defined by the number of different bacterial strains a phage could infect. To determine the host range, a bacterial lawn was made as described previously. Then 200 μL of phage lysate was transferred in a 96 well plate and a multichannel pipet was used to transfer 2.5-3 μL of the lysate on the bacterial lawn. The Petri dishes were incubated at 37° C. for 16 h.

Figure 4:
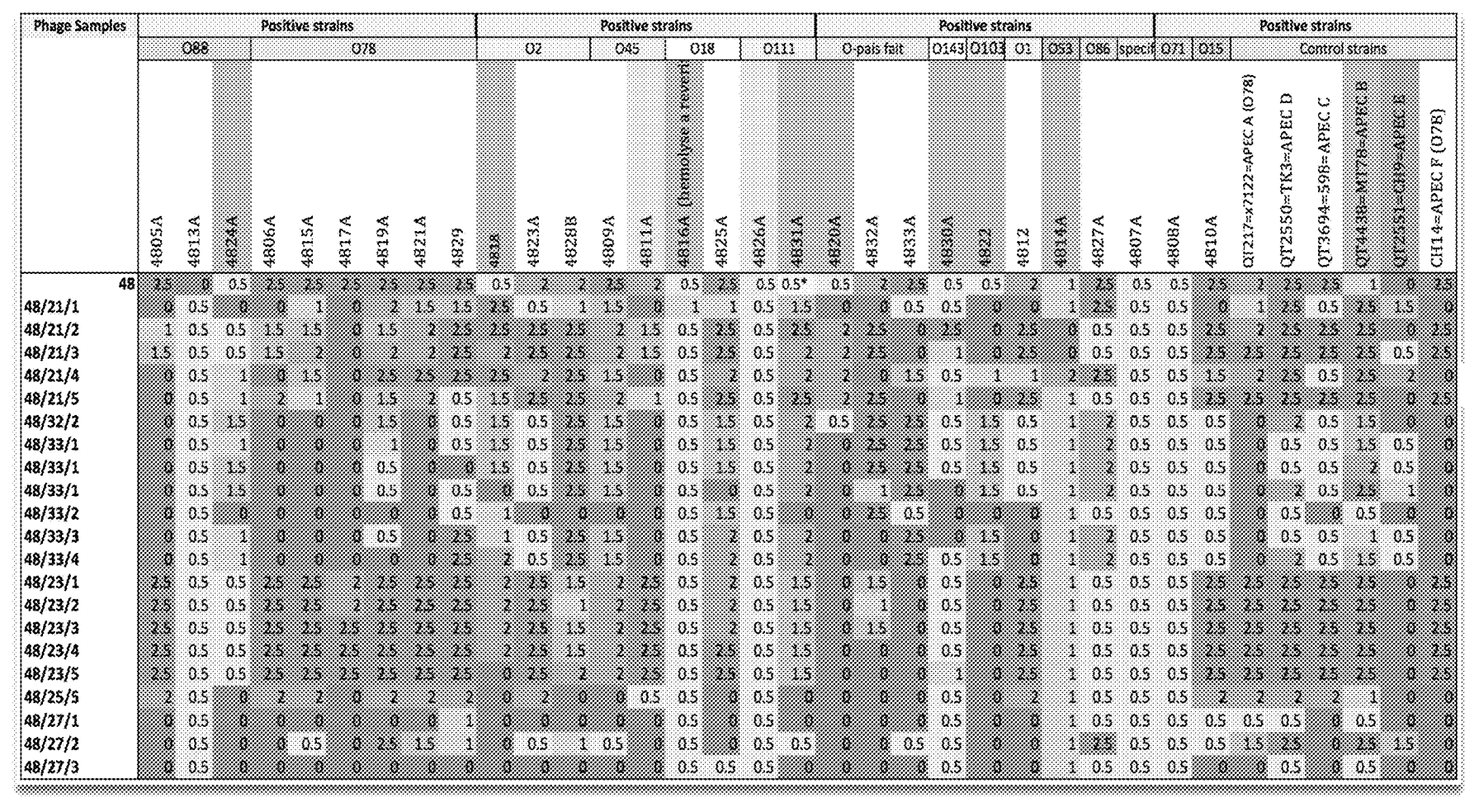

The lysis efficiency was measured on a scale of 0 to 3 (0: no lysis, 1: turbid lysis, 2: partial lysis; and 3 complete lysis). The results shown in FIGS. 4 and 5 demonstrate that the isolated phages are polyvalent and infect many problematic APEC strains isolated from the industry.

Phage Stability—pH

Figure 6:
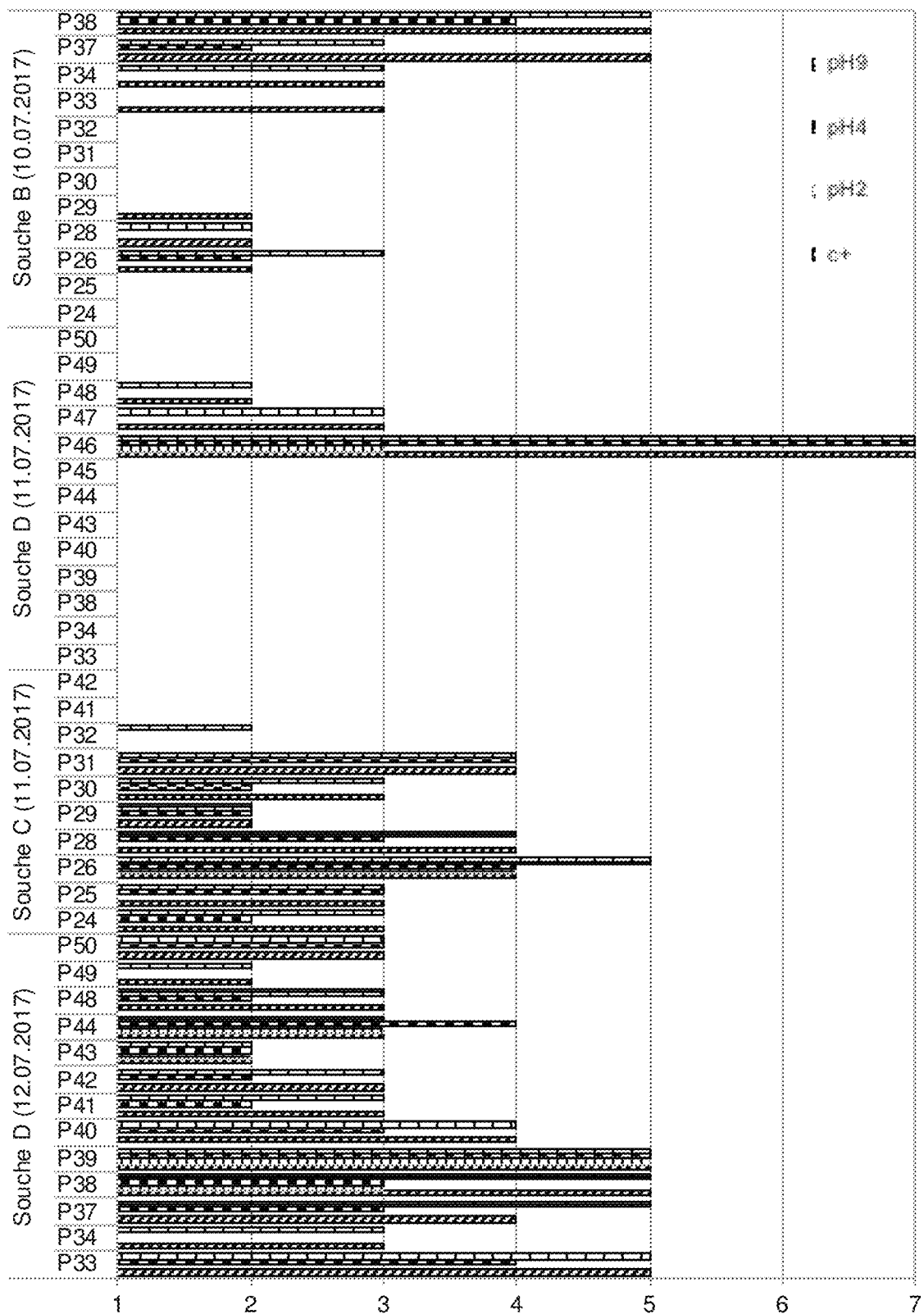
FIG. 6. Stability of the phages to different pH.

The stability of the phages at pH 2, 4 and 9 was tested. First, the pH of liquid LB medium was adjusted to the desired pH either with HCl or NaOH. Then the phages were diluted 1:9 in the acidic or basic LB medium and were incubated for 30 min at room temperature. Before titration, the pH of the medium was neutralized by diluting the treated phages in phage buffer (1:9). The results indicated that the majority of phages were stable at pH 4 and 9, whereas many were affected at pH 2 (FIG. 6).

Phage Stability—Shelf Life

To demonstrate the stability of the phages, samples are kept at 4° C. and at room temperature for more than 9 months. Periodical titrations of these samples reveal that the isolated phages are stable for more than 6 months at 4° C. and at room temperature.

Burst Size and Latency Time

After selecting the phages with different restriction profiles (FIG. 3), broad host range (FIGS. 4 and 5) and stability to acidic pH (FIG. 6), we measured the burst size of the phages. The burst size is a proxy of the virulence of a phage. It corresponds to the number of viruses released by an infected cell. Generally, an infected cell releases an average of 50-100 virions and we wanted to select the phages in our collection that had the highest burst size. Some phages infecting E. coli could have burst size greater than 1000.

To establish the burst size of the present phages, the bacterial host were infected with a phage specie to obtain a phage/host ratio of 5. This ensures that every cell in the culture is infected. The titer is measured at 10 minute-intervals for a total of 60 minutes. The burst size is then calculated by dividing the number of phages at the end of the infectious cycle by the initial number of phages.

Genome Sequence and Detection of Undesired Genes

Figure 8:
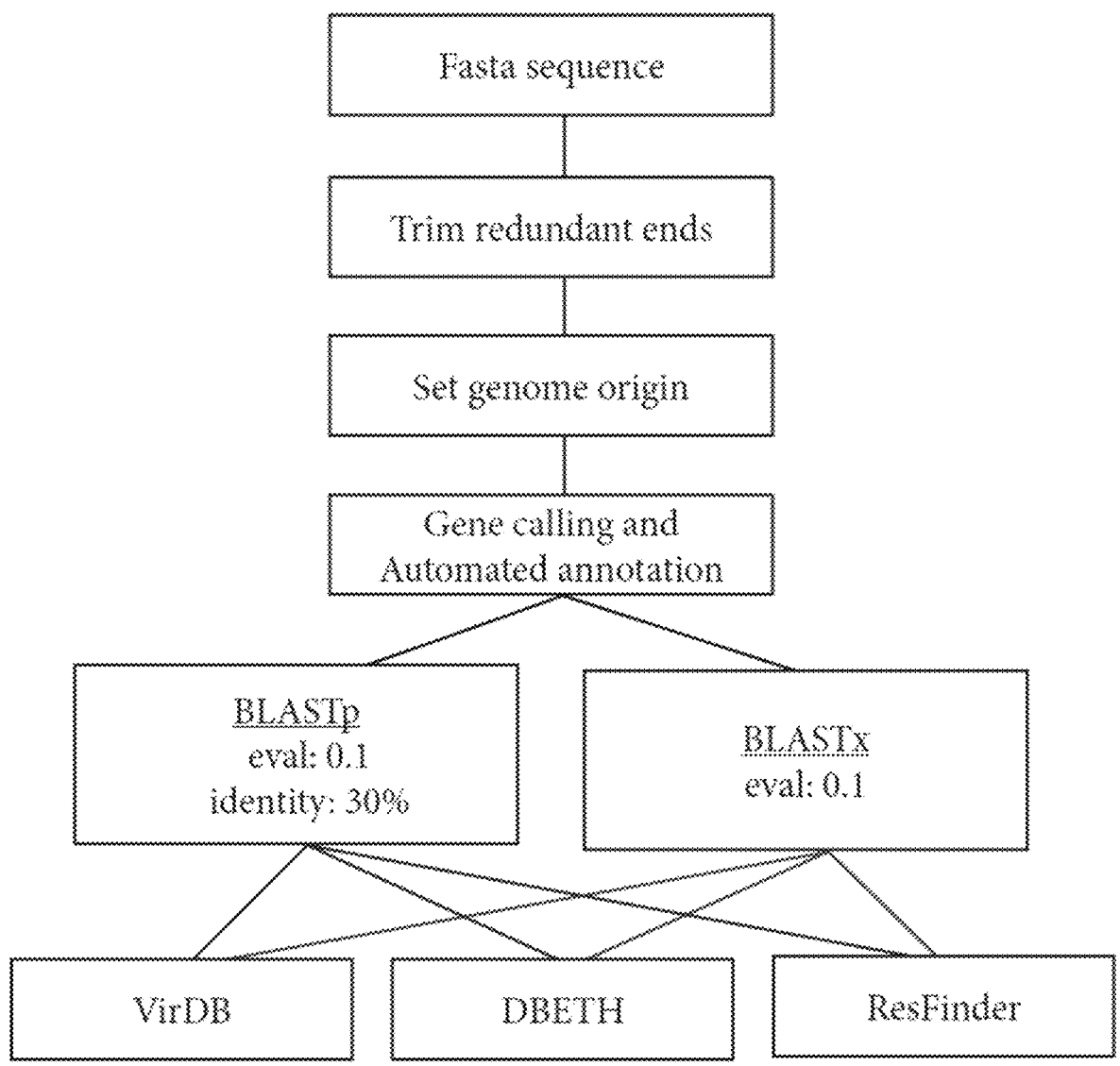
FIG. 8. Scheme illustrating the bioinformatics pipeline to screen the phage genomes.

The genome of the phages with the most interesting features (host range, stability to temperature or pH, burst size) were sequenced using Next Generation sequencing. The genome was assembled using Spades with the default settings. Once the genomes were assembled into one "contig", we verified if the contig had redundant ends. If the ends were redundant, it meant that the genome was complete and circular. Otherwise, more sequencing efforts were carried out for the completion of the genome. This was done using primer walking on the genome by sequencing PCR products, amplified using the phage genome as template. The redundant ends were removed from the complete phage genome using BLASTn and python scripts that aligned the end of the genome and removed the one redundant extremity (FIG. 8).

The coding sequences were detected using the software Genemark. Python scripts were used to convert the Genemark output in a Genbank compliant flat file from which the protein sequences were extracted. Finally, a bioinformatics analysis was carried out to detect the presence of undesired genes such as toxin, antibiotic resistance, 16S RNA and integrase coding genes (FIG. 8).

Toxin genes were identified by searching homologs of the phage's protein and DNA sequence in public databases of known toxins (VirDB and DBETH) and antibiotic resistance genes (ResFinderDB). Programs BLASTp and BLASTx were used to respectively analyze the protein and DNA sequences of each phage. This first step is sensitive but not specific, meaning that the E-value (expectation of error) is set to 0.1 (1 chance out of 10 of false positive). The data were then parsed to keep only alignments that shared more than 30% identity with toxin or antibiotic resistance genes and for which the alignment spanned more that 75% of the length of the longest protein sequence for protein/protein comparison (BLASTp), or more than 75% of the length of the homologous protein in the database for DNA/protein comparison (BLASTx).

Figure 9:
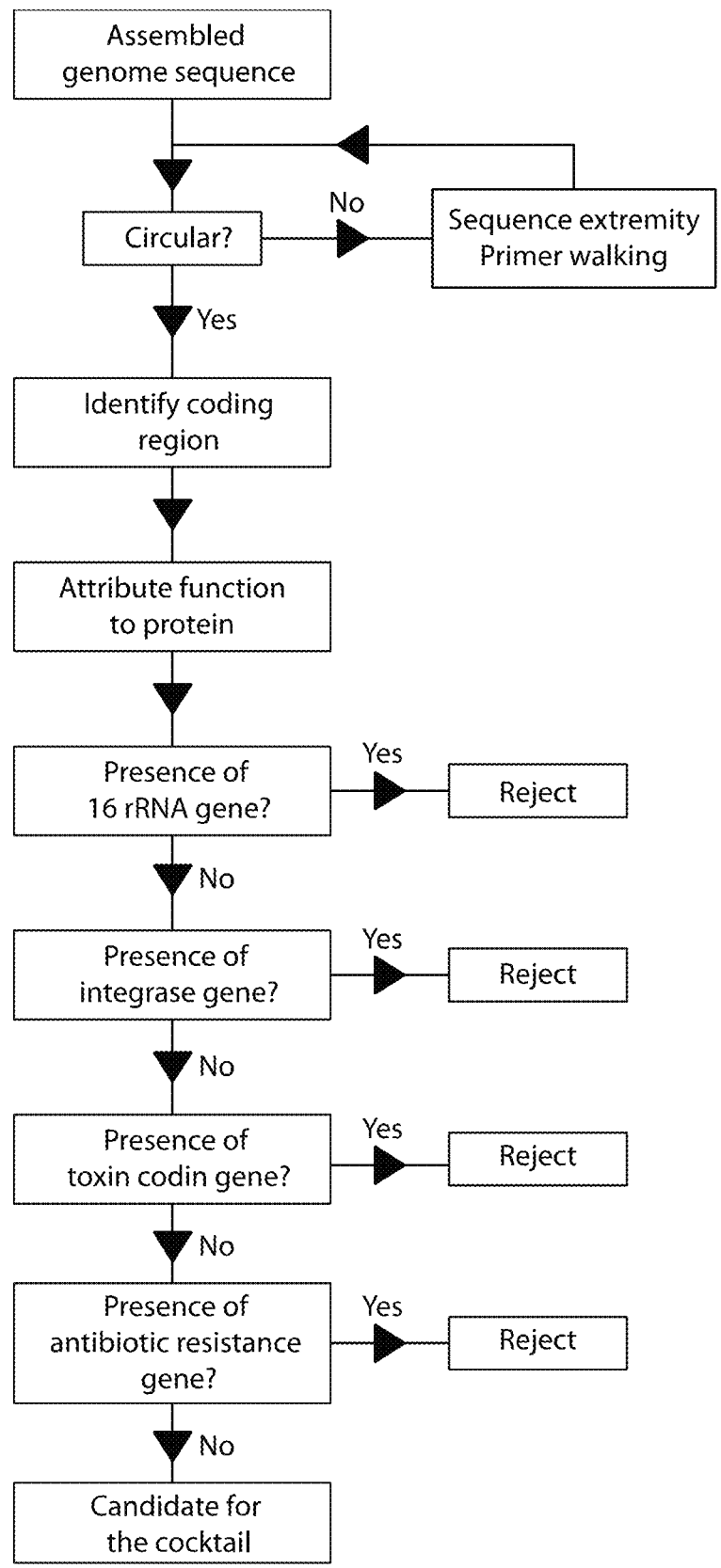
FIG. 9. Scheme illustrating the gene screening pipeline for decision-making in the selection of phages.

A detailed annotation of these phage genomes allowed to detect 16S and integrase coding genes. The translated coding sequences of the phages were compared to the NCBI GenBank database to identify homologous proteins for which the function was known. The program BLASTp was used with a threshold E-value of 1e-3. The top 5 hits were analysed and the function of the phage protein was extrapolated from the function that was previously attributed to these homologous proteins. Finally, we looked for conserved functional domains within our phage proteins to extend the functional annotation. We used InterProScan program and database to screen and detect conserved domains to confirm, infirm or attribute new functions to the phage proteins. This ensured a thorough annotation of the phage proteins and identification of 16S RNA and integrase coding genes. FIG. 9 illustrates the decision tree to keep or reject the phage based on sequence annotations.

The identified phages and their respective DNA sequences are listed in Table 1 and corresponding representative electron microscopy images are shown in FIGS. 12-21.

TABLE 1

Overview of the phage genome assemblies and morphology.

| Phage | Size | Coverage | Best Hits | Acc. number | Hit Size | Species | EM picture | SEQ ID NO. |
|---|---|---|---|---|---|---|---|---|
| 5a | 356230 | 173.289 | Escherichia phage vB_Eco_slurp01 genome assembly, chromosome: I | LT603033 | 348043 | Giant Phage | FIG. 12 | 27 |
| 11 | 354341 | 211.399 | Escherichia phage vB_Eco_slurp01 genome assembly, chromosome: I | LT603033 | 348043 | Giant Phage | FIG. 13 | 9 |
| 8a | 72689 | 753.93 | Escherichia phage vB_EcoP_PhAPEC7, complete genome | KF562340 | 71778 | Podoviridae; G7cvirus | FIG. 14 | 28 |

TABLE 1-continued

Overview of the phage genome assemblies and morphology.

| Phage | Size | Coverage | Best Hits | Acc. number | Hit Size | Species | EM picture | SEQ ID NO. |
|---|---|---|---|---|---|---|---|---|
| 35a | 72689 | 658.444 | *Escherichia* phage vB_EcoP_PhAPEC7, complete genome | KF562340 | 71778 | Podoviridae; G7cvirus | | 14 |
| 42b | 72689 | 49.4428 | *Escherichia* phage vB_EcoP_PhAPEC7, complete genome | KF562340 | 71778 | Podoviridae; G7cvirus | FIG. 15 | 19 |
| 43b | 72689 | 152.16 | *Escherichia* phage vB_EcoP_PhAPEC7, complete genome | KF562340 | 71778 | Podoviridae; G7cvirus | | 22 |
| 44a | 72689 | 41.5239 | *Escherichia* phage vB_EcoP_PhAPEC7, complete genome | KF562340 | 71778 | Podoviridae: G7cvirus | | 23 |
| 47b | 72689 | 16.38 | *Escherichia* phage vB_EcoP_PhAPEC7, complete genome | KF562340 | 71778 | Podoviridae; G7 cvirus | | 26 |
| 33a | 151263 | 47.4752 | *Escherichia* phage ESCO5, complete genome | KX664695 | 149312 | Myo, Distinct clade | | 12 |
| 42a | 150995 | 233.99 | *Escherichia* phage ESCO5, complete genome | KX664695 | 149312 | Myo, Distinct clade | | 18 |
| 43a | 150995 | 383.773 | *Escherichia* phage ESCO5, complete genome | KX664695 | 149312 | Myo, Distinct clade | FIG. 16 | 21 |
| 47a | 150995 | 431.442 | *Escherichia* phage ESCO5, complete genome | KX664695 | 149312 | Myo, Distinct clade | FIG. 17 | 25 |
| 26 | 167442 | 283.7 | Enterobacteria phage RB10, complete genome | KM606999 | 168401 | Myoviridae; Tevenvirinae; T4virus | FIG. 18 | 10 |
| 32 | 167496 | 329.818 | Enterobacteria phage RB10, complete genome | KM606999 | 168401 | Myoviridae; Tevenvirinae; T4virus | FIG. 19 | 11 |
| 39 | 45353 | 1047.35 | Enterobacteria phage K1-5, complete genome | AY370674 | 44385 | Podoviridae; Autographivirinae | | 17 |
| 33b | 43963 | 2452.6 | *Escherichia* virus AAPEc6, complete genome | KX279892 | 44559 | Podoviridae; Autographivirinae | FIG. 20 | 13 |
| 35b | 45597 | 187.416 | *Escherichia* virus AAPEc6, complete genome | KX279892 | 44559 | Podoviridae; Autographivirinae | | 15 |
| 42c | 43963 | 358.238 | Enterobacteria phage K1-5, complete genome | AY370674 | 44385 | Podoviridae; Autographivirinae | FIG. 21 | 20 |
| 44b | 43964 | 1356.68 | *Escherichia* virus AAPEc6, complete genome | KX279892 | 44559 | Podoviridae; Autographivirinae | | 24 |
| 38 | 72689 | 770.811 | *Escherichia* phage ECBP1 | YP_006908771.1 | ? | Podoviridae; G7 virus. | | 16 |
| phi7 | 164948 | | Enterobacteria phage vB_EcoM_IME340, complete genome | MH051916.1 | 165549 | Myoviridae; Tevenvirina: T4virus | | 8 |
| phi49-33-3 | 349740 | | *Escherichia* phage PBECO 4 | KC295538.1 | 348113 | Myoviridae | | 6 |
| phi3_2 | 134466 | | *Escherichia* phage PDX | MG963916.1 | 138427 | Myovirida; Vequintavirinae; unclassified V5virus | | 5 |
| phi3_1 | 170558 | | *Escherichia* phage vB_EcoM_NBG1 | MH243438.1 | 168869 | Myoviridae; Tevenvirina: Rb69virus | | 4 |
| phi18-21-5 | 351003 | | *Escherichia* phage PBECO 4 | KC295538.1 | 348113 | Myoviridae | | 3 |
| phi49-33-4 | 346671 | | *Escherichia* phage PBECO 4 | KC295538.1 | 348113 | Myoviridae | | 7 |

TABLE 1-continued

Overview of the phage genome assemblies and morphology.

| Phage | Size | Coverage | Best Hits | Acc. number | Hit Size | Species | EM picture | SEQ ID NO. |
|---|---|---|---|---|---|---|---|---|
| phi11_1 | 111711 | | *Salmonella* phage Stitch | KM236244 | 123475 | Siphoviridae; T5virus | | 1 |
| Phi11_2 | 58609 | | Enterobacteria phage 9g | KJ419279.1 | 56702 | Siphoviridae; No nagvirus. | | 2 |

Example 4—Cross-Resistance

One more factor to be considered when selecting phages to compose a cocktail is the cross-resistance of the target bacterial strains, i.e. if a bacterial strain becomes resistant to a phage, whether it will also become resistant to other phages comprised in the cocktail.

To investigate cross-resistance, we challenge a bacterial strain (ex. APEC A) with a phage (Ex. Vb_EcoM_SBL001 or SBL001). Using a high phage/bacteria ratio (also named MOI for Multiplicity of Infection) leads to selection of Bacteriophage Insensitive Mutant (BIM). These BIMs are variants that evolve from the initial APEC A strain that are selected with the phage SBL001. A typical MOI to achieve selection of BIMs is close to 1 (1 phage per bacterial strain). Thus, bacterial strain is grown to an $O.D._{600\ nm}$ of 0.1 which correspond to a bacterial concentration of approximately 2e7 PFU/mL and the phage is added to 500 μL of the bacterial culture to reach the 1:1 ratio. The mixture is spread on a Petri dish with LB medium 1% agar and the Petri dish is incubated 16 h at 37° C. The Petri dishes are examined for bacterial colonies that correspond to BIMs selected by the phages.

Ten colonies are picked and transferred to 10 mL of LB medium. After incubation at 37° C., the host range of the phages is tested against these new variants. If a different phage (vB_EcoM_SBL002 for instance) that was infecting this bacterial strain, no longer infects the BIMs, it strongly suggests that both phages SBL001 and SBL002 are using the same receptor at the surface of the bacterial cell. The combination of both SBL001 and SBL002 in the cocktail would not be recommended as the probability of BIM emergence is high. Thus, in the planning the phage cocktail, a cross-resistance scheme is established for all isolated phages.

When combining two or more of these phages, a broad spectrum of APEC strains is targeted (Table 2), hence limiting the chances of selecting spontaneous mutants to less than one event per 1E9 to 1E10 generations.

Representative selected phages were deposited at the International Depositary Authority of Canada on Sep. 7, 2018, under the following numbers: 070918-02; 070918-03; 070918-04; 070918-05 and 070918-06. The phages selected for a first cocktail and their respective DNA sequences are listed in Table 2 Table 3, and corresponding representative electron microscopy images are shown in FIGS. 13, 14, 16, and 19.

TABLE 3

List of phages selected for a first cocktail
Example 5-Production and concentration of the phages

| Phage Strain | | EM picture | SEQ ID NO. | IDAC number |
|---|---|---|---|---|
| 8a | Podoviridae; G7cvirus | FIG. 14 | 28 | 070918-02 |
| 11 | Giant Phage | FIG. 13 | 9 | 070918-03 |
| 32 | Myoviridae; Tevenvirinae; T4virus | FIG. 19 | 11 | 070918-04 |
| 35a | Podoviridae; G7cvirus | | 14 | 070918-05 |
| 43a | Myo, Distinct clade | FIG. 16 | 21 | 070918-06 |

Example 5—Production and Concentration of the Phages

The bacteriophages are produced in 10 L fermenters. The day before, the bacterial seed culture is inoculated in 1 L of 2xYT media and incubated in 2 L flask at 37° C. on an orbital shaker set at 250 RPM. The fermenter vessel is prepared as per the manufacturer's recommendation (BioFlo 320—Eppendorf) and is filled with 10 L of sterile 2xYT media. The fermenter is inoculated with 500 mL of the seed culture. The auto culture mode is used for the optimal growth of *E. coli* until it reaches an $OD_{600\ nm}$ of 5. Then the agitation speed is reduced to a maximum of 250 RPM and

TABLE 2

List of host APECs targeted by the cocktail

| Phage (SEQ ID NO.) | APEC targets | | | | | | |
|---|---|---|---|---|---|---|---|
| | APEC-A | APEC-B | APEC-C | APEC-D | APEC-E | APEC-F | Poulvac |
| 8a (28) | 0 | 3 | 0 | 3 | 3 | 0 | 0 |
| 11 (9) | 0 | 2 | 3 | 0 | 0 | 0 | 0 |
| 32 (11) | 3 | 3 | 3 | — | 0 | 3 | — |
| 35a (14) | 0 | 3 | 0 | 3 | 0 | 0 | 0 |
| 43a (21) | 3 | 2 | 0 | 1 | 2 | 0 | 3 |
| 47a (25) | 3 | — | 0 | 1 | 3 | 0 | 3 |
| 33b (13) | 2 | 3 | 0 | — | 3 | 0 | 3 |

0: no lysis, 1: turbid lysis, 2: partial lysis; and 3 complete lysis.

phage is added to obtain a MOI of 0.01. The fermentation is carried on until complete lysis of the culture.

The lysate is first clarified using a 1 μm prefiltration step. Then the phages are purified using a two steps tangential flow filtration (Centramate-PaII). The first step uses 0.45 μm pore membranes that remove the bacterial debris and any remaining living cells. The phages are found in the filtrate. The second step uses 100 kDa pore-size membranes that retain the phages and allows concentration of the lysate. We concentrate the phage at least 10× to obtain high titers. Finally, the phage is diluted 10× with sterile saline (0.85% NaCl) and is concentrated again. This last step allows dilution of the 2xYT media, to be replaced by saline.

Example 6—Preparation of Phage Powder by Spray-Drying

Figure 10:
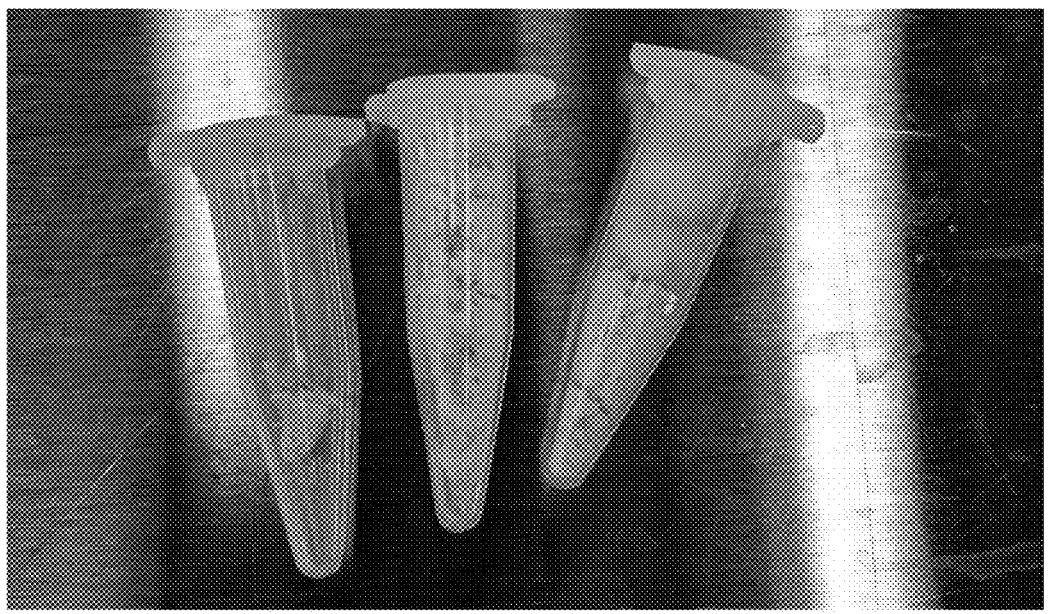
FIG. 10. Picture of the phage powder obtained after spray-drying.

First, lactose was added to the concentrated phage suspension for a final concentration of 2%. The phage suspension was then spray-dried using a mini spray-dryer Büchi-290. The suspension was fed at a constant feed rate 1.8-2.0 mL/min and an atomising airflow of 742 L/h with an aspiration rate of 35 m$^3$/h. The drying inlet air was heated to 62-65° C. and the outlet temperature ranged between 49-52° C. FIG. 10 shows the powder obtained.

Example 7—In-Vivo Investigation of the Effect of the Bacteriophage Preparation on Broiler Chicks—Laboratory-Scale Experiment This assay included 6 groups of chicks: A1) contaminated with *E. coli* X-A7122; A2) contaminated with *E. coli* X-A7122 and treated with phages; B1) contaminated with *E. coli* CM138; B2) contaminated with *E. coli* CM138 and treated with phages; C1) contaminated with *E. coli* MT78; C2) contaminated with *E. coli* MT78 and treated with phages. The respective concentration of the several (i.e. two to seven, or more) bacteriophages comprised in the cocktail was adjusted to 1e8 PFU/ml. Then, the phages were mixed by adding an equal volume of each in a mixing vessel. The phage cocktail was mixed to grounded feed. The mash was administered to the treated group with truncated pipet tip on day 1. The chicks of all groups were then contaminated with 1e8 CFU with the *E. coli* strains stated above. The bacterial strains were beforehand genetically modified and selected for nalidixic acid resistance allowing specific enumeration of these strains within the microbial community. None of the commensal strains were found to be resistant to this antibiotic marker.

Figure 11:
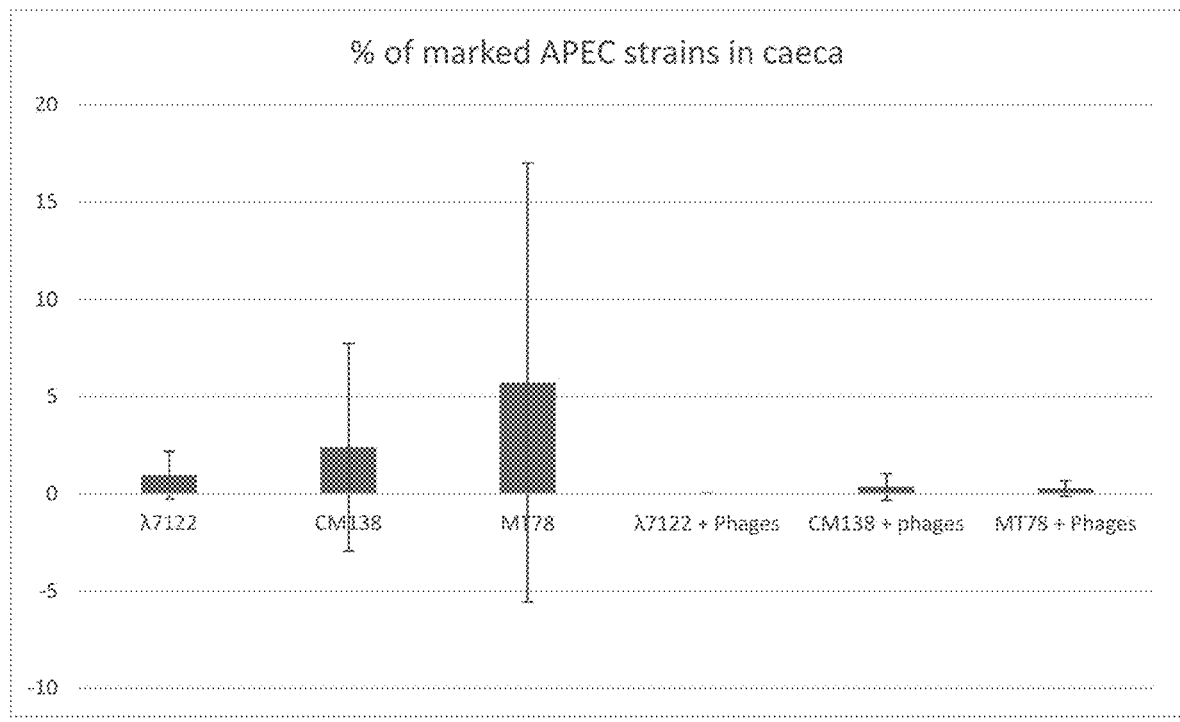
FIG. 11. Efficiency of elimination of *E. coli* by phages in laboratory-scale assay on chicken.
Figure 12:
FIG. 12. Representative electron microscopy image of phage 5a (SEQ ID NO: 27).
Figure 13:
FIG. 13. Representative electron microscopy image of phage 11 (SEQ ID NO: 9).
Figure 14:
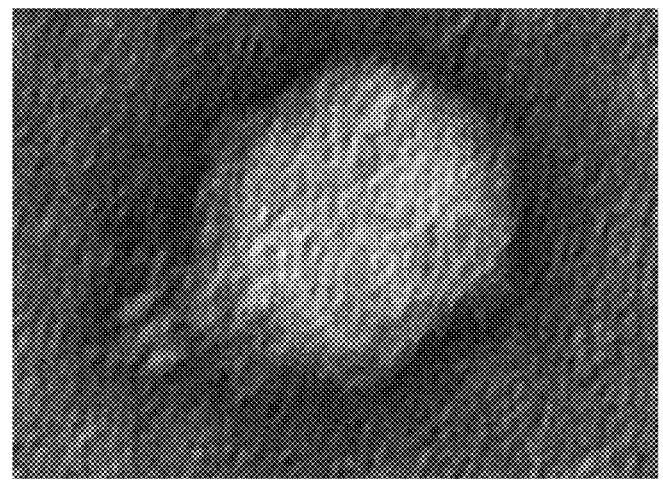
FIG. 14. Representative electron microscopy image of phage 8a (SEQ ID NO: 28).
Figure 15:
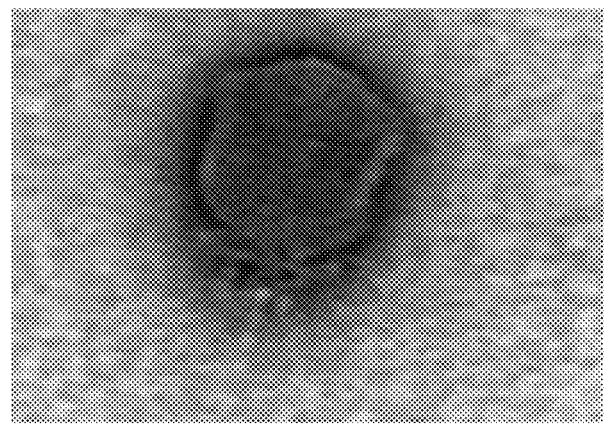
FIG. 15. Representative electron microscopy image of phage 42b (SEQ ID NO: 19).
Figure 16:
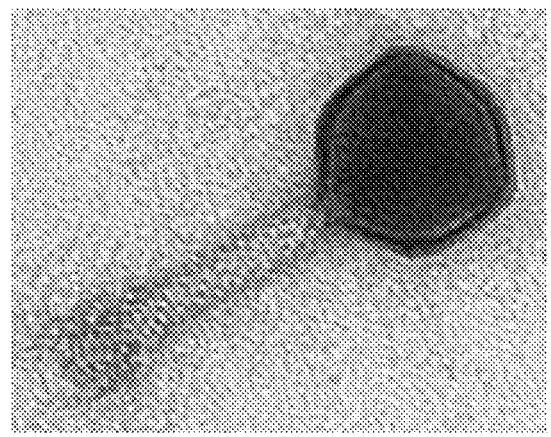
FIG. 16. Representative electron microscopy image of phage 43a (SEQ ID NO: 21).
Figure 17:
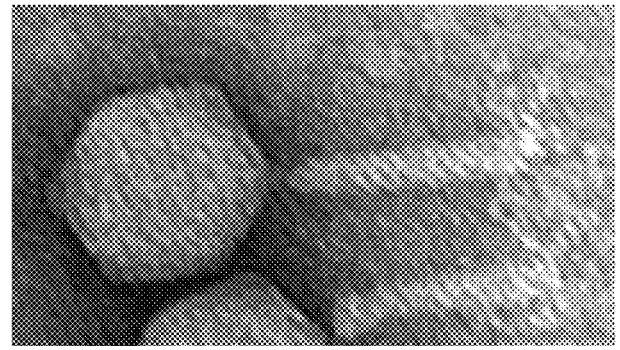
FIG. 17. Representative electron microscopy image of phage 47a (SEQ ID NO: 25).
Figure 18:
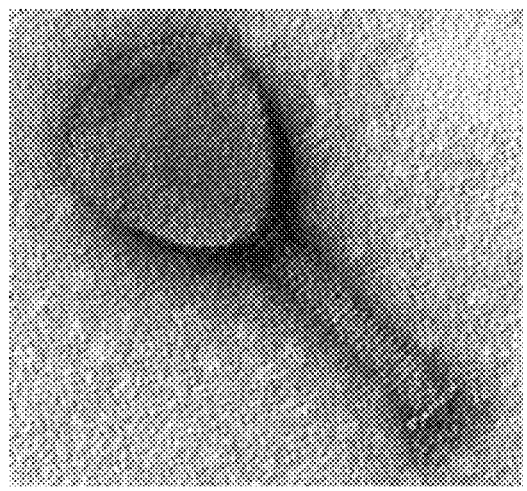
FIG. 18. Representative electron microscopy image of phage 26 (SEQ ID NO: 10).
Figure 19:
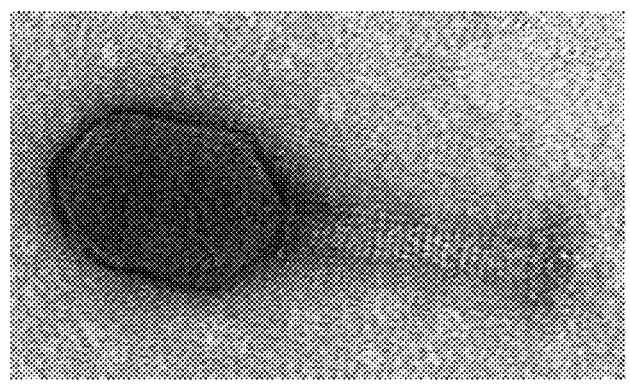
FIG. 19. Representative electron microscopy image of phage 32 (SEQ ID NO: 11).
Figure 20:
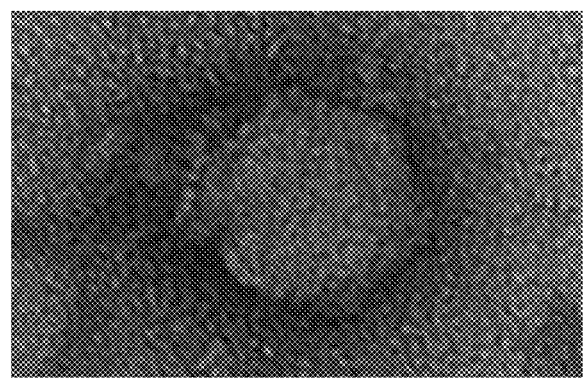
FIG. 20. Representative electron microscopy image of phage 33b (SEQ ID NO: 13).
Figure 21:
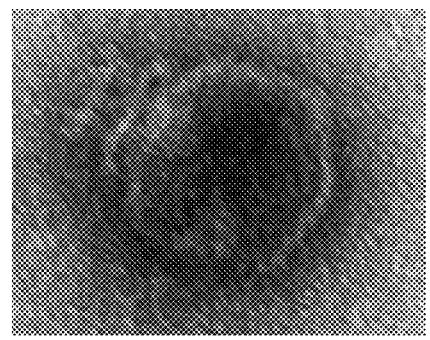
FIG. 21. Representative electron microscopy image of phage 42c (SEQ ID NO: 20).

We observed a reduction of the APEC strains titer in the caeca in the treated groups compared with the untreated groups showing the efficiency of the treatment (FIG. 11).

Example 8—In-Vivo Investigation of the Effect of Bacteriophage Preparation on Broiler Chicks—Field-Scale Experiment The respective concentration of the several (i.e. two to seven, or more) bacteriophages comprised in the cocktail is adjusted to 1e10 PFU/g. Then, the phages are mixed by adding an equal quantity of each powder in the mixing vessel. The phages are used as an additive in the starter-feed. The phage powder is added (400g/ton) to the starter-feed before conditioning and pelleting.

Kr-APEC is administered to the broilers from age 1 to 14-20 days in the starter-feed accordingly to the feeding schedule of the breeders. This in-vivo experiment comprises at least 12 flocks of 20,000 broilers divided into two groups. Control flock A is not treated, and flock B is treated with phages as described previously. Both flocks are bred in the same condition in different buildings. The carcasses of the dead broilers are collected, and post-mortem analysis are conducted to identify macroscopic colibacillosis-like lesions (perihepatitis, pericarditis, aerosac-culitis, enteritis). The number of broilers dead from colibacillosis in the control flock A is compared to the number of cases in the phage-treated flock B. Upon slaughter, 500-1000 birds of both groups are randomly selected for examination to identify colibacillosis-like lesions. The statistical significance of the results is examined using a one-way analysis of variance (ANOVA).

The present invention has been described in terms of particular embodiments found or proposed by the present inventor to comprise preferred modes for the practice of the invention. It will be appreciated by those of skill in the art that, in light of the present disclosure, numerous modifications and changes can be made in the particular embodiments exemplified without departing from the intended scope of the invention. All such modifications are intended to be included within the scope of the appended claims.

All publications and patent applications cited in this specification are herein incorporated by reference as if each individual publication or patent application were specifically and individually indicated to be incorporated by reference.

REFERENCES

Costa et al., *Veterinary Microbiology* (2012), 160, 488-90.
Saini et al., *Journal of Dairy Science* (2012), 95, 4319-3.
Summers, *Annual Review of Microbiology* (2001), 55:437-51.
Huff et al., *Avian Diseases* (2003), 47:1399-1405.
Johnson et al., *Animal Health Research Review* (2008), 9:201-15.
Clark and March, *TRENDS Biotechnology* (2006), 24:212-18.
Kutter et al., *Current Pharmaceutical Biotechnology* (2012), 11:69-86.

---

SEQUENCE LISTING (28 sequences)

SEQ ID NO: 1 - DNA, 111711 bp, Unknown
  Siphoviridae; T5virus
tctgcaagagctgggagttgatgttaagtctctaggattcaagtacactcgtgaggaagtaatcacgttagttaacgaagctgttaaagctgccctgaaacttgataaagaaaaaggtaaacgccgtgagtaaactaacagatctgctgaaagctggggacgtaaaatatctccagcgagatggctggggaaatagtgctgctgaaactgtcctactagaaatggatgtggacactggcgttgtaaaggagtgtacttggtatgagaagaatactcctccggttgtacgtactgtttatttgaccctagaagaagcactggccgacgattgggagatcgttgaactagatgtgtagcagttactgaaaaatttcagttgcttaatcctgtaattcttgatataatattctcatagtttgaaagaactattctgtttaattcttaattaaggaaatcaaaaaatatgactactccaactcagtggactgatgaactgttcgaaaaaatgtcttccgattacgttgctcgtatggagcaattcccagaagatgagcgtccgggcgttagcatggaaattgttagcgaaatcgctcaggaaaatggtgtaactccgaacggtttccgtatgaagttgactaaagctggtctgtatatcaagaaagctgctggctctacttctaaatcaagcgcatctactggagaaaaagcctccggcggttctcgtacttctaaagctcaggctcatgctgatcttctgtctgcgttctctgatgcaggtctggctccagacttcctggattcagcgattatcgacaagctgactggtaaagcagctgctcatctggcagaagctgtccgagctatcactaaataattctctagataaatccaccatcacaaggaaatacagttatgaataaagctgaaatcattgcacaatgcaacaaatttggtgagttttatctccattacgagaaactgcgtcagaaaggaaccacgtaccttcagggtacgatggagtttgatcctgctcaggataaatacctggcagagcgtattaaacgtgagcgtattcgtaagccgaaagaagatgaaatcctagttttctctcgtaccaacgatagcttccgtttcattcctgttgcgaaagttcgtcgtgttacgagcctccagtcagagttagatcgtgcttctccagtaggccgataagaaaacaattagcccctatatggggctttttgtctatttgggatttgtaaatgagcgatcaagtaaaccaaaactatgaaggacacgttgatgatcaatcaatccttctatgggaaaaggaaggagaacaagtaagactgacggtatctgaatttcgtgggaatctatacatgggaattagatattggctacaggatattactggagaatggtttccaacgaaatccggcttctcttttccatacacactagaaactacatcacagctgttctatgctttcacgcaaatcctcagtgaatcagaggttcttgccgaagtgcagaaacgtgctgaagaactcaaagccaagactgaatagctcttggctttttctttataaatgtacttgcttccagctcaattttaatatataatatttatataaattgatgagaggatcaattatgaaagtaacacttccaaaaattcaagcaaagttaaatcttgtatctaatgcaagaaacaactatctagataacttcggtggaataggcgatcaagggtacaaagatgcctggctgaaagaagcccaagagttagctgatcttactgcccaatataataaagaactacaggtagaaatgaatgactaatgtaaaagactttattaaacgttgtcaagaggcttactacaacggaatggaaattatttccgatgctgagtatgaccgtctgttaaaacgtttccccacggcggaagatgctattggcccgaaaggtgatatcccacatctgtatcgtatgtattctttgcaaaaagtttactttgatcgtggtgataaagctcccttcactactctcgatgatgttgaaactgataagttagatggttgcgcaatctctctgttatatattgatggagaatttgttcaggcactgactcgtggtaacggtattctaggaaacgatgtgacaaacaacgttagattgctgaacatccctaaaaagatttctcagaaagttccgactcaaatcacgggtgaagttctcattactaaagaagtagagaacaaacgtaactacgcttccggtgctgttaacttaaaagaagaagatgatttcatcgaacgtattgcagagggtggattgatcttcgcagcttatggtattcagtgttccgaagatactgtaggtatcaccgggacttacgtggatgatatggcttggttagctaacgaagacttcatcactgttctgaatattaaaaactacttcaagtggttcccaacggatggtcgtgttgttcgtattaatgataacaacaaattcttccgtgaaggttggactaataaacatcctcgtgctgcttatgcagttaaagaagatgaagaaggtgaagtaacaacgttgattaaagtcgaatggcaagtgggagcatctggtaaagtaactcctgttggttatttcgaaccggtaattattgatgatgccacaatcgttaaagcgactcttaataatgttgattatattaacgctctcgatttagagatcggttgccagattcgagtgattcgtgctggtggtgtaatcccttgtatagtagagcgagtgtacgagtaagtcgtaaccctttgctacccgttcaccatatcggaattataaagtggttattgacattttcgccgcttaggtatatactattatcattcagttgagggatagaatgttatggcgagggtaagcaaagttagttaaaattgtatttgctaagtgcttaaatacttgctataatagttatataaattgataaggaagaaatttgatgaaaatcgaaattccaacacaatgtccctcttgtggttctaagctagatcttgtcaacggacaattattctgtcggaataagtccaactgtccagctcagtcaagtaagttaatcgagaacttctgcacaaagatgaagttaaagggttttggcccgaagactattgaaaagctggaactgactaagatctcagaactgttttacctgaccgaagaagatttggtcggagctgtgggaagcaaggttgccgctaagttaattagcgagttaaatactaaggttcgcggagacattgactttggttcagttctcggttctttaggaatccctctgattggagaggttgctgcaaggaaactatcccagggttgcaccagttttaacgatgttaaggctgatggcaaagctggagaaaattataaagcctggctaaattccccacaaggcaaggatgttatcgaactaccatggaaatttagttctggtattcggggtataaaagctgatatcatcattatcgatgatttagttgcccaaccgaacggaatcgtggtatgtattaccggttctttgcaagattttgcaaatagaacggatgcaacaaactatcttgaaggtctaggatatacggttaagaaatccgttaccaaagacgtcaaatacctaatctgtgaggatgaatcaaagcgttcttcctcatcttataagaaagccgaaacgaatgggatagaaatcctgtcgattaaagaactattggagaaaaataataatgtctaaactgaactggaacgtagaaggtgtaaccgagtctctgaaagcaaaagccgctgctctgggtgttgctgtaatctctcaagaacaagtagctgctatcgctgctgaactggcaaccgagactggtaaagacgttaccgctcgctctgttggctctaaactgcgtaaagaaggtttcgaagtacagaaagctaacgaagtacagaaatccccgtggactcctgagcaggaagctgaactggttgatttcctgaactctcatgctggtcagtatacctacgctgaaatcgctgctgctgtagctggtggtcagttcggtgctaagcaggtacagggtaagattctgagtctggaaatgaccgcttctgttaagccaactgaaaaagctgctgctgttcgttccttcactcctgacgaagaaactgatttcgttaatcaggttgttgctggtgcaactattgaagctatcgctgctcacttcggtcgcaacattaagcagatccgtggtaaagctctgagcctgcttcgtgaaggtcgtatcgctgctatgccggtacaggaaacttcaagtgctaaaactcgcgaagatctgttagaaggtctggatctggctaacatgactgttgctgatatcgctgagaaaactggtaagtctgagcgcggtgttaaatctatgctgtctcgtcgtggtctggttgctaaggactatgatggtgctgctaagcgtgctaaactggatgcaaaagctgcggctgctgaataatctggtaaattaaacctaaggggagggggctatgctccttcccctttttgcatttagaaggcacgaaagcgtgcaaaggagaatgaccttgtttaacgtgcaagctgtagtgttgaagatgcttctggcttctgaacagaaacaaatagcattggaaacattctcaaaactgcataaagatcattttaatgacgctttctcctcaatttaccaagccgtccagaattattataaaaaatataacgcaatgccgtccattgacgcacttatgcttgaggccaacaggaacgcccgcctttctcaagctctagtcgtcttagctaacactcaaattccagaagtgagcatggaacaggcacttgaagtcctagaagctgaatatacacaggatctattcctgaagctgctagaaacagacgtgcttcaagatttaacaatgctggatcagggagaaattctcaacagggttgcctcccttcacttaaaattagaagagaaagtaacgaatactggaaaggtattcaacgcagacacaatgcgtattttccagagagaagaagataccaaacttaacatgattgctcttggtatttgtaatgagttcgacgcgcaaattggtttagctcgtacagaaacgttactgcttggtggttggcgtggtactggtaaatccattatctgttcaaacatacaggttcagcaatatttgaatggagacattgctccatatttctcaattgagatgaaagagcacgaggtattcagacgtaatttagcaatgttagctggtgtttctgcactggcaatgcgtaacaatactctagaaggtgctgctctcttgagattagcaagaactagggctagaatgtttaatggtggtgaagagcttttcgataacttcgttaagcagtatacaatggctcgcatgagtgatttctatgatatggagagcaagctcattgaaagtcacgagcttcacacccctatgatcatcgtttacgatcctgaactgtccattacaacggttgacgtagagttaaacaaactagttgctaagtacggtgagaaagttactgtagctcttctcgactacattaaccagactagacttccagattccaaaaccattgacatgtatgactggaaagagcagatggttgtaagttcatctttcaaatccatttgccagaagcataatgttgctggtgtagctccttatcagatcgatcaagatggtagaacccgtatgtctaaaggtatcctagattccgcagacatggctgccaaccttaacgctgctaaagctgataacggtcaaggtgctattatgtttgacttcgttaagactcgtaactctgatggtgtgaagtttatgcctaagatgaactgggaaactctacgaatggataacactactaacttggctatggaagacgtaatccaaatggaagctgaatttgttattccaattgagaaggacaagccagctcaaccaaaacgtgctaagaaagagaaaccagaaaattcaacaggtgaacaggccagcgatatatgagtagaataacagaactacttgatctgaaaggcattgaatacaaagacacaggtggggacatcctcatctgttgtctcaacccagatcatgatgataaacatccaagtttgcgcattgatccagaatctggtgtcatgcactgcttgagttgtggcttcggtaaaggtataccgagcatttaccattattttaatgagactcaatacagacagtccccaagattgtcgcaagtacgtaaaaagatttcagagattaggaatggatctacgaatcttgcaattcctgaatctgcttaccttttcgaaggtgatttccgaggtatcagttctaagaccttgaagaaatattttgctttccaacatcaagcagactgggaaggcagaattgtattcccaataacagatgctgttggacgtaatatcctattcttgggtcgttctattaacagttctgcccctcctaaatacttagtaaaacctaaacaagtttcaccaccgattttccctgtacgatataatacaccagttcttgttctagttgaaggtatatttgatatgcttaatctagaagataatggtgttaactacgcatcttgctgctttggtacacatcagtttacttctgataacattgcagataagttcagtccttacattattgctggggttaaagttgtggttatcctactagataatgatgcttctggtaataaggctgcacaagcgttagctaagttaattcgtacaaaaacacgattaacacctgtagttggtaacttccttcttccagacgggaaagacccaggtgatcttaataaagaagagatcgatacgttagcacaacgtattgaaattttagttgctgaatcgcttaaagatttggtataatatattggtaagttagagaagaaacactgaagttatacttacttaccaaaaggagactaaatttgaaaattgcagtagttgacaaagctctaaataacactcgttatgataaacacttccagctttacggtgaggaagttgacgtattccatatgtgtaacgagaaactatctggacgtttgctgaaaaagcatattaccattggaactccagataacccattcgatccgaatgattacgattttgttgtactggtaggtgctgaacctttcctgcacttcgcaggtaagaaaggtatcggtgattatactggtaaacgtgtagagcatggtggctatgcgaactggattgcaagtattagtccagctcagttacactttaaacctgaaatgaagccagtctttgaagcaactgttgaaagtattcatgatattatcaatggtcgtgagaagattgctaaagctggtgattatcgtccgattacagatcctgatgaagccgaagaatacatcaagatggtgtataacatggttatcggcccgatcgcatttgactccgaaacctcggctctgtatgctcgtgatggttatctgcttggtgtatctatgtctcaccaagagtatcagggtgtttatattgatgccgatgtgattactgaggtagcagttcattaccttcagaagattctggatagtcagaatcatggcattgttttccacaacttgaagttcgatatgcacttttattcctatcatctaggactttccttcgagaaagcgcataaagagcgtagacttcatgataccatgttacagcactatgttcttgatgaacgtcgtggtactcacggcctgaaatctttggctatgaagtacactgacatgggtgattacgactttgaactcgataagttcaaggacgattactgcaaagctcataagatcaagaaagaggatttcagctatgatctgattccatttgatattatgtggccatatgctgcaaaagataccgatgctactctgcgtctgcataacttcttcttaccgaagattgagaagaacgagaaactgaagagtctgtattacgaagttctgatgcctggttgtgtattcctgcagcgtgttgaagatcgcggtgtgccgatttctgttgatcgtctgaaagaagctcagtatcagttgactcatcgtctgaataaggctcgtgaacttctgtatacttatccagaagttaagaagctagagcaggatcagaacgaagcgtttaacccgaactctgttaagcagctccgtgttcttctgttcgattatgttggtttgactccaaccggtaagttaacagatactggtgcagattctacaaacgcagaagctctgaacgaattagcaactcagcatccgattgctaagactctgctagagattcgtaagctgactaagctgatctctacttatgttgagaagattcttctgagtattgatgccgatggttgcatccgtacaggtttccatgaacacatgactacttctggtcgtctgagttcttctggtaaactgaacttgcaacagttaccacgtgatgaatctattatcaaaggttgtgtagttgcaccgcctggatatcgtgtaatcgcatgggacttaacaactgctgaagtttactatgctgctgtactgtctggtgacagaaacatgcaacaagtattcatcaacatgaaaaatgagccagataagtatcctgacttccactctaacatcgcccacatggtatttaagttatcttgtgaaccgcgtgatgttaagaagctgttcccagccctgcgtcaggcagctaaggcaattaccttcggtattctgtatggttctggcccagctaaggtagctcattctgttaacgaagcattgcttgagcaggcagctaaaacaggggaaccgttcgttgaatgtactgttgcagatgcgaaagattacatcgaaacttacttcggtcagttccctcagcttaagcgttggattgataagtgccacgatcagattaagaactttggattcatctatagtcactttggtcgtaagcgtcgtctgcacaacatacactccgaagatcgtggtgttcagggtgaagaaatccgttctggatttaacgcaatcattcagtctgcatcttctgacagcttgctgttaggtgcaattgatgctgatgaagaaatcctgtccctgggtctaggaaaagagatgaagatcgtcatgttggttcacgactccgtggttgccattgtacgtgaagatctgattgagcagtataacgaaattctgattcgtaacattcagaaagaccgtggtatcagtattcctggttgcccgatcggtattgattctgactctgaaactggtggttctcgtgactactcttgtggtaagatgaagaagcagcacccgtctatcgcatgtatcgatgatgatgaatatactcgttatgttaagggtgtattactcgatgcagacttcgagtataagaagttagcagctatggataaagagcatccagaccacagcaagtacaaggatgataagtttattgctgtatgtaaagatctggataatgtgagaaggattctcggtgcttgatttcaaattgcccgtatatgcactgcgggcttttgaatcaattgagcaagaaggtgattattccgtaataactacaagatataacaaatatgtgctggataacaggaagttgcctggcacattttctcaacgtaggctcgttctatatgagaaaagaaaggaattaccttacaagctctaccctattcgtggtagaatatcaatgttatcccaactagtgggatcaaaacgtacccagtttatagattctgatggaaatctcattaactggaagaaaactacgttctatgatgttgtgactgcgaaagttctgcattctgcaagaatttataatggaaagtatcaatgttacgtagcgaaagttccgtacccattcgtgctttctagtgtaccagcttatataagctatattctggtaaataatagccctgttatttatcaagtccatcaagaggagcctgaaattcctagacttagaataaaattatgaaggttgttatatctaataaagcctatttcaagcccgatgatgaactctgggattattgtagtaagcaaaccacttaccatgtcgagacaatgacaagtaaataccctattatgtataagaatagtggtgttgttgctaaagagattaagtggattcccattacacgtctggatttactagatgctaagggagtgaagtacgaactggttgataaacgcacgttggctccggtagatattccagaaccatcattcaagctgcgtgaagaagatcagttacctatttatgaagagtgtgatgatacctgtattatcaatggtaagccaggatttggtaaaactatcctagcactagcactcgcgtataagtttggtcagaaaactctggtaatctgtacgaatacttccattcgtgaaatgtggatggcggaagttcgtaagtggtttgggtttgaacctggagttattggttcaggaaagtataatattgacccgcctattgtggttagtaatatacaaacagtaaataaacatgctaatcagctgtctaaagtgtttggaacagttattgtggacgaagttcaccattgtgtggcaactacatttactaacttcctagaaatttcctgcgcccgctacaagattggactatctggtacgttaaaacgtaaggatggtttacaagttatgttcaaggatttctttggatataagatctttagtcctccggttaataacactgttgctcctacaatccacaggtactccgtgccggttgagttgtctggaaaccagaacgttccgtgggctttgcgtgctaatgatgtgtattctaatcctgaatatcgtcagactattattaatctggcacatctgtacgtgaacatgggacataaggttctatttgtaagtgataggacagagttaatccaaactatactagaagcactgtctcagcgaggtgttacaacctatgagattattggtgcaactccacttgatgatcgtctgcgaatccagaaggaggtagcagagggtggtccatgttgtcttgctgctgcacaaagtatcttctcggaaggtatttctcttaacgagctgtcttgtttaataatgggaagtctcattaacaacgagtcgttaattgaacagttagcaggtcgtgtacaacgtatagttgatggtaagttagatccgatagtagtagacctaattatgaaaggtggcactggtttaagacaggcttccggacgtatggccgtgtatcgcaataatgcatggaaaactattactatgactccggagaaagcagtacagttagctaaaattgcatttggcaacagctcataattattgtataatatatacataaatttgagagagaaagtttcggattcataagaaagtccagagcagaaaaataaaaattgtacttgctaaattctctcgaaatctagtataatatatacataaattcgaggagaaaacaaaaattaaattcttcgactatgaaaagctatacttactagctagaggaaattccgacctgattgtcaagctatttaatagaatgcttgcagagcctgatgctcaccaattgctggtcggttcctcattcattttgaatgaatcaacgatagttgataatccacgcaaactgtctaatagacaactggcagaatatctaggaattttaagtctaagaaattatgccgaatacaagtttacaaacgatccgagcttggacatacaatatgtgccaatatggataccacgttctgtaatcgacactaacccactaatcgcaattaacaaatcgaaattaacatttattgaggaaataaaatatggctaagtcttggggcgaaactactggcggttctaacgataaaatcgacttcctgaaattcaacaacggtatcactcgtgttcgtatcgtttctggtgttcttccgcgttatgtctactggctgactaacaaagatggtaatgcagctccgtttgagtgcctgcgtttcaaccgctctaaagagagctttgttcgtggtaaagctgatccgattcatgaaatgggcttcttcgagaaagagctggacaaagatggtaatcgtgttccgctgaaacctaagaagaactacatcgccttcgttatcgatcgttctgataacaaactgaaagtaatggaagttaaagctactatcctgaaaggcatccagtctatcatgaagcagctgaaactggccgacccgttcgatattgatatctctatcgagaagaaaggtaaaggtttcgacactgagtacgacgtacagcagattgcagctatgcagttccagatggctctgaaagatccttctagcgcagaagctaagcaacacgctgctgatgcagatatcctcggtgaagcactgagcgatgaaaacggcgatttcatcaagttcgagaaagttccttctctggaagaaacctatccggttccgtcttacgaagagcagaaagaagcaattctggccttcatggaaggacgtgagaagcaggaaggtggcgatgctaagggtggttccgaagctggttcccagaaaggtatcgacgcagaagctgctagcgatctggacgactaataaccaaaggggagctacggctccctttctttttaacttatgagaatactatttagtgctgatcatcacatcaaactaggacaggacaaagttccaaaggaatggcagaagcgtcgattcttgatgctaggagagcggttgaatgatatattccatgatcataactgtgatctgcatattgctggtggtgatattcttgatgttgccgacccgtcgtcggaagaagtagaacttcttgaacaattcatgtcaagacttgatcatcccggtaagatcttcaccggaaaccatgaaatgttaaccaaaacaatttcatgtttgtatcactatgctggagttatccataaggtaactaatggaaaatgggatgttgttactaaaccctatcgttcaccagaatatgatatagttccttacgatgaaatccacaaaccgaagtggaaaccatctgaatcaaaactatgtttcacgcatgttcgtggtgaaatccctccacatgtaaaaccagagattgatctaacgaggtataactgttatgacgttgtaattgctggcgatttacattcttatactaatagtcaagctattggttctactaaacttctttatccaggatctccgttaaccacatcgttccatagagaacgcacaaaaggtacaaatggttgctttatcattgataccgatacactaaaggtagaatggattgaacttggtgacttacctcaattgattcgtaagacaatcgaggttggcgaagaaatggaaccgagtgactatgaccgtgtaatctatgaagtcactggcgacgttgttcagttgaagtctgttaagaactccgatctcttagataaaaagattaaccatcgagttactaaagatgctaaattaaatcttgtcgatcttgatatgttaggcgagctagaactttacttccgtgaagttgaaaagctgtctcaagacgatattgatcgaattttggctagagctgctaaatatgtcaaagattataattaagacactaaaattcagcaacgttatgtcttacggtaaggatatcgtgattcatttcgataagaatccagttactcagttaatcggagaaaatggtttagggaagtccactattgctactgttctagaggaattgttttataacaagaactcacgcggtattaagaaggactccctcttctcatggagcgctccgaagaaagagtacgaaatgcacgcttacttctcgaaagacgaagatgaatatgagctgcataaagttgttaagtcaactgctaaggtgacgctgattaagaatggagaagatgttagcggacacacggcaactcaaacgtataagatgattgaagatattatgggcggtgacttccaaacgttcaccaagctgatctatcaatctgttggttcaaatctagacttcctcaaagctaccgatgcaacacgtaaagcgtttcttgttaacctgtttaatcaggaacaatataaagagatgtctgagactatcaaagctgatcgtaaagaagtggcagctacgttaagtaatctgcaaggccagatggctgtaattacgaagattctcaacagcaaagataatctcggaagtttacaggagccagttgaagttcctgagtttgacgaagaacctctatcacaagagttgactgaatcgaaagtcaaggcggcattagctaaatcacaagaagctaatattactaagttacgtaatttggacaaagctgtacaagttgccgaacaatctttcgagccttataaaaatcttcccgcgcccatgtgcaaaaacgacgagatctcgagtgttacgcgtgacctaacgattgttacctcacgtgcgagtgaagtcaagaaacgttatcagaagttcaagcaagaggcttcagcaactgaatgtcctacctgtggaactcatctggatacaacggctgcacaaaaagctatggatatggcacgagtggaatatgatcctctgtttaaagagaagcaaacactcgaagcgcaactggaagtattaaagaaagaacaactcgagtacactgcatacactagagcaaaagatgctttggataaggcagtagcagctagagatgagttcaaaaattcaatgagtgattcttcttttgaagaactcaatgtgcaaatcctacaggtgcaaatccgacagctcgaacaggcgattgcagatggtcgttccaaagttgcaatggctaaagagcataactcaaatgtcgaagttgccaacgcaagatataaagcaaagctagaacagatcgagaaagcagaagcagaaatgactgagattacttccaaacttgatggagtagccgaagctgtagctgatcttgatattctgattgctgctttgaaaaatctggtaggatacaaactagaacatagtgtgaaagtatttgaagaattaattaataaatatctttctattatgactgctggtaagttcgcacttggatttgagcttgatgaaacgaaattacaggtagtaatcttcaatgatggaaatagaactagtatggagaactgctctactggtcagcaaagtcgaatcaatctagcaacattgttagcgattcgtatgctgttgacatctatcagcaaagttaatattaatcttctgttccttgacgaagtaattagctttattgatacgaaaggacttgacactctcgttgaattattaaatgaggaagatagtctaaattctatcattgtttctcatgggcatacgcatccattagctcataagattactgtcaaaaaagatgcagaaggattttcctacttagaataaaaacatggccgtagatagtagagagaaaggtaaacgtggtgaatatcaggtaagagatatactgcgtgaaagtacaggtcttgagtgggaacgtgttccaggttctggtgcttttggccagagccatggactgaagggtgacatctaccttccaccacaaagcggacacattagtaaatactgcttcgaagttaagtggtataaagatgataatatttcaagtaatttatttaatgttggtgaatccactctagagaagtggtggcagcaatgttcacgagaaggtgaacagatgaactccaaaccagcattgatattcaagaaagacagaggacagtggttaattgcattggacagctcagacccgatggtggacaacttaatgagtcgtacccatatggtgttaaataagaaagacatggaaatcgtaatcgggttattcgagccatggttacatcacttatctgttgaggacttaattaaataatgagcaaatcctggggaaaatttattgaagaggaagaagctgaactggcttctcgtcgtaacctgatgattgttgatggaactaacttaggtttccgcttcaaacataataatagtaagaaaccttttgcttctagctatgtttctactattcaatctctggcgaaatcttattctgctagaaccacgattgttcttggcgataaaggtaagtctgcattccgtctagaacatcttcctgattataaagggaaccgtgatgaaaagtatgcacaacgtacagaagaagagaaagcactagatgagcagttcttcgaatatctgcgtgatgctttcgagttgtgcgaaactacattcccaaccttcactattcgcggagtagaagcagatgatatggcagcttatattgttaagctcatcggtcatctatatgatcacgtttggttgatttctaccgatggtgactgggacactctcttaacggatcgagtttctcgcttctcctttactacacgtcgtgaataccatcttcgtgatatgtatgaacaccataatgttgatgatgttgatcagtttatctctctgaaggcaatcatgggagatctcggcgataacatccgtggtgttgaaggaatcggtgcaaaacgtggttataatattatccgagaatttgggaatgttctggatattattgatcaacttccattgcctgggaaacagaaatatatacagaatctaaacgcatcggaggagttgcttttccgaaatctgattctggttgatttgccgacttactgtgtagatgctattgctgcggtaggtcaagacgtacttgataagtttacgaaagatattttggagattgcaggacaatgattaaaattaaactaacccatccagattgtatgccgaagattggatcagaagatgccgcaggaatggatctgcgtgcgttcttcggtactaatccaaatgcagacttaaaagctattgcacccggtaaatcccttatgattgataccggtgtcgcggtggaaattccgcgaggttggtttggtttggtagttcctcgcagctctttaggtaagcgtcatctgatgatcgcaaacaccgcaggtgtgatcgactcagactaccgtgggactattaagatgaacctgtttaattacggttctgaaattcaaactctggagaatttcgagagactttgtcagctagtggtactaccacaccattcaattcataattttgaaatcgttgatgaactagaggagactgtacgtggagaaggtggatttggacactcaggaactaagtaatacttcaatggttactatggcaaatgacgatagttctcaggtctttaggatggactctgagggtaatattcttctatggaatccagaaggtttcatcgaattatgcgctaactcggaagacctaaccttgaaagctatgttagccatttataaccttggtatcatcgaaggtatgcgggaagagtaataaaaaccccagtggattgtccactggggttttcttttatttgttaagtagagcctgaaccattactttcaattcttcaacttccctgcgaagattatgaatttcattgtcctgctctttaactgcttggactagcagaccagtcaccgcagagtagctcaagctgtagtacctgtgttgcatacgttcagcatcagtcatgctctgttcatctttaccttctggtgctttgacaaaggtagagactgcttctggcagaacttccataacttcttgtgctaccagacctgcatctggggttccagtatcttttagattatatgtataacctgaaagagtacgaatcttagccacggcatctggaatgatttgcagattatctttaagatctctatcagaactctgattaaacgcatgagcagtaatagggctgttgaattgtgtaactctagagccatccttattgagctgagagtaccacacataaccattatcaaacttacattcaataacagatggacgatctacgttaccccataataggatagtaccattctgagatgcagtattttggttttcccaagtaaaagatctattaggtctacgcagtaccatacgagctgcatctaggtaaactacctgtccgccacctttggttttaatagtagcatcaccattagcccctagagataagtgagtacccccaccaccatcgttatagaagctaacacctccatctgcaccacctttgcctaagtaccacgcacggctgttatttccattaataccagaaatatagagagccttacctgacgccccatcgttaccttttatctgtagcccattaccaccagtaacaacacgaaagttattcatatgcacttcatagtcaccggcgtattgtaaggctcgatacataacttcagcatcactaaaggttaaacgcccatcatccttgatctgtactactttctggttcttctcatttctgaaatatacatctgctcccccaacccctacttggcacttcttagtatcatcagtaccatgctccagcatgatggaatacttaagctttggtgtagacataccctcagtaactatacggttccagggtatagaagttttaggttcttgtgggttattagtgtccacgaagcggtagtaggcattattaccggtacccatccagaattggaaaattctgttacctccgtaagatgactgaatacctgcaccattagcaggggcccagggagtgccactatcagaatccgctagaaattggccagcaccatctacagggcgtaagttacctattctacctacgccatacttagcagcagataagtgcaaggtccactcactccacttccatccttcattacctattaagttatacgcacgagtgtaatgcttactagcatcattatacgggtagtagtactgtaaagtttggttccctccgttagctacagaactagtaactaatagaacacctgcagtttgttctggatagttatttgcaggagtagcgatagcgtttcctgcacagtaataccagccagttttatcgaaaccataaacatcattaaggttgtcattggccccgaaggaagatctattttggaaaaatactttaagattcttacgagcatctatatctgtttttgcaccagtacccccctgagcaatagtaattgctttattaagagcatttagctcagtaatatcattgttagcacctttagcagctttcgtattattactgtcagttagcgcaccaaccgcagtatttaaagatccaatagaatcattaatattcttaatactagtatctgtagcagttttatctttattatagttactgatttgcagatatttagatgtaagaacaacagcacctttctcaccatcgacagagaaaacgccggcaacagcagcatccctgttcattactacatagggagccatagccccacttttaggcattaagtttcttgacattttattctcttgtaaataaggggctttcgccccttatctgttacacttcctcaggatatgctgggtcagtaggatcgataggattagtatcgagtactggttgatcaattggtaaagaagttggaggaattgcaggtggagttatttcttctggtacttcctcagtagccggaggaatagcatcagcaccgtccgtattatctaactccttggctctttcctcagcctctttaatcttagtgttgtaaatagaatcttccggcatttctacacgaacagagataaatacatcactaggaatgtcaataggatcaccgtttttgaacccttccttagtgtttctagcaaaaggaggggaatctggatactctctatgatacgttttaactatgattccaccagaagcagatacttcatagtcaacccagattaggttctgaccattgatatctttaggtacttcaatacccccggcgataccaccccaagccagatcagagtttaagcccaagcatccttgaatctcgtagacacctacatctaatcgctctacgttgcagccttcggactcttcgttggtttcaaaagcacccatttcaaagatcttaacgatcggagaagcacgtttaacaaagccactagcatcaacagtagtattaccagtatgccataaaagcttaggagactgccacaatccagaaccattctgcttccttaactgaatggagttataactagggctagtcattgcgatgtcttctaggataagtccgtaattaacaccatccccactaccgttacggtgtctagcagacatgaaggttacccaaccaacactagtaaccgacatagcacccatagcactaggcatacttgagattttattaacatagtcggtatagctggaagctgcaatgttacctccagtacttactacgttacctcctggacttgactggaaaggctgccaagttgaccacgtagagttattaccatttttagaacggatgtagaaagtacctttacctgctttagccaaatcctggttacctacaggaagttcaggagcagcactattcgcagtgaatggagtatatcgttgaatacacccagtagcaccattagccccatgaggcaatacttctaacatacccgcagtttgttccgggtaatgtcttgccagggtggcattggcagacattacttgatagtaaatacccggtccatcatcagaaccatccagtgtatttaaatcaatagtccctaatccagctttatcaagcttataaagtcctagatttttacgagtagttgcggtatctccaactccaatagctcccgggagacttacatagccatcctctctcatcccaaggtatttatgaccaccaccaccattattgaggtgcagagtcaaccacttgttaccatccgcacgctgctcagtatacatcctcgcataatgtttctcagtgttacccgctgcattataagccctcagatacagaataccacttgcagaagtagcactatcgctgtagctctcaatggacgtagcaatctggaaggaaggagtatctccatttctcaccacacctttccatggagtccaagtattcccatcagcggtaaagcgagtccataatccgccttcaccatccatctggatttgaccggtagagttgacacgacgcatagccaaaccgacagagtaaggcatcttgtagttaacaccgtctactcctgcccctgcgaagaaacagttcttctggatgttgttagcattattatcatggataacccctgtcgtagtaacaccaatgtatccaatatcaggaacgtttaaattagtctgtgcttgggatctactaactgcacctgtaccgcctgcgtcaactgagagcgccacgttacctgcgccagacttagcctgcactccccaatacccatcattacgaataaatagcttggcagcgtccttaccgtcggtggagtagagtgaggttaaatcagcacgctcattctctaagcggttaacctttaaattaactcttgcgtcttccacagagagcgcaccagtacctccagaagtaataggaagtgctatagacttagcagcagcattatcccacgcgccccaagatccgttatcttgtatagagagttgtttagtaccatcaccactaaccatataggtttcgcctttgctagtagcttgtctataacgatctagtagaagggttttcttagcagcgtctattgtagtagcaccagtaccacctttactcacgggaacagcaccagaaatatcattccagccaagtgttagagcaccatcatctccaggcccttttccattgattaatgcaatataaggaatctgatccttaattttaccagcatcagcttcattcttatcggcagcgcggaaggcctgaccttgcatcatatcaggtaagcggaaggtagtagaaccatcaccggtagagaagtacagttttgcacctgcctgccattcagcttctgtaacagaaggaatcagaccagcttcaatagcttcccaagtatctgggtagtctacacgcttaacttcacgaccgtctgcaggaagaacaccagagtacccaataccacgatctttatcataagggaaccaagttacctcaccaagccacagtgaagggttaccaccaggaagagttacctgtacgttaccgtattcatcgggctgtacgttgtttacagataatagtttggattcttcagattcaagttgaagtaccggagcttcggcagttcccgcaaccttgtaccagccatattttgaagcagtcttattccaaactaggatcatttcacctagaacgcgatttggaagatcagcagttgcagcttctactgttttatacgctttaataaacgtagagatatcttctttatcaagcttactatcaacaacctgcgttgcacgatctgcttctgctttagcacgatctgcctcagtagtagcatcaacagctttatcacctgcggttgtagcagagccagcagcagcagtttccgaagctttagcagctagttcagattgttttgcagcagcggcgaattccccagcttctgcggaagcagcagttgcagtgttagcagattgtagggcttcagaagcagagccagcagattgggaagccgcagctgctgcagcatctctagcctgttcagctagacgcttactttcagcagcattttcagcggaaataccagcagcagaagcatgactagcagattcttgagcagagttctgagcatcaagagctctctcagcagcttcatcagcagatcccttagataacgtagcttgagaagcagcctctctagcagattgttcagcagcctgttcagcgattgcagcttcttgttcagaaccttttgcgttaagttctgatgcagcagcgttaatctctgattctttagctgctgcagccgaagccgcagcagcatctacagatgccgtaagttcacccgcagtaatagagctgatggagttaccaagaaccaccgtatatcgtggataacgacttgcggtgatagaggtctgatccatagcaaccatctgctgtagtataatttttgtaatcttcgccattattcagttactccatcactaataaatactttaccttccattacacggaaagagctagaagtagagccaattgcagtacgggacatgataatatcgtaatatccagcgaatctctgtcgagggttgaaacgatcacgttcttttgaagcttttgcagcaacagctttaactgctgtagttggaaggctgatagaagcaaccccctgcttagcatcaataatagcagtattgaaggttgcaagagtaactgcaccgtcttctaagctattcttaatagtacctttaacagtaaagcccgtaagatctacaggctccgaagttgctgggtaaacgctatcgtctacgtcgttaaactgcatcagcagcccatatgggacgttctcatcaataacaatgtcaattactctgttttctgtactcattattttaccttatatggatatacccgttttgcaggtctatcttcattttatatgtaccttctggattggaagatagtgctgctgctctgtcatatataatgttaacaccaatctgagataagaaagcattacttgcgacaatcttactagatgtaatagttccgttaacaatcatatcaccgtgtagaaccattgctggggcagcccaagctgaaccgttccattgacgagtaaacgcagtccccggagcaccacttttatactctgttagtacatcatacttaacaggtccagaaccaaagtttgatgtaaagaaggagttagcttgcgagtcattccatgctgttaagttagcgatagcaagggaatacattcccggaccgcgcatcccatctttaccaattgtaccttctgtaccgctccattgaacaacatcagaccaacttgttccagatactaactgattagttgctggatctagagtacctgtacatgcaaagatattctgcgtagtagatgttctattaggcggagtttttgaccagccaggaggtggataagctgcactggtaggtttagctggcaaagaagtagccagaatgtagataaatacagtctgcttaccttgcataccagttccgaggtcaacatcaccattcggagttccaataacaacctgactagaaattcttaaaacgttaccgtcataacgaatatattgtgtagcgttaccaatatctaatttaggtttggcagtggcattatccatacccatccaaatacctgacttagtatctccccaagttttgccttgagtataaattgctgggttatcttgaccagttaggttagtcataacgaaatttgcagcatttatagttttagtaattacgctaccatcaacgttaacgattttcttgatagggtcgaaggagataggtgcttttccttcagcatctagcaatccaatactaacagcccctgttgcagcatcaattaagaatgtctgtttccagattgtaccatctttaatcttgcccttaatgtaagcgtagtttacctcaataccagtctcatttacaaagttattatctaacggagtattttcatttagtataaaggtttgaaccgcggaatctgtaacatcttgagcatccggaccccaggcaacagaagacactttgaacttgtgctctactttccaggggaatgaaatgattgttgcagcctgcgcagcacctacgttaatcttttgagctttagtccaaccactgcgtgcaaattctgttgaatctatataagaaacaacgaactctcgaacgttggcgcctgcacctcgtttccagtcccactggacgcgcaaatcgtaacgttccttaccatccgcaatacgtgctgctttgaacacaatattaattggggcagttggaggaacaaagttatatttaacttcaaatacagtaggatactcatagtaaccagaggagtcgatagtaacaccatcgggtaaacttacttgtcctgagatccttaccttatagaagccaattggtacaccaccaaacataatggtcggcattagcgcaccaacatagtatttaacccaaggattgtcggctttagagttatcttttaactcgatagtacagtaatcagcttcacccgtggtatcaatgaaaactattggagaacccacaccaacgtccactggttctgattcactcctagcacctgtaatcttcggtgcagctttcattttaaaagtctttttgtcagagagattaataccaatctgagcattaagtagttcagagtcaatgatggaatcgtagaatgcaccctgaacttcataagttgtcgtaggttttaaattattaatagttacagagaatgtatcaacaccagtaaaatccctacgagtgatgttgctaccttctttaagccagaaagatctaccaataacgtcataatccgagtagatagaatgctggatatacgctaaggtatacccagtcatcacgttatttaagaccatcttggctggtgcattgtttgctatcatttaaatagttgcccaaccaacagattgttctccgtcttcaccttctgccctgattctgaaccttaacttacggttaatacctagagcatcggagttaaggagcgcaaagtctgccttattataagtcaataagtactcgtaagtatagatatcttcaatccttacactacgtagcattcgatcttgagaatcatagatttccagagtataaaagatttcaggaatgatctcttcttctggtataggatcccaagcaagtttaacatctggtcctacgaactctgttacatcgccagaagctgtattggtaactcggaagttattaacaacactcaagtttctagcagagttaagttctacggataaggtaactggagagcttcgtctaccattaatatctactgcacggatttcaaagattgccagacctgctggttctcctataatctcctgaatcattctctggtttggattgttctccacttgctgaacgatatatggatcaacatgactagaatgagcaacagaatagtagacaacgttgtttgtaaggctaggaagccacgataattcaccatttttacctatagagccaaccataccaccaggagttggtgtatatttgaagtctctaggaggtaggacgttattgctaatgtccggaatatcgttaccgctgttatcaacctgctcggagttaatgaaaacatcttcaccgtattcttgcagagttatgttaatcttaccttcacgagtgttctcaacctcatccactaagaagaatttatctttccacccgtaacgctcatatgtgaaagcaattggatcatttggctcaataccaatgaaacgatagggtagtgagaaagttagtgtacgagagtatcgagacttcttaagctctctatctgcataactacgagctgtatagtagttcgtaatattcgcaaaggataactgaagtttcttatccagccccttatcttgttctttaaacttagagttgtagaacgtgattgagtttgttttccagcttaatgctggatcaaccagagaagcctgcacagagttaaacttattgcgtccggtggtgtcagatagatcaatattgccataagtatctaagaagtcgatcttcagtggagttttcgagaatttctctacagttatacgatattcacctgaaaggttattaatcgcaccactaaaggagtctaggagtccttggacgttcttaaatacagattcagcagtatctataatagagttaagctgaacaatctgacgatgttctgagaaagagtcagaccaaccaacataacgccagtaaggttgccatgctacttgataagattcgtcaatgatatctaggatagctgcttctgagattatctgttgcattgggaattggtcaatagtgatattagcaccataacgttccgaagtcagataatccataagttgccaaataccgtttaaactagtcttattagcagtcacagacccatcagatttgtataccttaacctttttaccttgaatttcagcacttacttcaggaatttcagtcctattttcattaatggtgaaacgaacaacagcataagctgtatccagaagcttataacgttcatcccagtactctgggccgtttttatttaagttctgtagatagaaacccttttccttagcgatatctaccagtactttagccgctgtctgatcaggttttccatggaatgtccaaactcggatatctccgttaccatcattatacttatattcctgaccatgaacggaaggttcagaagtactcacaccagatgcaatacgttgcatagtatcgcccgtgtgtttcttacgtccgaagcaagtacgggcatcagcatcagtctcatcgaaacagatcatagggttgtcacccatgtagaagtcaaggaatccgtcgatttcaccctcagcaaatgcatacactacgtaaacaatgttagggttatgtagctcagtatcagcgaatactgggatacctgggattttctggacaccatacacaactggaaggaacttagctgataggttgaagtccaggtcaacttctttagttactgtctcataatactttttaagactgtagcttctagacagaccgaataatttcttcttagactgtagtttatagcgttcttctttcacttggtacttagccaagatggttgtactcttgttggagtggaagaagccgtagtcttcttgatactcagggcgcttagcaccattagagggctgaagttgtccatttactacttctagaccacgatgggaagcgtcatcagtataacgtccgttaaccctatcgaagtcgtagaactggtttgagcagttccaagtaataacagaagtaccaatacctgaagtagtaacgttttctttgattccgccaccagtaattttaccacggaagaatagaagaggtccgtttgtatcagggtctacaggaagaatgttgccatcttcatcaattacagcttgatgaatagatatgcttctatctaggaaggatacaccgttttgcacgagctttagaacttcatcttccgctgtaccagtgattgtaaaagataagctaccaactgagagatcacggttctgtttatgagagctaatacttttaaccttacctgaacgataaaggatgccactataagtaacatccctaaaatagtcagtaagataaatgtacgcagaagcagatccagtagagccaggtagctcaagggtaatcagacttgcagtctttagcttattatgcgtatttagataggctttagcactatcaagtatcttcttcatagactttccctcaaggaaagtgaaataccagagtaagttccgttattgtttaatgtggctccaaaactgtcagcattcattagcttagttttaaagagaataccgttaaatactggcttttcactacccgtagtagtaataaataggtcagggtataaggagatagtccaaatattacctgaatttgtgaaatttgttattttatatactttcggatgggaggataatttaaataaatcaccagcccttggtgtaccaactagagttccgttagtgtttaaagtaatctgtgaacctttctgtccagcaggaatagtaacaccactagtctcaccgcgtactcgaaaagcttcatattgaggtagtagaacctcaagatgtgctccagtacgtttgtattctagaatctttgaatctagaaacatatattcgtcagggaataattcaggatatgaaatattgattccccagtattgagcagacaccttaacctcattaaccttaccattaggtaattcatcacgaatcatagggtcattgtctactaaattaacgctttcaaaacctaaccctgagtattgtgggttcgtgtatggatctggtagtctcatagttaatttctcctctttgataacaatattataatagtattggaaaattttatcaagaaatttttatttttccataaagaaaaggaggacataaagtcctcctccaatattaagaattaccaagagatttcagggtggttccattctcattaagagcctgttccacggcatccctgaaagcagcgctgttattcgacgcaaaatctctgaagcttgccgcatccatagtgctgatgttcagaacaatcggtctaccagaagaagactttgatccttcggaaagctgatcgttaggcgtagctttcattggaaccataggagtaattacctcggtaccgtgctcacccatttgatagctcaccccaggatacatcataccaccttctgcacgcggaacgaaggagttggcattaccaatacctttatcaccacgtaggtaggacaattctccaccacttgcttgcatagaaacgtcaacgttcttctggcgctctccaagagacagatactgtgcagaatctgctccagagtctccgatactagacataccagaagcagaagatgcttgagcaagagccatagcacctgctaaacctgctgctaccatcagagggatagagaacggataaggaacagccgttgccgcctgcattaccgctactgccgtctgaatgatgatctgcttcttagccgcatcttgctggatttttagcttttcagcttccaacttcttcagcttagccttagacgcttcggatttaccatcacgcttctgctctgctgcgattgcggagtctatagcactcacctgctgacttgtgctatactgaatcattgaagacacagtttgcataccagctgcaatcatggaagtagtatccagagatccttgtgagaactgaatcatcgcattggttaagttacccatgctttgagccactgctgtagcctcagagttcaactcggatagcttggagatagcctggtcgtaggacgccattctattctgcatatccatgttagccttatcatccccttccagtccagtagttggcgtataagtacccccaacggaagaggtaacagcctgttgcatctgagcatcacgttgcatcttaagctgtgctagagctgccgaagtttcttggatcttacgcttgtactcttcctgagcttgtgcgtttccttttgtaatttccaatagactttggtacagagcttgctgttcagtcagacgctgagattcaccagtaacgttacgttcggtttgagacacattaagtgctctctcacgcccactagccatttccatttgctggtcttgacggaacttccagatttcacgctcaatctgtgcctgggcacgtcttgattgttcagcttccttctgcttatctccttgctttctataccattcatatttctctttctcgatagtcagttcaaggttcaactgagctaaacgatactgagcatctgtcatagtacggttattaaggagagcgatctcacgatcaacgccaagaatcttatcagtatgatccttaaccttcttggtagcttccattccctgattcagtaacttaatcttctcaagctgaaccttagtgatttcaccttcaagagctttgttacctttgttagtctctagaatattctttagagcagcttcctgtgcttctaactgttgaagttccagacgacgtccggcttcctgtgctttttctttatctttagtctggttgtacacttctgcaatcttttcctgaaccgctaactgattcttagtttcattaccagtcagttttacataaccagcaagtgcttgggaagcagttttcatttcagatagactattgaagcccaggttcaggtctttaaccagcttgtcagcattctcaccagtaccagcagacagtgattcaatagtcttaatggtatctgcaaaggatgcactagtttttgcagcagtattggtgttttgagcaatgttctggaaatcattagctaaatcaccagcagttttcttagtctgctcatacgctttctgctgctctgtaagtcctttcagagtagcggagttaaaatcgtaaacagcatcaggatcagtagcatctctttgtaaattaatttgcttctgaaactcaggcgcagccttcttagcagcatcaccagcagcctggtaagcactcttccatgctcctaagttttcagtagaatcagcaacttcttgatctagacgctgaatctgtagtgccattgcagctgtctgggctacgaattctttgttcgcatcagaagcacctacggtagcagcgctaactggaacaccttgagcaactgaacgaattgcacctttagtaaagaagtcagcttgttccatacgtttgtcgaagtcagctttcaacttgttacgcttatctaaagactctttatacatatcaagagctttattgtacccagcttcagatgcttcgagactcagagcgacagcaccagtatttccaggatcaatctgacggttagtctgttcctgtgcacgagcggcagaagcagagatagacgcctgagaggtatagaacactgcgttgatagaatcaattacaggaccaagatacttagcagcagcttgttgaatcttacgtaatgcagcatcagcgttagcagcgaactgttcccacggagttgcacgtaatacttcgtctaaataaccaaagcgacgagtagattcttcgataactgcgttagcatatgcttgttgcttctggaaggtagaaagactattgatgttatactgaataccagtgtttgcagcattaagctgtttaacatagtttgcgtatgcgtcattcagacgaatagtaacaccaagttcgtccagaagttcgatttcttgtttagatacacccttgattacacggttaagtgcatcagtcatatctacaccaagaacagcagcagcacgacgagctactagaccgaatttatttaactgttctgcatcgaatccataagcagaagcagaggatgcttgtctcattgcttcttcaaaggagatagcgtaaccagcagcttcctgaagagatctagcaagagattgtactggagtacccgtttgagtaccaacaatagtaccaaacttctccagacggtttaactggtcacccatcttcagctgttcgaacgcagattgcagaacgaacacgttagatgcgattgcagcatacataagaggtaaactaccacccaccttagccatagctgcgaagtcacgagttgcaccacgggctgaaccagaagtgttaccaattgcacggctagcgcgtccggctgctgtagttgtatcattaaagcccctggaagtatttcctaaagctttattagtatcatatagtctatcttggactttttcagttgcagcagcaacatcgttacccattactttaacagactttgatacgctttcaaaaccagtttccatcttatcagcaacttcaatcattgctaacgcaaggtcatccagctttgtctcaatttttgtcatagaggcggtaatactcatcatacctctattcgcttgcatcttagttagactttttgctgctctatctgccgccctctcaatggaataaagagttttgggcatctgtcctaactgttcattagtcagttcggaggcagcagcagcattttctaacgcatcagcaacgttttcaatagatttagcagttcgggtagcacccttttgctttacatctataagtaattcacgtattagcttatcagtcatgttttatttttcccaataaaaaaggctctgggcaaatcacccagagccaagcctcatcgtggaacgcccattggaggaaacttttaccgcgaacgagatctagcatgtggcttaacgttaggtattctaccgttttgcggtttatgcttctctgctcgcttacgtgcagcttctacagcctttgcatcaaatatattgatgatgtgtagaacgaattctttttctatcggatcagtaatcccatagacatcaaataaaactcctaaagctgccttgtccttcccaataaagattggaaaatcaccaggtatgaaacaatctattagactgttataaatctgcatactggtagcaactataggaggaaaatcttcgagctcaacgggcattactgcaggatctggttcgatacccattgactcacacattattaaatattgttcttttgtcattttagacgctgcgccttttacacatttatcagcgaatttggcaacagcatctaggagttctttacgcttttgagctacgaaaagtgtctaagtggaacactgtctggttgatccaagaatcaaacgcagcagagttctgcatcagcattacagcgttatctcggctaaaaggaacttcggtagcaggatcggcttccgtttcaattagcatgagcttttcaacatcaccaatagtcagaccagtccaacctttgatagctgcatcaacgaaagattcgatgaacttgtcatcatcctgaacctggataagagtaccgtttacccactcatcacgcttagcggaagaaatgacacgcttagacgttgcacgagacatgtagttcagttccagcttgaagttaggcatgcctgggtaagacagagtaacagtacgagtatctagggtaatatcttttaagttaatcatgattttctttctccaaagaagtttatttctacaggatctgaatcgacagtaggtattacatcatattctacttggtacaaatccgagaagtttaggcgttttgaaatacgtgctaaagggaatgttacagaaacatatttatttttaataattaaaggagttcttgcttctggatctagatttaagaacttgtctccagcaaatcttttcacgtaatagaaggatagtgtggcggaagcattcatctcgttaacgtaagcgcgtttgttactatagactttattaatatcaaacacacttctatcttctctccaagagcattgctgttggaaggacatagatgcagagagtaatgcaggtagcgaagcactattggtgtatactgcaggagcactatatgggagtacttcaccctgagtaattgtagcaccatcacggaaagtagatacttcagagaacttccctgactcaataccaacatttaggatcggtatacttttatcaagagaaaaatcaactgttgatacataacagttttcgaaataaatacagttgttgttattattaactatatacagattgaacatgataggttcaatatttggtgaaactcttggcaagaacaatgtattaccctcacgcttaaatcccatccagtcaaagaagttggattcaataagcgtagtactaaagtttattgccaatgaaatggatgttggatcttgagcaacaataacagagtcagcatagttagttctggcatggatggtacgtcttagagttttaaattcctcaaaagacgtactagcatcataattagagagggcatcgaaatgataccctctaccgtcatactcaactactattttagactctcgcatgagagcataaaacatttaattaaccacctgcaccagttacagtaataaccttagtgcctttaatacccgaaccatctttagccgtagcttcaacagttactgcaccagtcttagtagaatcagcagttaatagaccagattggttaatagttgcagcatcacctgcagcgattttccaagttacagtcttatcagtagcacctgctggctctaccgcaacagtcatctgaagagtaccgctattcactaccgtactagcgtcggagttaacagtaatcttagtaactggaactggagctgcttcaccaccgtcaccagtagcaatcaggttagcaattgtagtcttagtatacttactagagaagcctaagtaaccttcatcaccagtgtccagatcagtaggaatagccttaaactcaacagaagtaccaagtacgtcgtcggtttcgatgttcgggatgtttacgtgggcttgtttagcaaccaggattgcagcaggacgttcatcatcgtactcaccaccaagtaccagagcgatttcgaagcggttaactactttcagagtcttgatcaggtctttgtacagatccatagaaccaagcgccttatcattcagataagcagtcagagaaccagtcatttcgaaagcaccagtaaaggaaccgatcggaatgttaacacgggacattacgttaggtgttaaataagtaatgttgttgttgatggtgaaagtaccaccagtgatagggatatcgtaagacttattagtatccatatccttgatcttcaggatagtcagtttgttcttaatgtaagaaccctgaatagtcatataagtctcgtcgtcgatacctacttcatctggatcaaatggagccgcgtcaagagggactagctggttaccattaccagaccaggttacacgaccgatatcttcgatatcaacgttaacttctgcctggttgatctggcaagagtcgatgtaactccatgctttatcagtcaggatgtagatatgcaacatagccagttcgtggtacgcgttatctttgaagttaaccataaagttggtttcgttgttgtgagcaccagtgtcgccagttaggtcaagagccttaccgctagagagtgcgtgccacagcatgtagtcaggaacgatctgcttttgatccgccttattcacataaggaaggatgtaggtagagaagctccactcagcggcgttcagagagtcgttgaaacgttttgaaccacgagttggacgcggacctgcttcgttaacagtaatatcggttgagttactgtcctgaccccaagaaatatcatcctgaactagaatctcttgcgtgttggtcttatcgtgaccagtcttaaccgtagacacgaagattcgagtattacgtaatagttgtaaagacatttatttatattctcctaatctgtaacttatctgcgaagtgacctgcgaggaggttgatacctcactgttacatttatttccgctaaaccatatggggccagtagaccctcatctgtactaactgacgtgatcatcatatcagtcgcctcacatgggaaggtcgatccattaggtttactaacagtatattctaaatttccacctgtgtcaatgacggtttttatgtcagctacgagtttttcaagttgctcttgaatatctgttttctctttgtcatacacgatgattggaagttctaaaaacatccactgttgacctgaaggaagatactgcccagtttcagttccgatatgaactgccacataaggaaattctcggatttcctcaaatttataagtttgacgagaaacgtttccataaaggttattgaagtactcgtcaggttgtgaaccatccagttgcttggagattcgatcaaccatggcttgtgcgatacttgttctgtgatccatttattaggttccttgattaaccttgattttatatctagagtgaatcaggtctctcgctgcttttgcgattgcttccccaataagtttttgagggtttcgagcgccagggtaaggccgtaaggaaagtcttcgataagtagatactgcggggttgaacacagagtatggacgtaccatataattatatgttacgtttaattctggagcgcctctactagtttctgcgtcccttaacatgacgtccttaatcttcaaggagttagcaaaacgacccgttctgaatttcagaggagcacctgctttcttcatatccttgattaagtattccttagctacaatttcaagaatagcacgcatgttactattcgatacgaaacgaccggaagcacctgttactgcacccgaataaccatcttctgtatctctaggatcaccgaagtttacctcaacacgacccgtggttcgtttcttacctacagccgatttcttaccagcagtagtttgtatcagtttttctagagcacctagatcgcctgataggtctaagttagcggagacagccttcaaaatcgaggctgtcctaacatttaataagtcttgagatacgggcttagagaacttgaatgatacttgcgcaacagtaccatcccttaggggatctttaagtccagtctctacagtatatacaactgtattcttattattctcagatcgtccggcagtatctagctgatctttgataatctgacgagctagatcggaaagagacattacactctcctatagacttcgataatagtacgaatatgctctggaataccagacttcgtgttattgaacgttaccgtttcaccaccaatagtcttggcttgtcggtagtcttgtttatgccaatgatctaccagcatacacgctgctagttttagatcttcaggcattgggttgaatccaccttgtgtatattcgacatccatgtagccatctggtgggttaaacttaagaaggataacaccatcagagtatagcttatattgttcaggatcaatttcctgatcattaatagtcatcttggttacggctgtagcagaaggtgaacttaggaaatattttctgcgagtaggttttgtattgattaactgatctaccgcatccgcatcatccatacctagaaggcttgtaatcagcgtattggcagcgctaatcatcatctctaccccagattcgatttcaggtcgctttaggctaccgtatagtctataatcttcagctgtgatgatttgcatttatttttcccaataaaaaaggagagccgaagctctccttatcggctgaaaagcctgtattaagcggcagcgtaagcaccagatacaacgccgttttcgaagtaacgttgcaggttaacacgctgagtaacgtaatatgcgtcacgctgtttgccagcttggcgctcacgttcaacagtaacagcacgctgacgcggcattacgaagttatctttgtaaacgataactgcgaactctgcagaagcagctttagctgggaagtactcagaaactacaactggcagaccgtagatacgaccaacctgaccctgcagcttaacagcatcgttaccaacctgggcaacatcctgccattcttcatcttccagcagatcgtagtacgcatccatagatacgatcagtaccagcttgctcagtttcagaccatgacggcccagtttacggcgcagcttggagatagtcttagcagttaccagaacagaaccgtcagctttagcttcggtaacaaccttagcaccatcatcagcagccagtttcagaagacccttaggctggccagtaccagtaccattcatgaaagcttcttcgatagaaacagcgtgtgcttcgatcagacgcttacgcagcagaggcagcagagagaagattgcatcttcttcagtttcatcagtgatgaaggacttagcagccagcttgtaagttttgaagctgatttcagtcagttgacctttaacttcgtcaccaacagtttcgtcagtaccgaatttggaagcgtctacccaagtagcacgaccagcttctggttcaacgagcatagtaaggattttgctggacattggcagttcatcgaacagtgcaccaactaccagttccttctgcaggtcacggataatacgggtagagaagatagtttcgtatgcttcactagacatggaaacggaagaagaaccgtttacagctttaacgtgagccttaccgtgttcagtttcgaatacgtccttctccatcatataagacagaagaaccagtttctcaacttcatcttcgaaagcatcctgagtgccataaagagctttagctacgctatcaccaacgaaggaacgaccttcacgagctgccaacagagatttgatttcatcctgaagaccaacgatggtttcctgctgcttttctacagtctgtgcgaacagttctgcgctcttcttagacttctcgtccagattcttaaccagttccagggcctgttccagcttctgacggtcttcgccaacagctttagatactagatcgttcatacgagccagctctttttcttcctgctcttcacgcagacgcttagcttccgcagctttctgagcagcagtcagaccttccagagatttagccagatcacccagaccaagttcttccttcagcttattaatatcaatagtcatttttaaataattctccgttattctttaacgtagcctaaagctatcgcaagtttttctagttcagaaagattacgttcttgagctgggacagctttagaacttgttgcagtaaaagatttacgccattcggtgtagtcatgaccattcatgctcttagcgaggttgaacgttgagtcctgattacacggtacagaaactaccgatacttcgtatagttctaaatctttaataataaaaatgtcagtagcttcatcccattctgcatctaggcagcggaatccgatactgaaagttttcagtacaccgtttttaattagtgagaagatagctggatcagaactctcatagacctcgcattcaatttcgagacccatttcagtagggttaagatcaatacacttgccgattggacgacgatggtcgtggccgaaaagaataatcgggttcttcatgtagttagcaagtgcattagacgttttccacgctgaagcaggaattacgtcgccagcacgatctttactaattgtattggcaaatccacgaatcttaactacaccttctttggattcaccatcaatagatttaatataagcatctaaatgaacgggtgctgattttaacttgttatagtcaatcgcagcgtttgtcatttattaagcctccggtgcaggattgatagttgttacacactcgttagaagtaatagtagcttgtttgctatctgttactacaactttgtaagtaccagcatcttctgcagcagctgtagctttgttgaagttagggccagtagttccactaagcggtgctccatccttagtccaagcatacgtatatggtgcagtaccaccagtaaccgtaacacctagattaagagctgcgcccgtatcaactgctagagttttagccagattcttcgagaaggctagagccggaacaaccggagcactaccttcatattcttctttgaacttcttccaaacctttcggttggtatgtgcagaagttagtcctaactccctacgtagagtagcatagttaggaacaaacttgtgagctgcaaccgtagcaaagaagatatgagattctggtaatttctcaccaaaaatggcctttagaccactataatcaatcattcttcatccccttcggtggaaccttgcggtctgccaccttcttgaccagatacacccgtagcagaaccagcaacgttagcaggaatacgaatcttattcatctgctcatcatctaaaggttcaaggttcagctcttgtcgagcttcgttaccagtcatgataccgttattaaccagagaggttaaatgtttagcctcagcttccttgtctggcgttaacgcaactacttccttagtatcaggagtaactttgtagccaaagaagaaagtaagagaactagtcagtttgttcagcattggaatgatagtcatgtaatagaacagttcgatgtttggtcgaatgttcgcgttattaccaccatcaatcaagacctgcggaacaccaaaagccagacagacgctcttatcgaaacgttcaatgtcgtctttaaagtctagatctttaaatgaggatatttgggagtacggttttgctttcataccaccatctagaatcaggacagtagactgacccgtactaggattataatcgagttgtaattcttcttgtttacgctcacgcaatttcttgttcaggatttcatccgtctcaagaataagaccaatcactgtgccgttatcgaggaatttctctttaaagttaagcattttagaacgcttctcaagagagtcaataacagtagcaacacgagattgtccagaaatttgagagtttgtgccacatacgtaactgttatcctttataaagataatctcatctacgcgatagtctatctggttattaaatatgaattttttgataaacttattggcatctgcctcgacctgcataagagcagccgggacgtggtagagtgctgtgccatcccaatagatgtatgcacaaccttcaaaaagtaggtcagtgactacaagtctacggaatgtgcttatatccatgaatggattaggtcgtacatttaagagagtgtctagagtctttgccttgacgccggtagcgtatgtgacaatattatatttttctccgacagtataagaacactcagccgcactatcaataaccatgttagcagttcggttgagaatctcaatcttactgtaggcctgaccagtggtaaaaggctttcggttagtacgatgactaactggttccatgtctcttataatacgttgacccggatttagcttttcagtaatccagctttttaaacccattataagaaccttgcgaatcctgatttagtttcagtcttgacttgtgtcttttcttgaggattctgtaacttttccttttgtttaagaacccatgccttctgcttattagcagagaaaaggggaggttctttagtatacaccttatgtaataattggtgatggtgcacacaaagggtaacagtgtcatctactagctcatgccgatacttttcatagaatgccgtcctatttgagaggactgtttcttcgtcagtgaaatccaattggagttctttagcaaattttttaactagtagagacactgtatggtaatgatgaagctctaattcttcttcacaaccacagatttcgcagcaagcggcttttttatattgactttttataccgtctcgcatgagtgatattgcatcacgtttgtattttacattactcgccacagtgttctcctcaactgtatgaatatagtatacataatcgcatcgaatttgtaaaggggattttaaaatgcaggaatgggataccaactgagtagtatcccatcctatacttacttatttaccacgggaaattgagtaaattccatagcggagcgcatcacaaaggtgtgaacttgcatcatgacgtggtttttcacgtgatagtttttcttcaccttcttggaagtcccacttgtagttggccagggcatggatcaatgaggtgcatgaagcatctacaatgatcttaccttgctggaacaatgcttgcaggcatgccaaaccatctaggacggactttttagcaggtgcagaagcgatctcgtgttcgtatgccaagtcctggcggaactgagccgctgcggagtcaacaaaaatacggtcaacgttgtaacgatctatacagtgttggatataggccgcatgctgtgctgtcgttttctctgcttgctggtattcctccagtacgtagtaaatatccgtatcgtaatgatacttgatagtaagaactgctgttggatcacgataaccaacgtcgataccaagtaatgtttcgaatgcttcatcatctttaaagaagtgacgcatacccttgaggtctttaacatgctcgatagcattgaaggtatcaaagatctgaccttcgaatacagagaagtcagcctcatattcttggcggaaatagtttttactaacagtacgacgcgcttcctcgatatcattcaggtcagcacgtgggttatcacgatatgtaccatgaatagatacccagttaggtaacgtttcgttaaagcctttctcatagaactccttaaaccagttaccaccacgaggggtagagataaatagggctttagagtttggtttatctagagtaggacgaagctgaatgtcaaatgctgcaccaccaacgtcggagatcgctgcttcgtcaaagatgatgaaatcatacgaacgtccaaccgcggagtcagcctgcgccgcagaagccagtttgaagagagagccgtttgccagctcaatctctttatctttggcgttctcacgttcagtctgtaatccatacttcttaataagaccacgaatctgcgaccaaccgatgttggccagtgagtagttaggtgcaacaacaagcacctttacgttaggttccagcagttttaggaacccaagtgtatatgctatgaatgacttacctacacgacgtgatacgcatgctgttacgaaacgatgtctaggatcttccagagcattaataattgctacctgaggggcattaggtgtaatcccctcttgagctaggatactagagactggcagacggaagaagcgtttgtctataccaaagtcaataacatccgtagtgttaatatacgatcttgagacttccattactttctacctccagttgctagcgaagtaattaagtccatgtagttctgatcaccggagccagcaataatgttgttctgaatgttagtctgattagtgggggcacgtgtagcagctcttgctttctccagctctaccatcattttcatttcttccatcttcattttgtgggctttccacagaatgtccatgatatcctgatcagaacccataccagtttcttcgagttcttctagcttacgcttgataacttcatcgagtacaccgaataacttgtcacgattacggaagccactctccataaagatatcgttgagataattctttacctcaccacgattcataatatcccggaatgcgatttcagacattccgagagaacgtgcggccattcgtacatcactaccgcattgcagatacgcctcgattacatccatcccttcaggggacataagatcgggaactaatacatcatttgccattatgttaacctctgtatattaagtcttaatttcgggaattggatataaggagtagcagatttacccgcacctgtaactacagtagctcgggaagtaccccagaattcaatagcaccactagaaatcctacgtagatagtattggaaacgactcttaggtttaccatctgctgggttagaagcaccagcgtaactaaatacgttatcagctaggacaggcacgaactggtttagtggaagaaccataatctggtgacaaacaccatcacctttatcatagtccattttagttaaacgtttaccaatacccgcggcatctttacttgcaccaccggcagagttaacaccaatccactggagactcggatcaccgttgaagtcgcacaggttgttacccatccactctatacttatcaatactgtactcggttcacttgttaaaccaacgtttacagtgttgagcaatctcgttgcaccagtagcaattgcaatcatttgtgtgttgtcaccaatagtaacgttattggctttattcgctgggaatagctgtagtggacgtacacttggtccccaaatcgtcacaccattgatactaaccgtactgttatttgagttaattgctatactactagaagcagggaacttataaagccctatattccaaggagtagagttacctacgccatcggcagatctactagcgttccatgatcgcacacctccgtttttgttagttccatagaatttgaaggaacctccatcaggtagcgctgtagtagaaccaaccacgcagttactaaagaaatatgtattactaattgttggtacacctttactcgcagtactcaacatttcatactgagtgttacgcaggtcatgacctttaataacaaacttatcttttccgataataatttcagaaccggtaaacaagttctgggcagtataaccaccagtgttgttaaaggttacatttaataataaatgctcaatacgaaccggagtaaaatcaaaggtatactctaggaagctaggcattgtaccgttagctttcagacgctctacagaaccagtaatatattcgttaccccaaccagatgagtaggatccaggcatgttattatcaaagtcgatatcacgcaccttacagttagtcccacgtccattcagccatgactgagttaagttaaagaatccattagctaatcgacttccagattttctaacccaaacatgggaataggtactagaagaaggcccaagagggtacatataatctgggttaatcaggttgacgttctcaaacatctcaactggcagagctgggttagtacgtggtgtccagttaaggttagaacctcttttacgcttagtactttcgttagtggtgttaaaacccatcttcatcatgaagtacaggtcggctaagaagtcctcaccccactctccccagtaacagatttgcccaccagtaccgttgttaccaagacgttcccacatgttaacaccggcagcattttggtagtagccccattctaggtttagatcaaagtgcaaagcacctgtaaattgggctgcaataccaaccatgtcggagttccaacgataagaaccgcttttctggatacctgtcatctggtggtaatactctacgttatccgttcccttaactactagaactgggataaccacgtttcctctattagctagaactgttggcaaatctgatggcatagcaccgtgatagtagccattccctgcatgggataagttcgttacatatctcttctttacgaatagatgcggcatatcggagtggaaaatagagttagtgttgggtgtgttatgcatattaacatctccccctgcagccttgttgagggagaggactgttttcgttcctatacgtcctgcaaagaagctcataaaacctcaaaatttcacttgtcaacaagtctttatttttgtatactataagtataaattaaaaaggcatccaagtaaactagattttttatttcttggatggtgtactggcagaaaacactatgcaagaaaacgagaagccctttcaggaacctctaccactagagatgagtcctagggcaaaggcaatacatgatgctataaacgaaatcattcaagacgtcatacaagatacgatagaggatgtgatgggtacatcctttatattagaagaatccggcttcgatgaagtaatggatctaatcgggacagtcgtaatggttcgtgcaatatctagaatcttccaaataccaggcttacaggagaagcaaagagatgtcagacgacaacagaagaaagaacagacgcggggaagtgtacgagagttgggtaaatagtttcggattcgggactattctatttctaatctttgtagtttggtttatcgcggcgatggcggggtgggtgtaatgtcaacattagtaatcgtattcattatcggggtgcttgcgggtattttcgggacggctgcggcaatcaacaggcatcgtgaacatgtttcgggaatgatgcgggagatttcggaaagggagcggaagttcgcggagaaacgtgcggagtttgagcggcaatgggcggacggatctcgggcgtcgcggaagagatttcgtatgtctgaatcgggtgacaaaccagtagacaggcgttcctcctaagttagcgctaattaccaattctcgaaatttcataagattacacatggaggtgtgcccacgggttctctagatgagaatgagtctcattaccgccccggtacttagcaggctaatagtcacggcatgttatcgttacacaccgtgactattttatttttaattgttaggcaacttttaatttgtcgatgaactgttgcggagtgtaactatattctgctctttcttcgtcggtcataccttgccagcacatttctaaacgttgcgctaggaattgataatcgttatcatcatctaacgattcatcaataaaggtttcaccgatcaatgttaccccgattgataggatatcattcacggcttgagcgtccagcgttttaaatccagcactagccgccgccgctaatacacctttatgatcatcaatcatcgtaaaatcagcgttcgggtatagctgtttaaacagttcaaagtaataagatttatatacagcatctttgctgtgatatatttcgctaaccttatcagcatcaaagtatttgtgtaatgtatcgcgggaaaatacgcggatattactatttccgcgccctcgcaagccttgtttacgcaaataaaaataatcgcttttagacataaggcgcgcggtacaaataatatttaaagtatttgcatcattcatacattggcgcatatattcgacaagcggcaataaagaatcctgcataattaaatcatgtttgcaggcttcgcgggaatacttaactaaatctaaattcccgttatcatcaaagcaaggcgctacacggtgaaaactattaattaccgttccgtctaaatcccaaatcataacgcgggaaatatgcgggaaagtgcgggtaatattcattttaacttgattcatttgttacattctccatttaagggattagggttaattcagcattacccgcttattatatcaaagcgggtaataattaactaacctttatttgttatcctgctagaccgtatgccagagcatcagcaataaagctaacatcttcaccggatacgctagaacgaatccccgcgcaagtgtagacctttgcagatactaattgatcatcaaggcaaccaatacacggcgcgacaactgcaaacgctagaccggattttacagcgtcaataataatcgtttcttgcttgattgtatcgacataaacgccttttgctttaatatggcttgccgctttgaccgtcatatatgcaaacgttgtaacctgcaatgcttcgttaaagtttaacagatcatcaataacgtgacctgattcaacgtgataacgctcgccattagaataaaccagaacgatagaggaagcggcgcgatcgaaaggaatatttgattgtttcatgtttataactccagattattaaatttaattacgggaaatataagcggggattttttatttccccgctaggatgttaattagttattacgcaaagaatttaccattcttaaagtcaatcaaagtgcgctgaccgtttgcataggtaattaaatgcgtttgcgtccagcttgacgcgccgacgttgtagcccatatcaagggaaccagcaacgccagcggtataaacgccgccgtaaatgctagccgtgtgagtgtggcctgtattgagcttgcctaactttttaaactgcttaggattgccacggctgccgttaatgccgttgtgaccgtgtacgccgcattcaatgccagcgattttaaatgattggtctgtcgtcaggaaaatggcgttaaaatcgcaacctgcaacgcttctaagcgcataatccagcacgttaaaggtttcatcacgttcaccgattgcggcgtaaatcgcagcgtttaagcggtgatatagttcggcgtttgcgggatcgtctttaatgttagcgttacgatcatcaagccagcgtgaaagcgccagatcgtggttagattccacaatgattgtttgactaaaatcacgctccattgattctaaaacgcgtccagtatcaatcaaatcatctagaactttatcacgtcctgcggcgtactgtttagcaaggaatacaccggaagcgcggttatgatgattgcgggaagtaaaatcatgtacatcatgaataaactgatatttaggcttgagaatatcaagcaagctattttcactagcccatgacgcaacggcgcattcatcatctaatttttcggcgtgaatatcgccatattgcaagcctaaaacgtggcctgtaatttcacggcaaccgctaggagtggcgcaaatattcagatcgtaaaacatgccgctttcatccatcgtttcaatttgacgaacgaaaaattcaccatcatcatcaaattcaactaacagagcgccgaaattatgcaacgcctcagccttttgacctgctttctgctgaatatagtttttcagcgtagccgttccggttgaatacatacggcgcacaatttcacctttaagcgcgggcacactttcagcggtgattttagcgtgaccaattgccaaaccttcgatatttaaagcggtggcggtttctgcgaatcctgaaagcggataatctgccgttggtaatacgttaatttcagccatgaaagcaaagcggcgattattcaggaatacgtttttatcgcagatatatttattaaacgcgggatcgtatttgataccgtctgccccttccccgttttggaatccatttttattataaatgaatttagaaacgagcaattcagcgccgcaatattcagcgaatttttccagacttgctaaaaagtttttatgcgggaacgtattgttttgaatcgacgttagaataaaacggcgaccggatttaatttcccattgttcaacggtactagaaacaattcccgccgcttcggggcgatcatcatttttaatcgccttttcagctttcgccgcttttggttttgctggcttgtttgcttccagccagtcacaaattgcggtcgaatgttttgttgtatcgtaaacggcttttgaaatatcgtcgcaaacttccagtttagtagcgcgtaaacgtttaccgtagaaattaaaatcagtggcaagtttaacgatctgggcttgtttttctgcggaaatattcataactaattcaactccattaaagggataattaaaacgtttattactggcaatattgccaaatataacgccgtttatttacagcgttataatttgcaacatttaattaattggcattaagctagaacttagaccgaaagcaattgcaaccaataaaaagaatcttgcagaccaaagcgaggcgacattagcgcggtttaaatgctctttatttgcttgactaataacactattcattagctcgcaaagtttagccatataagaataccgcacgaaataaaacatcgcagcgataataaataaaccgagaattagcgactcgctaggataaaagatcatttttataactccagttaaagggaagatatagcggggaatattccccgctaattaaaatttattcacctgcggcctgttttacttcctccgctacgccgagcaattgcgctacggcgtccagcgtttccagttttgcactttccagacttgccagatcatcggcgtcttttacgatacctgaatcaatggcgtgtttagcaatgacgcgcacatagtgagctttacgcaccgagctaccgccgccaactttgcgcggcttatcgcttttctgatacgctttcgcgcttgtcagtttagaacgaacagaaacaggacttgcagcaccgaccgcgcttgcaatttctttcaggccgtcactgttagcaaattcaatgccgctatcttttacaaaagcgttatacattgatacagctttttcggtgttttcttcgttccaagaaaatttagcggttttttcggttttaacgttagacataatttaatactccattcaatttttaattaagggattatgattaactaaatgttaatcgctatatattctataatctagaatatataacggaaacattttatttttatttccaatttatgctgtttattaattcccgaatatatttatattctcaccttttccggcttgccagagaattaatatagcgccattgtatttatacgctggcgatctgatcgctattacccctttcgacgggaaccgttaacgctagattattcgaattatcattattgcctaattaagcatgatatgtttagttactaccgcttattatgcgatagcttgccatttatcatccttttgaatgatctttacaacgtcgccagatttaacgcgaacgttataaataggcttgccgtgattactacgttccgtttccgcatagaccgcttcgattttatcgaaaggatcaagcgccgcacctttaatacgttcggcttttccggttttttcatccgtcatagtgatgaaaggaatgaaaacagattgaccaattttaggcgcggtaataacgttttgcatttttaatactccggtttattggggattattccgcgttacctgctagatactaataacaggtaacaagttataatccgctaggagttagcctaaacattaccgtttttccaaattgttaaagagcgtggcgttttgtcgttcgccgtggtacgaggtgaatattaaaacctatcggctaacctgtcaagcgtttatttcagattttttatttctttcgtgaatctcttttagattcaacatcatattatcccagaccatcggcaagccttgttgcataccgcgtttataggacttgaaacggcgtttcatatctggctgtaaaatttctagcaacatgctaacctttttacagtgtggcgcgattggttttgcactgataactaaagcgtttactgatttgatcatcgtcttattccttattagtggagtaagccgataggctttaattattcacctagtacctgatttttaaagagcgtggcggtaaacttccccgccgttgtagtccgttgccgtcctacgagataaataataggttattcaccaaatcggcgcaaccttatttttgtaaagaaacgtaaagaaaaccactacccgcaagcgtccagcggcgcactaaatttaatgaaacgggcgcgcgaataacacgaaaacaaccaattaagcaagtaattttttcatttatatctgctcttgcctacttgacaaaatctaaaatcctcgtggtgacgttttcgactacctccccttatgatgggatggcttttcctcaaaggcgcttagaatcgcttacagagcgttttagaccctgttaataacttatacaaaaagcaaaaatgaaatttaatgagttatccacttgatttttcaaaaaagtattttctgctgttattttccattgacaaataagtctggacgtgtatcagatcattagcacgctaacagtcgctaggatgataatcacgctggtggattgtgacttgcgttatcgttagcagactattaatcacggaaaatcctattagccaactaactatttcatattatataatatacatataaattaaggagaaataataacaagggaaactatcgggctaagtaagaaccactatcatttaacttatccccaaagttatccacagcacaaaataatttgacacgataagcggcgttttgagcacttatccacagacttataaacaggttatcctactgtataaatatacagggtaaataggtagcactaacaaccgcaatcaaatttaagcggcctagaacgcgttctaagcggttttctagcactaccccttattataataaagccttgtgtacgcttacagagagctagaaatggagaacgcgcggttagcatacttttttgatttgagcaagaaaaataaaaaggtaaaataaacgttgcccctgaaaagagaaaacgcttattatctttctaccgattaacgagggagacaaagaaatgtctttgaccagaattgcagtaccagaaaacgcaactattttaaaaggtagtttgcgcaacctgctagatggtagtagcgcggcaagcgttcaccatacggcggcaaaggttgaacaaattcacggcgatatcttagatgataatgataatcattattcagtcgatgaatttacacaattgcttgatcctacgcggattttagtaatgtacaaccgcgattatttcatctttaataatcgccgtgaaaacaatgttgattttatcattgtaggtcatgacgagcgcggctatattgcccgtggttataatgtacaggaaaaagatcaagttttcggaatccgtgtatcgaatattaattctagcagtgttgaggatctgttagaaagtatttggcgcgatctgccgacaactattagccgatctaaagaagattcaatccgcactactggcgtattgtgttttgaaagatcaactggtaacatgttgattcctaacgattattttgacgatgaagattatgtgatgaatgtcgcaaaatctggattcacattaaaaccagttgacaacgtaacaaaacaggctgtaaactctcaaacttcaagcgcaaatgcgcaaactactgaaaataaaggaaataacactatgtctaaagtaaccgctatcgttgccgctaataaatccgccgccgctaccgctgcaaaactggaagcgggtaaagtagcacttacccaactgacaaaagtagcggctaaagcgttgccgtccggtatggctggcatgtttgcaaaacagtatttagatactccggtcgggcgcgttgttgttgctaacttgttaaatctggcaattgagcagtacgcaccaaataaccagaaagcgcggattgttgcaaaggccgcaatggatgccgcaatgctggaagtggtacagagtttcaatatttctgaaatgattgataaagcaattgaaggtatcaacattgatgctttgactgctaacatttcagaagagtaataataactagcggggattatttccccgctttcccttttagttaggaggctaattaatggctaaagttccctgcaagtatggtttaatgatcgacggtgaaagatcattaactgaaattatcgctattgtcaaatgtgaaacgggtacgtgtggcgaaagctggacggatgagcatttgatctatgcggatactgatattgatcaatttgcgcacgattgcgcaatggaaaacgcttccagttttgggagtgagggttattatgtttgccctgaatgcggggatcatctagatgatgatcattgcgaggattgtaatacatcttgcggttatgaagaaaattccgacgtttgcggaacggtgtttcaatatcagttaagccgttcggggatttatgtaaatggcggcgatcctatcgccactgttacaaaatggatcattgaacacggcggcgtttcgctgaatggtaacaaggcgttactatatgcaagccgattaaaacagcttgtttatattcccgatggtaaagaatgggaagaatacaacgttttgattgaagaattgaaaagcagttttgaaatcgaaatagtagaaatagcctaatgtaaagttttgtaaaggtcgccttaatcggcggccttttttgttataatgcctttacaccaaaacggtggattgaaaattttcccaaatttttggaggcgttaaaatggtagctttctcttcttctgactctcttttcactggtaaaggttgggtatctaatcgctggattattgatcagatggtttctgaatttgggataggtaaaacttatgttaccattcaggcgctttatgataatgataagattgaccagcaaaccgccggatttttgctggacacgctgaaatcagagcattgcactaaaaagcaagctgcaaaaattgttttaatgtaattagtaacggggcgttactttcgcccctcattccctttctaggagttatgcaaatgttaaagaatgtttcccttgcccgttctaaaggttttaagctggtggatgttaacacgtttgagcgtccagattgcaagatcgaatatgtagcacgcaacaaaaacgcttttcgtgttacagaaaagaaatttgacaagcgcggcaatttgatagccgaaacggttaaacactttgctactttttacgctgctttccgtggggtattatgattcaacaaattaaaagggcgttccaatattggggcgtcctgccttcaatcggttttatgttaatcatcgttagccagctaatctttatcggcgcaactatttgggagatgtcacattggtaatttatgaaggcaaccgctttgtaactaattgccgcgctggattgttagcgcactatctaaatcagctttcccctgtttataaaggagtggttaacatctatgagggcaaatcacactatcggattaatgccgttgttgctagggagcttgccttccagtttcttacttttggctcatgtgatgtacaggttatgggagagccattaatcgcagaaaatgaaaatgaatttattgatattttccgcaaagtatgtacagagcgcctgataatgaaaggcgcttatattcaatcaaccgctgatagtattgaaacagcgtttcgaaaaattgcatatgaatagctggtggcgtaaaacgcaatcccataaatctaataataccgctgggaaacattcccagcgcttacgatttgggaacggcttcacaatgctaataataatcattctcattctaggagcaatggcatggctgtaaacattcgcgtaacagtggagcgtaaagaatacgttacaactgaaatcacgctttcggatgaagaataccgaaagtttcgggaagatcttcacggcgacggacggctaaacggtagcaaggattttaaggagctaggcgacgaattgctaaatcatccaaccgcaaagcatttcgattcgtggggtgattccggtagcgttctattgttgaatgatactttcgaggatgaagtatacaccgagtaataataacggggcgcaactatcggccccgcttctttttgcccttcctcaaatttccccttattaaaatacctcctccaaaattaaaccgcttagaacgcgttacagagcgtttaaacgctatattagagttattcactacataggaatactgtataaatatacagtagaataacctgttgataagtctgttgaaaacgcctcagaatcgctaggattttgtcaagtcaaatcgtgctgttgataaacctgtggataacttaaatagcagtgtttctcacttccctttctaaatgataatcattctcattatgcgtctcattcgcattcaactctgtaaatgataaccgttctcattccgcttcctaaacgcgaatcattctcattcgcattcaacttctcaaatgcgaatcattctcattatcattcgcatttcggcaggcagggcattttctatttgccctgcgcttttgtgcaaaagcgacatttgctccaatgggttacgtgtgggcgtgtatgtgcgaatccgacaatttttggtattgtgcaaatccgatgggaatttattttatagtgtgcaaatccgacaatgaattttcctaaaaactcgggcagactcgtgctgcgcacaaatccagccgtatatgtgcaaatacgacatgagtttgctaggattaagatgtgcgaatccgatgaagtttttgtgagttcggtgagagggtgtgtgattgcgtgagtttgtgtgagagttgatgcagcgagggaaatttggaggagaaacggaaggagcagcggtggtggcgtgcaacgccttgtttgctgcgtttttggggataatgtgggatgttttgggaagatttgagataggtgtagattatgtgaaattttattagttaaatggggcaaaattgcttgacaagtgaaaattcctgtggctctaaaaactcaggcaatcatgggccttcggcccgaaataatgctgctattttcaggagagtaagagttcctaaaaacttaggcgtttgtgcaaatccgaccgatattttctagaagtgcaatgtgcaaatccgatgagagtttctggaaatgtgttttcaaaaaatgtctatcagaaataaccgccctccctataaccgccctgtattaaccgcctattgctagagtttctaggaacaatgaaaactgccctatatagcgtaggttttcctagaaacttaggagtctaggagaaagtgttgtgccatcctagcagatgagcggcaacaggtgtatcatcttgaacacaaatattgcctttaaatatttttagttatttaaaagttaatatacccccatttcatgagagttagcccctctaggcgcgtgcgatttagtactatcatttaagttctcgtgagaaagaacatattctagaaccactcctgtcgtcggaacctatcaatgtttttctttgagaaatgctagtataatctacggcctagaggtagaaacaagttgatgtttctaatctatgagattattataacatgtgtgccaatgagttgtcaagaagattttgttaacgtttatacatccttctcgactttgagtatcactccctttgacgccatgtagaggaatgttgctaggtaagatgactcagaattaagcgcagaataatctgtagttcctctatgtcgaagagatccaatatcactctctagtatccctgtaatatcataactaactgaaccagcaattttgagagcttgggattcatttcgtttgatctcatgatatgaggacattaatgtaggggacatctcccagttagattttatactcagatcaacctgcgctaacactgaaacaatccctagctttaactcctgaacattggaatatggagctgctgtaaacttttgaagtctaggcaaatgatcatattcacatttctttggtggaatcattaagatgttgggataacattctaatgccgtctttgcagacccttccttgaaatatgggagttctacatctgcaaatacgtggtaagagttagcagagaatcctttaatagttgggtcaactgtttgaatcagacgacgtaaacctatataagaagctgctagggtaacttcatcacattctttattatatttggcttgtccaccagcatcaatatatgctggataaaactctgaacagaaagcaattgcatgagcttctagttcgttcagttcagaaacacgtttgccattacagccccttgcgaggctgataatttctgctaagttctttttaatactcattaagccccctgaagtttagctttaccttgatcaatagctgcaaatgcttccatgattgcatccgctagatcactacctttagttgggttactcaaattgatggtgtagacagaacgaataccgttactagaaactccagagtccgcaggagctgtgtgattccctgatgtactccactcatctctcatgaacgcttccccaactttataagctgtagaagtctcaatcggaccgccacattttacagagtgcatatccgacattagtttattatcattactactattaagtaatgcaatcggagtttcaaactgcgaagtatagcgaggtattgttgtctgactaggacgattcacttcagtcttcacgagtttataaccagcatcgatcaatgcattaatgaggttatcagccgggatgcgagccgtgccaaagatagctcgagcactaacgagtttgctctcgaaatccttacaaccttgaagatcagtgtgcaaaaacgacatcttcatagatttgaactgaaccgttgcagttaagtctttaaagctatagtcccacgtgttcaattcatgatctgcgactacttgaatggtttggtgttggaatgctgctaatgtcattatttggtctccagtttatctaacagcttgcgagctgctacattatattgtttaagttcacgattaagaatctggttctcactaattaattctagattcttggtattgagactactacaacaaactattaaccctagaattgctacgagagatgctactaacataacgagaaatattacttccattatttaatccctagatattttttcagataaacgatgaagtcttcggctttatgctcttggctgccttgagccacgaataacttcagagcctcacgctgttgtttaagatcagagacttctctccgtaacttcacgttatcatcaatgatctggttagcatcacgagtcttgtgtacagcggtgttgatagcgaagactaatgcgattagtaagataattaatacgtattccatcagttactccagattagcatccaactcttgtcgaaagtggctgctctgttaattaattcgcccatagagatactattgtcctctagggcttccaatacaaactctttaccaaaatcatctagtaaatattctgtaccatttatagtaatcttatacagagttggaactagtggatgttggtggttaagtggggtctcactaacagttatctcattccttccccacgtcgtcttgaacagtttgtgggataggagagctaaggggtttgaccaaactacatattccatccttctttaactcctgttttaacttttgatctttattataccaaattatgtgatcaccgtcaactacaaatttgtggagacatgctggtacggtgtacacaccatgttctgtaaggcgtgtcacaactttgtgtgcacatagtcggcaaccatgaccttctaaatgagaacgtgcagtctgcaagaaatatccatcatgatctggacaatagatctcaatctgctgttgcatcgttctatatttaactctctcgtacccaaagaacttaccatgagcttcgatagctcttctaatgaatataaggtttagtgcttcttgttggaagtctggatgtaattgtctgatcttagttctattaatagatccatcagactttgtgaacttattatacgggaatgctagagcttcctcataaagtaattcgtttattttatcacgcatagtatacacgaaaggccagaacaattaagtcctggcctctaggattagtggagtttcttaccttgcaaagctaagcccgcagtttctaacagcgattcagtaacttcacgagagcgtagatactcattaatcgcatgacgacgtttaaaagcgtaggcattaacgattaagtctagagcaccgagaacatcaggaatggtgacttcttcaccgttatcaacctcttcctgagtaatatccattaactgcccaacagctaacagaagccctaaaatatctgctgtttcactagccaccagtgggttagcacattctacagttgtatcgaaggtgtgttggacaatatcctgtccatcaacttttccttcctcaatctgcttctccaatagcttcatctgctcgagaactggatttttcttttgagtcatgatagaggtttcctgtatctgttggtaagaatgaactctgctgcttaggtggatgttgttttgcaatccagttcaggatcagtacacggctaggaacgatatcggtattgtaccagaagtcatgaacccattgacgcgcatcttcgaacttaccgaatgtatatgctttcttgaacaactcaaaaccgaaacaatcaggtgcgaaatctacatcacgataaggaattaccttagaacctgttaggtcttgaatagctgcgttgatctctgtatgggaatacttcgtttcatggaaagtattaaagaagcggtagttaaaacgtccgttcgtttcgacaaacagttggatgaacaaatcgttgaattgaccatcaaaccagtaattctgtaatctttgcagtgctgtcatttacgaactccatttagtgctgcgataaagccttcatacatgaaagggataacttgagaaacgtggaaatcttgaacagtccaaccagcttcttgatacataatgttaatgattgcacagcttagtatgaaggctggtaggattatgaagtaatcccatgttgctttctgcaatcgggagttataaaagttgatcatcgatctttaagtctccttattactttggcctgctccacaataatgaaaatggcaaccactaatccgaagattaggattgccgctaccattgtcaggtcaatcacggcagtcgccacttataatggccagtccagagagtttctggtacatcgtcgtggtgcataaccaaagaagctggtgaatagctatccgcatattctagacgaatcatttcacgttcatcaccagtctctatatctttaacaataaccttcatcttgagtggaggcaattcagaaagtggtttccagagatcttccagatctgctttggttttattctgaatagattgtagaacatctaatgtttgtgggtctacattaataaacccacgctcagtaacaaagcctaggaactcttccagtagggttaattcagtatgattaagcttcatctttcaggatatcctcgatcatgtcagaagattgctggatttcatcaataatacgcttgacgttggtcttagtgatcttacctgcgatcattgtgagaactaacgcaacgataagaactggaaccgggataataaacagtgctactttcgcaacgttcttaatagtccaagtatgatacttttgaaccagaactgcaataacaacaaggtacatcgctacgaggaacataatcatttcttaatctccgtaataatctgcgcacgcattattttaacaggtagtttagtgtttccagcgagtgcttcgatatttgttagcttttctttgagaagatcagaacgtctttgtgcgtcctcaatgtctttctcagcggccacatacttttcccagaggccattgttagtgagcttcatcgcttccatatttttattggcgttaataatacctattacgccaccaattgctgctatggttgtgataactaacaatccaatcagaatttccattaacattagtctgttactccattactacacttaatgtaggggcttgtcattcgataaaacttaatttttactaaggatgcgtcacttgctttacagaaacgcttaccttcttcaatctgtagttttgcttctgctatatcttctattttatatgcatcgacaacttctacaccagagtatttagagagtgcttcatctaagttagcttgttggcgtataacgtttgcttctgcgagcaatttattgcgttccgccctttctttaatctctggatgaatatactctgttactgagatcgatacgggtgcatcttcatcaactttatcacgttggttaaccatataattggaaacaccaagcgagatagctaaggaaactagggcatttagccctagggtaaagaagaattgtccgttggtcattatttcttacctttcagttgtttaacttcacgctcaaaggatgctgcacgacgttccgcagttgcctgatgctctttcgcaaaacgtgcttcctgcttagcgaggttgtacgccatagcgttcttgttcagagaatcatacatctttttcatagccggaatagacatcttcatgagctgaccttcaagaccctgcatatcgaggagaattgccagaacgttagccatttcgtttttagtcatgttttccattagaatttcctctctcattaatttatgaacttattatacagaattttgaagctaaaagcaactgaatttttatttaattaccaatcgttaacaaaaccggagaactcagaagcaaatactgcttcaaacttttccacaatatgaggatgatctttacagatcagctcgatgcacttctcaggttccataccgtcttcttcaggatcaccgtaatacttgtcccaaagatcatctggaatgaggcgttccgctaagtcctggaaagatactaactgataacgtggagtatcttcaccaaagagctcttgtaaatcttcactcacatcgcttcggtaatccgcgatcaacaaggcattgcaagcgaaacattcccacatcatcaaacgttcagaaatcgggttcgatttatcttgaacataggactggaagataaaagagaagttagctttaacttgctcaaacttatctgctgctgcgatcaagagtgctttatcaaccttttgcattttgtttccttctcatcaatttataaagtaattatacagaaattaaggcgttttagcaaatgaagttttaaaataaaaggcctattcctaggccaacaaagaaagaaataagaactactattgctatcgcaataaatatttcacgagccatgccgtcgaagtcaaacattatgttcacctcgcaatactgcagccacatcttcccctatttgcagtacttcaccagtagtgcagttaaccaccttatcataactggtatacttgccagaaacaatatcctcgagaggaataggagccttgctcatctcaaatgagacgttgatgtagcgtgggtcacgtaaagagttagtgtgcacgtgtccgtggatgtttaatttaccacgaagttcagcctcatgcaacggacagtgtgacagccagaacttcttgcctccaccagtttgcttacctagagcttgaatgtcgtcgtaaacttctacgaggtctttaatacgcaagccctgacgttcagcatcatggttgcccataataagctggtttggcacgttgtggataaccgattttaattttgccagaccttcgcggcctactgcaacgtcccctagcaggataagctttgtacgcttaccaatgtgcttggatagggtatccaaaatatattcgtcgtgctctttcatgttcttaaaccacgggcggaaacgtagagttcctgggtggtctaagtgcaaatccgaccagaatttaactttcattggtattccttatagaataaatggcaatgctagtagtaaggatagcatcacacaaacagcgattccccagaggacttcagcatcaatctcttggcgggtctttctcataagacttcctctgcatatttgttccaaccttgacaatagctgctaataccacgaagtttgaatatttcatcataaatctcgtggtgttctttagcagcttgatagcctttgtcaagctcttcctgccgtgcctgttcaaattcaacacgattctcaagcatcttccagacttcttcatactctggccaatcgtgctctactactacagttttaagctcttctttattacgttggcgtctgctataccatagctttgttacgatatgttctagagacacaatgctactttggctgatatgccctagttttagggcttcttcaatatcagacagttttattactatgtaacgatcttcgcgttccataattataccttatagaatgttaggttaggcctgttttgtagggcatcagcaagaattacggtggagatttggttgctcaatgtaactcgatagtctgtaaaagaccatgggcccttttctgggtctactcctgtactttctatagcaacaatattagtacgctcaacacgagggaatcttccctcgatatgaatctctactaaatccccgttggagagttcaggggtaaacgtgccgccattccaggcaggggtaaaagtaatcttttccattataaaatcctttgtacaccgcaactatcgtcgcagtctgtagtaaacgtcataattttattagcttcatcactaacttgcgcaaccgtcaacttgccgttgaaaacaccgccagtatcgaggtaaacacggttctggtacaggattgggtatggaataccagtatgcccatggaatacgaaatccacaccctcaactggaggcacttccataatcagctcatccttaaatcctgcataacgctggaagtaaggatgctcagcacctttacgtgccagattgaagccaatttcctgaattacatcacgatcccacaaatatggctcaatatagtgagctggatgatcatgtttgtcgagcttgctagcctcaatcttctggataatttcatcccagttaggtgtataaacttcattaccacactctttatactggaatgggatacctgcatgaactacaccgtacttcttaccgcgatgcagaacggttaggaatacaggtagtttctgtgccatatctgctgcgatacctttaatagtatcagtatccatatcatttatagcccagctaccaccattatacatccagttggcgtagtcaccaccaatcatgaactgatcatgatttccacgaacgctacggaaacgtgggttgtataagaagcgtgctagaacctgtaggttctgcttaccacggtcaatcaaatcgccagcacagataacgtagtctcgtttatctttataccctgcgagtttaagggcatcatccagcatatcattgcagccgtgaatatcccctacgaagaacaggttagcagtatctggaactactattgtttcatgtacattaaattcttttttcattatcgagtcatccaattagtgtgcttttcagcttcgttatcgttaggctcaaagactacatggcagtccactgcttcccagaaggcagctttaataatggcgttctgttcaccaatatcaagctcttcccactcttcaagcgtttctaaatctgtatcaacttcggtatcacagccaaccaagcccaaagacacaacaatagtaacgcgatcttcacgttcttcgggataagcctcagcgtactcccaagcagcctgttcaacataatattcttgctccgattcagataaagaattgtatttttcttcggtgatacccatttcgacagcgcgagtaccacaaactacgttattgtgaattattaagtaggcatagttcatttatttgatactcctctcatcaatttatacatatattatatcaaaaattttagcagaaagcaagtaataaaaaacccagatcagctaagatctgggttggatttattaatcttctggattatcttccaggaaggttttgatagcctcgtgcatagtttctttacgaagctgacgaccaaccatgatatgattagcctcaacacgaccattcgacaaacgatctgctagaaccacaacaggaacttgacgaacaccaaacttctgcatcagatcagcgttatcagtctctttatgtacttctaggtcatagtcagtgactactttatcgaacacaggctcgaacattttgcacgggttgcaggtagatccctttaacagatatactaatttactcatgtttattaatggcctccaaaaatgccttcattactttaacagtcgcagtgctaaggtctaatgtagctcccaagcactcggatacagcagcctgataaggggcttttagcctgccttctggtacttgtactttcttataggttttctttttaactttatccagcatcgtttcaagaacattgagaggcaatttttgaccttcaatgttcacacccagctcttccatcagcatagtgttcaagtcaatacgagtaagtttcttgcccttgctagacatacgaatccccgcctttttctcaagtttttgacgctctggtgaatcgaggtcacgtaatgcgatgttcaattcatacggagccatattataatggttggccatctgagtatagaaacgatctgacatagtgaactcctctgattcaatttatacatatattatataaaaatttaagcaggaagtcaattacttttttatcttaatgagctatatgtgggaatctcttcctcactaagtacatagtgattggataaattgaatacataagtataggggagaaaagggtgaaataagccgtgactcccccagctagcataagtggtatcagtgctagagtaagggccataagaatcataccgaatgagacagccagggctatagaaatgcagttctctaactccatccataaccaacaatatttcgtattcctctggcaattgcatttgcaaacgccgaatgtgcccataattatatactctagaccgtgaacgattttctttaagaaatcattttgggtaactagtgcgactaatgttaatattatcattaaaacgaacactatcagacttactttccagatacctaatagcgtcattgtgaatagttctgcaaacatggctttctcctatcattaagttattaaagccccctttgctttaaaaggcgggagaaccccgccttaccttactatttaaaccaattctacatgaccgccgtcataggtaccacgctggatttcatcgtgataatcaccggaagcattccagtcagccccaaagcgaagtttcacacccaattcttttccagcttgttcaaaagccttcttaacagcccaaaatgcctctagatcgttccaatcgatcttgccattaatatatggtgcaaaatctagagcgttacctgtaacgtgtttgctcttgctaggatctttgaggaatgatgtgccattagcaatgttttgggcactctgagcaacagtacgaatcccctgaacgatagtaaaatcataaggagacagttctagtgctctccgagctactttttgtagctcgggttttacagtagcaagttgtttttcgctatttttaccaaatttaaaactcatattgctctacctaatgatctctgttgtggggaacagagctttgttaagtactcgttaaattgttccgagtcagctgtatctacgggtttatccttccaagcaacaccaatatatccagcgtagatgttgtttaggttgaaatacggacacgtgtaaatgtaattaaacgtaacgttcttaaacgtagggatatttgcccccatatatttattaacctttaccgttaaatccgaagcgtagttaaagccttccaggtgacgtctatacatctcagacgtcttgtttactgctttatcggccaagtcagccctatctaattgcgcattgctttcccatgcgataatgttggaataatcattaatagcatcaggtttatacttgactacaaaaacagcatccgcacccgtttgcgagaaaagcaccatactcttctctctcgctacattaggaaagttatcgatcctttgggtttgaacatcctgtaaaaccgcagacgtggagaaagtctttaaaaatgacatcacctcgctagtattactaacaaataagaaaataatgacagcaactaagatagttagcagacgtttaagaagcgatgctggatctttcgcttcttggagcagtaccgttaataattgtagaaacttttccacttgtaacctcctctaaccattaccattatactaattctagaggaaaattacaacgtgtttttaaagttcacatctggagcacaaaattttgtcgttgtcaagaataattttaggcaaaagaaaagccagagtcgttaaactctggcttaaaactacttatacttccccatgctcctcagggtgaggacactgggatttgctgaattgctcttcgcgatatgctgccaatttttcaatacgcttattgatttctttgctgttgagatagatatttttattctcttttaccatatcctcgatttcttcaattgagaagaacgggaagtagatatcgagcatcatatcttctacaaactggttgtaagattcataggctttcttgatttcttgacctttctcacagaatccgccagagaacgtgtgtcccataagcgtagagtgtggatgtaccacccaaccgtggcatgacaggaagattgtgcagtaggcggatgcactaggacctagcaggtgtccaataaccgttccacgacagttagcaattaggttagacaattgtgcagcagtgtctacataaccaccagggccattaatcatcagattaattacgtctccctcgtttgcttgtaccaaaatcattgacaggtcacgatattcatcggacggcccgagttcctcatcaaagaaaaaggtatactcgttagattggtgcacagtatggaacaggttagtcttttcttctttcttattagtcatagtgatcctttaattatccaactagtggttctagctctaagtcacagaagttatacacttctagtttaaggttatccatgccgatgaacggattcaccagttcatgggttatgtatttagctggaatacctttttcagacggatgatctgtcttaatggtaaattcctgctccgctggtactacattcactaacagagaatccatatctaaatgatttgtttctctgatcaactctccttcattagggaatctcacatctgttactacggcgacgtctgggtcgtctttagcgatggattgctccagaattatgagccaaatgcgttcatgcaccagctgccttcctaactcagtacctacaagctgtagcatctttcttggcgaaataaacacactatagagtgcatcttcatccgaaccaataagctgctgaggatcaaggtattttccttcaaaaatcggccaaacgtacgagaagtcttcatatttgtcgattccgtatttaaaccacacgtctctagctcgctccaattgagattgagtcactgtaaaccattgactaacctcttttcccctgcgctctcccagaaactctggagttaccccgaggattacggatgcaagttcgtaaacgggtttagcaaaactgtaacgacgggctagacacgttggatacgtatcattacaccagtcaatcactaatttcgcaacggtatcttttcccgcaccagcctcaccatgtaaaccgactaatactgacattaatctttcctatttgtaatgggtggatagtaaactaagcaacgtttctcttgtaaatcttgacggtagaagcaaaccatactagtcagtcgtgaaatatacgaatattctgcctcacggcattttgccagcatattccagtctttatatggtacaacaactactacgccatcttcgccatttgtagctaactttttctcaaatttgaagtcaaagctacacggctgaagtcctttgggccaatccacatgtgctgttggcaattcatgggacggctccggtactactttttctgcacagcctgtgacggtgattgcggctgcgagcagtattccaagtttccagttaaacatgctaatctttcctcgaactctttactctgctttttagctattaatgttaccagtccaggctttgcagctataatgtcttgacgattaagagctttatcaagctgggagatcttcttatcaagatcctgttgtgaaatattatggaaagtgaagtattggttcattcgtgtttcacgttgttcactttcggctttcaccttttccaaagcagtttctagagtagagatcttcttagttgctactgcgagatctcctgctaaagtttccaccttatttactaggtgataagcaccgaatccgatgcctatcgccaaaccagctcccaggatataccacttaccttgccatattcctgaaagaagtttttgtatcaaatccatgagctgctaacctgtctttatctgatactgtaatcatatcaggctcaccagttcctagtacaccgaaaatatattgttcgagaacttggtgcaaacggtataagttactttcaatttcctgccacggaataccggactgatggaaacgaatgtttgtctgaataatgaagttacgattatcatcgttttcattcttcttaatacctttcacgaatgcgattggtacacgcagttcagagaggatacgctctgccgttggcttggcttctactaagatatcacgcatcgtttcacgaacatcaccacgactcttatcagtgaagtaagaacgagcatgtaatcccatttcttccatcttgtcgaacatagcatctagactaaacgtcttgaagctgaattttggatgccagcagtataactcatgtaaccaatatacttcaccagctaagaacagtggatttacgaagtattcgaagtcaccacggaaagacatactgccttcatggaatacctggcgatcgtggatgatgttcttttcagcatcttcggtcacttttaccagaatctcttctgatttacgctcccatacacgatccgggtcaaataagctgttctgtaaatcgtatacatcagcaaacttagaaatgattctcataatttatccttttgcctcaatctataaacatattatacaacacttggggcatctgcgcaactaaaattttgttacaaaaatagcccagtcgcaaattatgcaggctgggctttgtcattattattttgctagtaagttgactttagatgtcaatcttctttggtactcaattctctagcacgacgtagcgatccagcggttctccataatttgatatcagcaactgtctctttgtagggagcgatagtagcaccaatcggccctagcaagagtaacccaaagaagcctataaagcgcatataacgcagacattctttcggcgtcatttccatgaccatttgcttttcttcagtattatcgaacttactatcagtatcctctagtcgtagatacttaataaaccactcagcagagtattcgtcaaggtggcgaataatcgcaatagcgtatcctaagccaatcaaaagccaagatactaaaacaattgtaatgaaggtcatgttatctcctagtttatgatatggtcagcgaccaactcaccacttaccgcactaaggggcacgactcccttatccgtaacagttgcaggtgacgcaactcggtcctacgcgagttctttaggagtttcgcatctcagcacgaaacttcttcattttacgggttttacggaagaagaaataaactgctaccggcccgaataatgtgtccataataaccatcatcgccatcatgcatttataaagtctttctttatctagcatgtctaactctgcgggtcgatgcttttccataacatagagagtaacatctttgttcttggaaatgtagagatcatcaattaaactgtagatcgccacaactgcaccaataatgaaccataaagcaaaaggagaaacaatcatttaatatccttttcatcaaagtagatttcggtgaagtaaggaactcgtcccattatcatagtatcaccgaatttttgcataagatcccaaagaggcatcttgataaacccatcagtaattacagggtcaacatactcgtcaattctttttctagcaaagactgcggcagcttctgaagcatgttcaaaactatatgcttgccagaactcagtatgctctttacgaaggaactccagaactgattccgtcgctagaaccctcgcataactgtttagatttatttctttcacgttcttctctcctgcgtttacgttcggccatcatgtgggctgcaacaacttcatgatagtggtcattaatattgtctttcggtaagaaatgcttaattgtttctatctgacagacgactcgataaagatgtttatttggtagagttaatctcatacctgttatgaatccagagaatcctggtacactacacataggctcagcagttacagaaccatctggttgaagtataacctcaatcgagattcctaacttcatactgtaaagctggcaaccttcacctttaccaaaccttgcccagactacgaaatcttcatcaatctgatcttggatttcttctacagcagtctggattctaggatctaaattactcatcttcaccttcaaagtcgcaatcataacgacaagtaaacgaatcggaattgttagaacgttgagtagtgatctcaccgcgcttgctaacagtaacagcaggagtagagaagtttttattagtatagatttctactttgccattacgttctttaacatcacgtactttaccatactcagtggtaacaccattctgttgaactttaacgttaccatttttcatagaaactttggtggatgccagagaaccgaagctaactgctgaaatcatcagtgcaataataaacttattcatctggatcttcctcattacagtcacggcatacatcatagtcattgaaagaatgttcatgggcttcacaccaccagccacattcatcacataggaagatctcagtcttttcaatggcctggcctagtaattcgtcggcttcatcatgtgtgatcttcaggctacaaacatcagcaacacgttgaacaatcagactccctactttatggtaggacatgcaggttccctgtgcatcatgctcaagaacgtggatagcgcagtctaaacggtttttcatttcaaagccctctcatcaatttatataaatattatatcaaaaggagagggttttagcaaatgaattatttacgaaattagtcgtagatccaccagatgcctttcttacgaaggtcgtgatctcgattgtagtcgtaattttctggatctttcattacatgatgtaactcacggcgatttccctgtctaaccatcttgttagagtgccatttaacactctggttgatagaatcccaccagtgaccatctttcttctcgttattcaggataccttcctgaatttccgcatcaacttcatcccaagacatagcccatgcttcattggatcgaacttggtagtatctccattgtttaccatcacgatctgtgtaaatatatggaatacgcacgttagtgctgtggaagttataagtggaacgatgtttgtcacgccagtaacgatttccagattgtttgcgataagtacggctcatattttctccattaagtctgtgaattaacttaatgtgggcgaacttcgaaatataacatcagtaatctccgttatcgttgtatactaccccagcactaggaagttcttctactgtcacaccttcaaactctatagaagatctatggtttctagctagttcgatcgcttcttcctcagtttccgcaacaacaatagctgtaccgcctaaccatagtccgcggtagttcactctaaaaattttcattttgaaaatcctgtgtatataagaaaaccccaactacttattcaatagccggggtttgttattagttaaccttcgccgaatccgataactaattcagttgattccatctttttaatctccgatattttcagtccaaccttactatttccgtaaagttttctaggactcatacacatgcaacaagaacaaagacaaggagtcttaatcattttacctaaagcaacgggagatttacttcccgcattccagtaatgtttccgattgttcttgacacgttgacggtggtgacgtcttaatgctctgtccactaagttctcctaaaacttcggagataaatggagtctgctcgactaccttgcgtagttgggagaaatcgtatccaaaccccattacatcgcctgagtaaatgtacgactaataacgtcgttctgttgttcacgcgtcagtgcattaaatcgaacagcatagccagagacacgaatggtcaactgaggatatttttcaggatgtttctgcgcatccaaaagctgatcacgacttagtacattgacatttaggtgctgaccaccttcgatttgaggaaccacttcaacatctacgatgcggaaggcttcaggatcaaagtgaggtgtgataccttctagatcttcaactagaactttctgcttaagttcaccatctttagagtatagctgaatgatctgattatcatgaacaaggttaattacgccggatttaaggttttgatatgctttcattagatctccctgatgttagaaattggctcagctttttgataacccagaagcaagataaaaactggaaggcaggcttgcttttctcttaatcactagctactgttggggtgctagcattccggtgagattgatggtctcgattaagaagaaaagcacaggagctttgattttaacgttgcgatcctcctggtctgttgcaactacgtgattgctcacgctaagacaatggctatctaaagtcctagcttctacatttatactcttggatagcatagagttgcggtctacttcccgccgtcacgcccggccatttatagaatgtggactctcttctcagcaagttctggcactgtggcctgatcttctgtttggtagttagtagtggaatcgaaccactctagtcgctccgtatgaaggaggtgcataaccgatctgccaactaactataaatagatccctgactttgggtgtttcggggttactcgtctgcaagctctactgttaacccttattcgaactaactgcttgcctaagagcgtactcgccagggaaattaaattggtactccgacttgggatcgaaccaagatttgacgattatcggtcgcctgttctaacctgttgaactatcagagcattttattacatcatctcgtccagataagaagtgtactgatacttagcttcaccagttttacctatctcaacttctgtacgaggtacttttcgtactagaccatgaatcatcttataagtgatagacttagatggttcgtgatctttaggaaagacttgcttaacggtacaaactttgaatccgtcacgcggtgtcagcacaacaacttgatcaccctctttgattttccaagactctggaaattcgtaggtataacgctgaccaccagtttggaacacaacagaaagataacgtttcatttggtttccctctcattaatttatataaatattataacaagaaataagagagaaggcaaatgaatttttaataaagtttagtcacttcatagacaatatttctagattctttgttacgctgctttaggttatcataagcgcgttccgcagaaactttatcatgaaagtctagaacatgggaagtattagccctgtttgaatgactataccaaataactactaagattttaaacataatagtccttaattggtgctgggcacaggattcgaacctgcaacgggattgctcctcctgattacaagtcaggtgcattcagcctttctgccaacccagcaataaacccgttatttcaacgggatttctttttcaaatacaggagacttatcagacattactgtcattgccaactgctgaagaaactcaaaggatagtgctaggcgttcatcaccaagctcaatctcaacacgtttcttttgtttatcaaccttcaatttaatattatcagccattatgtagtacagtactggaggtagctaatgttggactacatagaagctgtgatttccagtctaggttaaactgtttacggaactcttcgtaggactcttcaggaaagaagctataaccacgttcttcgtcgtttaatagcactgatccatcttctttctcataagctcgatagttattgcctatgattaaagtacgaagtcctttaacaccaccattacgtgtatccttattacgaaactcaaaaacgtgcataacgtttccttaattggtgcgggatacgagagtcgaactcgtgtctactgggtggaagccagttattctagccactgaactaatcacgcataaattggcaggagaaggaggaattgaacctaccactagtggagtcaaaggccactgtgcgaaccactacactattctccaattgtttggctgggatgcctgggatcgaactaggaaccttcggagtcagaggccgacgatctgccaattgatctacatcccaataattctttactctacaggaaccgttgcgattggctcaggttcttcaaggcgtttgccttcatggtcaacacggataacgccacagccttcgcagattactacagcaccgtagccttctttaacttcggcttctgtaattagaccagataagtcaccagtatctttgccccacatatcaatggaacactctttgcagaaatcagccattattaatccttaggacaagtcgtggaaatgatagtgcgttcagaaatccaaccaccagtataagcaccgttaactttatagtcaaccagagtaccatgaccacgtttagcagtgacaggtagagttttagtgcccccataaccatctttgacagttacagtacaatctagtgatgggccgatagtacagccagttaaagccagagcagcaatcaatactaagtatttcatgttgttatccttgttaagttaattggtgcatcctcagggaatcgaaccccgatcgtaaagttcgtagctttacattctttccattaaactaaggacgcagtatttggggtggctagtggaactcgaatccacataggcctgattcacaatcaggatcattaaccatttatgatatagccacaattgaaaaccatcgaggagtagcgaactctctacactagaagcttgcatgcccatacctagtgattagacctagcagataggcgctacaagtaacgaccctaaatggtagactcaaacagacaatgatcttcaattgtggcggctctccgaaactcatcacactaacaactagttgattacttctggattctcgcccagaaaattctctagaaaggtgcaccgttactctttgagccattgaaatgtgggttggtctctcaaccctagttgctacttgatccttacgatccgacggcaaccacgtgcagcgacccttcatagataatttatagtgctcagaaggtctttagaagcacttatcaaggaatagaaggacttgaacctccacgagatagaccatttatctcagcctcgttttcgggtatcttatgaggagtggatgttcctcttacgccctttgggaagccccgtctaccgattccggcatattccaagatttggaggaagataatggagtcgaaccatcaccatatcactacagcgggctagttttcaagactagttgcgtaccactacgccctaccttccagttgtttggcggaagaagagagattcgaactctcaagcctgctttcacaagtcagccactttccaagcggttttcgtcccctaatcgatttgctcttccgtaaaaatggtagggatggagggactcgaacccacacccgaagactagaacctaaatctagcgcgtctgccaatttcgccacatccccattttgtttggtggagtcactcagaattgaactgagttccactgcttgcaaggcagtaagtttaaccaaataacctatgaccccaaaatttggtggagaataacggaatcgaaccgttctgttgtcctcggtgcaagcgaggtgtccactccatgcagacccattccccaaattctttaagtttactaaggctattagctcggtgtgcgtactaccctcagacattagccagtagaggatagccgctcttcacaaacccgatacactattcagttgccgctgaatctagtggactaatctagaactcccctcaacccagacctcacgcggagcgtttgaagatgtgcttgttggcagccagtcctaggtcgagctaataccttagtgaactttgatgaggatttctcctcatcaatttatataaatattataacaagaaattaggcatcttgcaaatgcatttttgcaacttcttgtatatgcttaacgtctttgacgaagagcatgtcggaactgccagagtgcatgctctgcatgactactccatcatcaggagcaccttctttcagagcgattcctaaccagaacttggcaaaaccaggcgttacctcgccttgacttgccttgaagatgtcaccttcactgaggacttcaccagtgcccagctctgcgaaaggaacgtcgagatctactttttggtagaaatcagctaactcttcttctaagtcccagccgtgcattaacgcaaactgcattgttacatgaccgaaatagctctgaatcttgcttgataattgcatgtgcaattccttatattaagttgttggtactcggtgatagaatcgaactatcgcagccaccgtgtaaagatggagttctaccattaaactaaccgagcaaaagacttccgattaagaatgcttcgaataggaactcacaaagtcctgctaaaaacattccaatagtaaagtcagcagagaatacgttgtactgcttgactttctgtttcattaagtaaaaccagataagcatctaattttcctttaaagtggtagaccgcctgggacttgaacccagaaccttccgattaaaagtcggatgctgctaaaccaattgagctagcgatctatttaatatggatagacttccttaatagagtaaacttctaagtagcgatgattaataccaaattcggccattacttcattttcatctttaccataatgggctaaggtatacttcgaacgatctttgctagaacgtcgatcacttactactaatcgaaataatttcatttcgtatcctctatcaaattggaagcgggtgcaggaatcgaacctacctcttactagcttatgagactagtgatctctaccagagatctaacccgcaattgtttggtctccgtgggaggatttgaacccccgaccctatcgccccaaacgaaacgctctggccaaactgagctacacggagaatgttctttgttaactcactttataaaatatattatacagagaattaagctaaatagcaattacatttttaataaatttacttattgcgtaggccacctggaggttcaaccctcacggctgacaaagaagtttgcgagacttctcttaaaagccagaatagacccgccgatctatcggaacctactcaataagtaaacttttgtttacttatgtactatgtatttctcggtggcagttggcacagactaaaatacatttttgtagctcttctcgtaacttaatcctagatattcccgaagatctaaactgactgatgttatagtcttttgagttttcatccacatgatggaagtctagggcttgcttacacttattatagccacaaatagagcactctaaaacagggaaatattctgcaataatggaatctacagtctcacgtcttttagcgttttcactgatcttgcacgttggtttccatttctgtttaccagaaggatacgttccattagtatagaaatattctttagttaatgggtgctcgactccacaacttttacaaaatttatattccatgtttcctcaataagtcaatctaggtaggacttgaacctactatcacttgtgcggatttacgagaaccattctttcactcgaatcgaacgagcttctaccctcggcaagctggtgtcccctctccaccacgctagaatgtttaattggtacacccactaggaattgaacctagaaccctccgcttaagaggcggtagctctaaccaattgagctatggatgtattttaatccattgtacatctacagaagaacccccacttaccgcagtaagggcattgtcctcctgagtttctactaaaagataagaatttcattcttagtccttaaagtggcgcgaccgatgggattcgaacccacattctctcccgtgacaggggagtaccattaccaagccagccccgatcgcataatttgtttactcagctttgagtttagacagagcttcctcaacttcttttaaagcctcacgatggcggttaaggttgtgaagttcttccagaagatcagccttctgttgttctacccaccgttcacgaactttaatattgttcgtaagattatcacgatcagcttctagtcgagcaattgcatgagttgtcatatctatttcctcagttttaatgaaaatggtatctgtggctgaacttgatatcagcaatgatagctggttggctaccggtttacttaactctacacagaatatggcgggccgtgtaggattcgaacctacgttgtctttcgacatggattaacagtccaccgccaaaccgcttggctaacgacccataaatttggacgaccgcatgagattcgaactcacataaggaggttttgcaggcctccgcctaagccattcagccaacggtcgatttatctttactttccggccatgagaagtggattagttcagaaggcccgagggttctgcaataatatccatcaccatgatcgtaaccacatgttccacattcacacatcttaaattcaccaaacttagtaaataagatttcagtgtcacagcagtcgaacttaactaatttcggtttaggtgctttcatctagtcctccagttcaatttatgtaataattatacagaactttaaggatttaagcaactacatttttcagaaatttgatgcctttcttgcgcttcttataccaccacgttttagagttttgtcggttatgaacgcttgagatctttgcctcattaaaatgcttcaaaaccatgtagtcagtccctagttgctcaagcggaatgtgatctccactggaatcgtaaacataaggctgttgactagctctatagtgataaactttactaatccggcgtttaagcaaaggactagtgcagtatataaagaagttttcaggatgcatcagcatcttcctcaaattggtgcaccctgttcgtatcgaacgaacctctcaagctcttcaggcaagcgctaatccatctcagctaaaggtgcaaattttggcaaacctactaggactcgaacctagaccgtacggttttggagaccgacatgctgtccagtaacactctaggaatgcagaatttagtaattttctagtttggcttctagctctacgactagttcatcagcctgttctagttgagcttctactgtaccaagctctgtaacggctttgttagcaatcgcataaagttcaccaacatagctttcattccacgcgtaatcaggaatgctatcatgaagacggcggagtaattctcttaattgtacagagccttgcataagaatctcctaagtaattggcacacccaacgaggatcgaactcgtgttcccactgtgaaagagtggtgtcctaaccgctagacgataggtgcattaaatttggtgtgggaagatggagtcgaaccacccgagacccttccgagtcggcagatttacagtctgcttcgctacctctacgatactattcccacatatttggatgaaaagtaagtcggttaaactcaaggtggaatatttcaggctatcctgactttacccctcaaagcaactcgcttagttacttctcattcaaatatgttttccaaattagataactattatatcaagatttagggcactgagcaagtcaaattttaaagaacttgctcagtgctgtatcagttaatcgaagtcaggagtgactttcaaggtgaacggaagttcgaagacttcttcaccttcatcactaacggtaattacacgaccttctagtcgaaccatagtgatttcgatatccgctttagcatctggagccataccagcttcaatacatttagctttgatttcaggcagaagttctacattgtagaaataaagccattcaatctcaccttcccaaccatcccaggatttacatactgagctttcgataccagttgcgctaacacgttttgacattctgtttcctctcatcaacttatataactattatagcagaaatcttaagtaaaaagcaagtacatttttaaaatttctgcttggaggagttaaactccggcttcttctgccagatcaagtccagctaacgtgagtgctagggttgcagcagcatactctgtttcaccagtttctttagcctgagtgagaatagctttaaactgtgcctgaaaatctgcaacagcttcggtaagacctgcttcagctacaacacctttgatgatcaagcgctgtgtggttacttctggattagccatgttttttctccattttcatttttaatagtttgcaaatgaagtcaatatcttcatctgtgtgtaattctttatcctcaagagtagccttgaagttcttcgccagctccatcaaaagagtttctcttgatcttcgaactggtgaaggtggtctctgatacatatcagtttcctttatttggtaggggtggtgggattcgaacccacaaaacccgaattttaagtccggtacctatgccaattcgattacacccccatgtaatctttagagttcataaccctgaatatatcgagcaaagccagtaatttcaaactgaattgcccaggctacttccatatgctcaatcttgtcgaaccgagcatcagactgctctaggaaatagcgagaaataatagggaactcaatatcgaagtcctctttatccattccgtaatagaagttttcagaaatattacgaacttcacggaagaagtcctcaacctgaaaatccatcagagggtatgtatattcctctttgctatcatccgtctggaagaagcggaaatgtacgagacaagaaccaataaggttaactgccggagtagtataaatgtccatcttagcctcgctcaatatctagagaaataccacatttagggtcaataccagagccattacaatgcgtgcacacataagtgttaaaccaagtatctcctggttctgcatcattccattcacctgccccgaaacacttaggacaagcacattcttctagctcttgcttgagttcttggaacttagacatattgtctcctagttaattggtggctcctctcgggtatgatccgagaacctgtcccttatgaggggaatgctctaacctgattgagctaaggaaccatgaatttggaggaagataccagactcgaactggtacaccgtgtctccacagctactggttgtttagcaaacaactcccttacctttagggttaatcttccgaatttatgaatatattatacagaaaatttcggcaattagcaagtgaaattttctgtataatagccctcgcttagagggctataactactttacttgttaactcgtacaaagtatcccttataggcccccataatagagttacccaggaataccagccacattgctaggattgcataagatgcacccgtagactgggcagttacaagccaaatgtatacagtaccaatgttaatggcaatccaaatcaaccactgctcagcgtactgtttgaccataagccacatagcaactacactaccaaccgcagtgaaggcgtccagcattgggaatgggtcagctgtagtagccaggaaactaccgtaacctaacgtacctactgctaaaacccctagagtcagcagagcttgtgcctttgttagaaccttagtaggaacatccggcaagttgcttggtttatttttatgccacaagtacattccataaaactgcataggaacgtaatacaacaggtttagtgccgcgttaccataaagatcagcatttagagctgtaataccgtaggtaagaacacctaccaagccccaaacatagttagatactcgaccttttgcaaccaagataacacaaacaacgttagtgattgcagtggcccaatctagtgctgtaccattatagttagccaaactaatgaaggctactgcaataaacagccacagatattccagaggtttccagtttttaaagtcatttacaagatagttagtcatattagatagctcccgcgtcaacatgatgaattagccagtctacagcatttacagcttcgtccatgcgaactttgtagtctggtgagtcaatataaacagtgcgtccctctgggaattggttagggaactcctccttcatctgctcaaatagttccgaagtgatagaacgatcagagttaatacgtaaaccatcgtctacccacttcacagtaggtgctagaacaataactaaatcgtaatgctcttcttttgcaatagctgtaaccacaggattcttacgatgttcataaagtctatggtagaactcagtaatgaaagcattggtgtctacaaacatgatcttatttgcagtacgttctgcttcaaactctagctctttgtgcctgaatgcaatcttcgtatagtcgtcactggtcagcaggctttcattaccaactagatcaacttcacaatatgtacgaccatactcctcgacccacgaagtattatataacttcgcaagatactttgttaaagttgtcttgccagagctttcagtaccaataacaactaccttacgcacgtagtctttacgaactacactaggcagaaattcccaatacttcatcagattctcacgaatcatagtagcagagatcggtacacgagtacgttcagagtctaccacataatgctgcatgtgtggtaaatacttcttatactcttcttcatatcctagctcgctagagaagatggtgtagttacgatccatgatatcttctgtattatagaagccccactctcgcatactctggtcaattaactcacaataccctttccaaccgttcggatactcaggaacatcatcttcgactacgcttttaatgataacatggtcaatatctgcatatgtttgctcaagccaacgtactcgattcttcaactgcaatacttcttgatcgcgagggttttgtcgatctagccagcgattatcgtggcttacgataacaataacacgttcacacatagttgcagcaacgttaataaggttaatatgaccacgagttaatggtgcgaatttaccaattactagaccagtcttaatcatatttgcttcctctctcaaatttataaatatattatacagagaatttggcattcaagcaatcgaatttttaaactttttgtaggaaaatagcagggcacttaggggtagcaggtaagtgggtagaccccaaaattgttgccccaataaaaatccgggggcaatttttaaagaccccttgacattttctctggggtagtgtaaagtatatgttatggatgagtgatcaaagagacacacattttctatatactaggaggtgtcaaaaaatgacagaagaagcaactaagaaacctgagaccgtaagtgaagtcgcagaagaactgagacgtcatgaggaatcagataaacataagtgggagaaggtcaaagcctacgaaaagaaacatcgtgatcatgaagattatgatgaagatgatgatgaagatgacgaccatgagggctgtcataaacataggaaacataaaatgcaagaaccagtaaacgtattcactagcggcttcccaggtctgatgggcggttacccagcagtagcaaatggtgctttcggtggtgaaggtatgggtctattcggagctatcctgatcggtgctctattaacaggcggattcggtggtttcggtggtttcggacgtggtgctggtgttgccgctgagggaactgctgtggatgctatcctttccaaccaggatactgcaagtattctagctgcaatcaacactgctcgtactgaagcaaatcagggtactggtgctgttctaagcgctgttaatggtgtaggtgccgctcaagcttctagtactcaacagattctgactactgtgtatggtactggtgctaacctgtccaaccagatctgtcaggaaactcgtaacgttattcagggtcagttcgatctttctcgccagatggatcaagctttcgctgctaaccagatcgctcgtgcacaggacaagtttgattctgctcagatcgctttccagcagtctattcagaccaacaaccagttcgccgctgttcaggctcagatgtgtgctaaccagaacgctctggaacgtcagattgctgagtgctgctgtgaacttcagactgcgatcgctggtgtaactactgcgcgtatccaggacgaactgaacgaatgccgtctgcgtgaagcaatcgctgcaggtagcggtgcaaacggtcaggtaatcaaccaaatcgctgtaagcctgggtgcaattactcagactctagcagctctacaggctaaagtaccagcctaatttttaaggggaggagcccattatgagtaaatatggttttgtgaacaacggatttaatcaaccaatgggctcccagcagcccattccgggtctggataacccttacctacaacagttgcaacagcgtttagcagaagcgcaacagatgcagcaacaactccagcaaaaccctggaagtgtaagccctatgcaaatgatgcagcaaatgagcgggcagtcgcaaatgcctcaacaaatgcagcaacagatgccccagcagcaagttcagcaacaaacccaacaaccgcaggtttctgcggaaggacaggcagtactagccctttttgaagacttcgcaaagacagaggatgggaaacagcttgtatcgcttatgggtaagtttaatagcttctgccaaagccaagttgcaaaagctcaaaatggtggtaataactcctaaggaggacttatgtgttgcagaaaacctgtttcgtgctgcccaatgcctgtagcacgttgttgctctccaacaatgtttacacaaataccggtgttcaatccgtttgcctttaagcctactcttatcctgccccctagagtagattttcagtcaagattggtctcccgtatgggtggttgttgtaccccgagagtatggttctaaaccaaaaacaaagcccctgccgaaaggtaaggggcttttcttttgccttaaatacagaaaagcccgcgctctcggaggaaacgcgggcttacttcagatgttacgtgtggctattacttgttacgcatatccataatcatctggccatcataaccagtaccaactacagtctgcggtacaccaccctggtatttctcagcacgaagcatttcaacttccagctgtttccaacgaatcatttcaggagtaatggtacgttgcagtgcggcgttagcttcagcttctttcttagctgcgtacagtttagcatctgcatcacgttcgtttgcaatagcttggttgttacgagcttcacgatcagcttctgcttgtttaactttctgctgtgcttcttgttcaacacgagccaattcagctttagcagcgttaacttgttcttcacgaacttttgtgttctgaacctgttccatgattactggtggaagtgtaatatcctgaaggaatacttgcttcacggtgtaaccataaggacgagcatactcttcaacttcctgctgaattgcagtttgcagctgagcctggatcttagcgtcaaacaggtcttgtgctttcggtacagatttaccaaattcacggatagtagaaagcatcttctcttctacatacttgttcagagcctgttcctgagtcccagcgttaacacggttaatcggagctttagaaccatcgaactgcaacataacggtaatgtcaacagtagacttaaacttgtcctggctaggaacctgaagtttatccagtttcatagcaatatctttcgtactgaacgtatcaaaagaagcaaacgggttgacaatgtggaagcctggcagtacaggagttggattaactttacccaggaatgtctgagtctttacagtaccgtcctgaacaaccgtataggaattgagagccaggataagagcaccaagaccaactacagcgccaacaccccaacgtttgatagtacgaattactttttgctcagaagtcagatctttagtgtttttagtaaacatatatttcctttgtttagttacagttaataaaattggccgaggtgacaggattcgaacctgcataaaggaatttagaagactcctgcctatcccttagactacaccccgaaaatgaattacttaataatatcattcaacttagtttgactttctaccgcttctctagctgatttctcagcttttctagctgcacgttgtgctctagatactacaagtagttcatcatacttttggttcagaaactcttgaacttcactgtagaagcggttctggctcacatattgagtagcgtcagcatcataacagcgcatgtagaagtaatcactaggttgaccgcgtaatgtgcgttctaggatttgtggacgatagcggcgaagattatctttggccatctttacttcatcagtatcttcaccaagttgagtaagatgataaagacgagtattatcaatataatctaaagcaatgctaaagtattcaccttcccgaagattatatcccgtaagctcactcattttctcacgagcttgatcaagtgtcaaatgctcaggaaaatgcgctatgtgaagaatacgagggcaacacatttcttgatgatcaaagatacaagttgttcccagattcatagttattccttttgttaggtatttttaagaactctcgtaaaagctcttaaagatacccggcggtaggtagggtcaagccccctcagattaagctcttcagccctgccgtcagacaatatcttccagtttaagtcaaggtgacttcgtggttatgtcctccatatgtggaggactcggttaggcttaggtcatgactccctgccttctgctgctactcaacaggacttatcgcgtttacctgttctattgtgcaccattagtcacatgtctcatgtgagcatttcccaccctcatagttacgcggtctggtaaaatcgcacctccgattttcgatgcgaagttccgagtttggttgaggccgtcaggtttcctcgtggttttggcagtgcgcaacatgcctgcgaatgcttatccggtataagcccgagttatccaattcttaccgaccgtaggattcgaacctacatcttccaccagttacggcttgatattaccttttatactaggacggcagtgttattacataagtcagttcgacaccccactgtattcgatggtcactcacctcattgtggtatacacatgtctcgatttgcaacctagacgggtcagcgttaggagttgcatgggtttctcaagcccaactcctagtcttctacccctgggtcacgcaccatgtttcacactgtgactggctcgtgctgagatccatcgttgggataaattaggagaagagtttacgagatttcgggacagctcccgagttttgcagagtctttcagtagcggcatcgatagctggaagcggtacagagtcttactctgtggtgcctggaacctctctagccgcccttacttggctctaactcaccgactctattcagtgtcaataactatcactaggtgaatcgttaaagctcactcagcgttatcggctcgctgttctctctaatttatgtaactattatatcaacttttgaagcacttagcaaatcaatttttaattaaattcgccagcgatcagagcagcggtcttaccatcataacgaccagggaactcttccttaatcgctttcatcagtagacctttgttgatgcctgggtttaacttaaccagttctgcaaagtaattgcgaatctgagtttcagttaactgctgcaaagcgtattcgtattctagagctgctaggagatccagatattcagcatcaggagtatattcgacatttgctttttcagcagaagcctgcgtactctcaattgctttgaattgggacttcagccaattagtaaattccagcttagttacgcaatccttatcaatacgttgcaagtcacctagaatcgtacttaggtgcttaaccgacacagtatcaccacgtttgcgagcagcttcaatcaactctcgcagtacacgaatcatgttcgtacccattatttcattcctaatgcttggttaaaagattgttccgtcataactgcggagactttagcgaaatcgaacttcttagggttcgtagtgatttcagaaacgttagtagttttaaccgttttcgtggtacgaatgccgcgagtgttaacaccaataattacaactgatttcatatttcgcttcctctcattaatttatggaagtattatacaggattttaaagtattaagcaatcgaatttttaagtttctttgtggacaggtttgtaaaacgtatgtcccttgatcttcgttgttcgcttaaatgctttagtccaataaggtttttctttaccactatggaagtataacgctccatatgtaggatcatgtggtaaatcaacgtagtatatcactctagctaaattcttagcaacttgccaagcctcatcggttttatcaacttttggtctcttagatacccaagagaactggttagactgatatactactttacagtaggaatcagggaatttaccggagttcacacggtttttagtaacctgtgcgactgcgatcattcccttcgtaccctcacctcgtgcttcgaagtagatattttttgcaatgcaatcaatctgctttgagtcgtaggtagcatgactattgaagctaaaggcgagggcagcagttagtagcaaagctgccttcatcttttatttactccacccaatcgtattcaatacggtttgggttctcttgatacccgatgtctaggagatcattacgcatgttctctttgcctacggggtttgaggttactaataccactttcttgggtctctgtccaaattctaaaagtaaacgaagaatttgataaccttccataccctctacagccaaatcgttatccatataaacgaaatgacccgtggtatcggttttattcagaaactcaacagcggcttcgggggttcgaatgataatatccattccattcaggttacgaacatcatcaatcagaatatggaaaatcataatagcctcgtctcatcaatttaaaaatatattatacagaagttaaagcgttttcgcaaatacatttttagattgagagactagcaaaccaataaacagcctagaggcgccacaggccatatcttatgagccatgtacctttgatctagggtttgaatcatcaacgaatactttgcatcttttagctttagaaggttagaagtttgagtgcttttaacttttcagctttcatacttgagcgttgatctttgaagttgtgttggtactaccaacgaccgtttttacagttcagcttaagaggctggtgtaataaacataatctccaatagattatactttatagtatggtcagcggtcttatttaacctcgtatttcaaccgctgctgcgaggtaagatgcttgggctttcgtctaccgatttgctagccttttaattcattactctacttcgatgaaagtagaggcgttagactcagacagaacaaagtcaacgttagttgcgaagtcctggtattcttcgtcatgctgcttgatcaacgcttccagacccagaggatcgatcaggaacggagtgctcttcagttccagcaggttgagctgcattttaacttcatcttcggaagtcttcttgtctcgtgtagccatagtgtcttgcagacgttcgtgcttagcatcgaactgggctttctgagagttgaacttaaccgtcgcagcatggaactgcttgcgcatgttagccaacagttgtgccttgagttccatagaacgcttggcttcgatagcttccgctacggtcattttgcgagaaccgatttcaacaaccgtttctgcgttgctctggatcagggcagctttgatgcgatcacgctgagacatcatgtccagcagagactggaaatcagactcaatgcgggtagacagagcatctacttcgattgcagcaccaacaacaacctggttcttttccttaccttcaccaactgcaatcagaagctgattttcagtggctttacggattttagcttccagagacttgatagttgccagagcacgagttttagacatacgagtagtcattgtttcttccttatatgaagtttgagatttgaatttgttttaaaacggtctattacagaccaattgccagcagggtacgcagaacagtgtcacgactattgtcgatatttgggttagcacggttcagtacgttaaagatcttctggacgccagactgacgttcagccatacgacggagacccaggttacgagttgcttttttaccatttttacgagtgtttttagatactggcatagtgttttccttttgtttgttttctcaaatttatgaatatattatacagaattttggagctgaaagcaaatcaaattttgattttttcgatcatgcgtgcaacgcagtaactttcaactaatgcatcgaatgctgggtcatgcttaaccggatagattccataacgaatggtatccatcttttccattttagctttagcccaactagcaccttcggcttccagttctttgtaattataacctgcttgcatccacagattacggaaagaacgaacgttacccagattccagaatttccacggaacgactgcttcgttagttccggcatggaatgtattagcagagtagatagtcatatcaaactctgggccattgccgtaatacagcgcattttcatctaggaacaattccatcatgttcttagccatgaaataggcattatagttagagcctagctcgttagtgcagtgatgtttaccatcacgaaatgcaatgagttttgcaccgttgctttgcagagcttccataatgtggagggcagaagggctatttttagcctgatccatccagaaggcaaaagtagatgcagtaactttagcacctgcgttgagttgatcttgaacatcgagcgttacaaagatcaggtcaggatctttatcaattccgtgcatggctacgaaagcgaaagacggcattgcaatatgggttgttccacagttatctggagtccctagggattcaatgtccagcataccaaatggttttactttcataacttatcctttattgtgtagaaaactaacaaagagtggtctctttgttagactcccacttcttggggtctttgtatccaggaagcatgtcttccccaacatcccagttttcttccatataagcatcatcgagtccccaatcttcttccatagctaaatccatagcttcttgagaagaaaggcgagtataatctctagcagacttatgagtgctagcacggttaaaatcatttttagcaacgaagttacgcatagtttctccaaatgagaggggctttcgccccctgatttaaattacttgcccagcagtttaaggatgttttccttaatagtttgagcagatttttcgctcttattggtttcagccagtttcagagcaagttcttcctgctgtttctgaatttcagcagcagttttctgatcagcttcaatacgtgcctgaagttcatcagtgatcgtggtaaaggaagcaacgatttcagtaacggaacgtggtttcttagagaacataaaatatccttagttagaaagagagttagtatatggggctttcgccccatcaatcattacttcgctttacgcttacgagccggtttagcggatttacgatcagaagcaccagtaaacttaataccgataccgtagcacagagcgcgaacgttgtcacggctgtactctacaccgaagatattcggcttaacggaaccgaactgtccacgggattcacgcattacgtcagccattggcttacgcttctggttaactgccttttcgtactccttcggagacatatctttgcgagaaaagagttcagcaccaccgttgaagctcagggttactggtacagacttgtgaccttcacccggaatgtacacaacatgcttagcagttgcgcgggtggagttcttagccttcggcttgtgacgaactggcagcggagccgtcagagcagactgagcctgcgcatcagttggatgcttacgcagatgacgttccagacgagctttacgattagcttcggtctgagggaaggtcttaactgctggagctgcctgagtttttgcgtttttctgcttagccattatttgttttcctttttgttgatcaatttatgaagtatattatacgagattttgaagcgtttagcaaatgaattttttaaaaattatctgccgaccatcttagcttgttcttcatcagagacgtattgatatgcacctttgttatatgccggagcagtgcacatctttttacgctcaatttcttcttgtgccttacgttcacgttctgccagttcctcgtctagataaactagacgttgttcaggaggtggtggaagacgtgtttctggttctccgatattagcctttctgatctgacgcggagattgtgcacgttttctcaatggtttgaaacctaatgaatttgagttataaattcgcataaagccctcctcactttcaatatgaatattatactaaagtttcgggctttaagcaactgaatttttaaattattagccaaacttctcttcaaattcttgttcggcaataactgtattgcagagagcatctactgcttcattaccactaataccagagtgacctttaaccttaacgaaggtggggttagtatcgtgatatttaatgtacaactgagtaagctcgaaggcttctttccagagatctaggttgagaggagcctctccatcacccttcttccagcctttcttctgccaagaccacatccagctttccatgccattcttacaataagcagaatcagtatagataatcactggacggctatctttcttagtagaccaacgaagaacttcaacaatagcagtaagttccatctcgttatttgtggttttcttactaaatccagatttagaacctaaacgatcatcattgtcattgaaaacaatgaaaccccaagcacctaaaccaggattgcccttacatgcaccgtctgtatatacgtggaaaaccgacattatttttcgccctctacaatgaccctagtcgccggaggaattggcggcataggtggaatacgtggatgacctctctgtgcatcatttggtgctctaggcggttcaggtctaattgcctttagttccttatctaggaactgctctatcgcccgttctacaaaatgatcaaaaggtaaatggtaatattgagacaaagctaagaatctacgttcctggctttgtgttaaataaactttctttttaaagagtcccataggtatctccgatttataaaatatattatatttgaatttcactcaataagcaaatgaaatttaaatataatagccccgaagggctatttgagttagactgtaaacggataagcaatagctggatggtgttgatagtctacaacatcgaaatcatctttatttacccatgtcagcacatcatccagagttttaatatctggattaataatcaggtgaggtggttcaaaaggttcacgatcaaactgtttgtgttccattagaacttcatactgattctcgtaaatgtgaagattcacgatcttttggcgagcgatcccaggtttatatcccgtaatttgagccatgattgcaagcagagcgtagcactgaaccatgttaaatacctggcctaataggaagtcattagacctctggaaagagttcaggtatagagtatctcccaaaatagagaattggtgggtgtgcatacatggacgcaagcagccctttgagaactcccccggattccagaaagttagaatctcaccacgatcgtcaatacctttcttgaggttgcggtagattttggctaactgatcaatcattaggccatcagagtttgtccattggcgtccttgaaccccatagactcgtcccatatcatcttcgcctttacggtatggattatccaaccatgcaaggttttcattggcattcgcattccacgtgttgaccccaatagcacggaattgtgctgcggagtcatagccacgtaggtagccaatcatttccataattgcttgttttgcaaatgccttacgagttgtaacaagagggaattcattagcccccacattaaaagtgaagtctgcgtcgatgatagttagacagcgaacccctgtacgagggttagttacccactggccttcagttaaaatacgttttcctacttcgatatactgtttcattagtaagtaatcaactcctgtacgaatcgcaggctgttatctgcattatttcccgtagcgtatactaggcgggtggattcatagttgtaatctagaatcataccatccagatgaatgtcagcttctagcttctggtcgcagaagatagtagatacgaatgcactttcaatatgcccgtattgatacatttcttttaggagtgtagcaccacccaatacaactgtctgctgatccctcaagaaagatggtagattatccccaattctagaaattggtgtatagatttctttgatgctatctgccagaggtcgatcagcacgaataaacagatcagcttctccaactatacgagaacgtacagcttgcggaagcgccagatatgtgcccgcacccataataatgttgtctgggtctaggatatccagttgagtgtaaaaagcgtccagttcttctttgaaagaaccccaagggagtttaccgtggaggccgaactccccattcggcccagttgcatagagagcagtaatcattagaacatgtcctcgaattcgttgcccagatctttcagagtatcggtagaggtttcagttacctggcctacacgataagctgcaccaatttggatttcctgtggagctggttgcagagacgtggtgtccagccagttcataatccacggaatcgggttcttagtaattaccggaagattgctcggccattctacgccgatgtgcataaatgcgttacgtcctacgaagtagaggtactcttctagaagttctgcgttcagaccaatcagactacggcctttaaagataaaatgaccccagttgatctcagtttgcagagttttcagaagctgtgctggtgctttagccagagcttcatcaatcagatcttggtcgaactgctggaacatgatctggataactgctttggacatttgagtgtgcagagcttcatctttagcaatcaattgcaggtttttagcaataccttgcagaatgtcattttctgctagagcaaaggtacatgcaaaagatgcatagaactgcattgcttccagaccatagattgcaaagtaagcatctaacagtttagcctgagtttcacgcttaacttccgggaactcagtttctggataagtattatcaccacgatgatcacgtactgcgatgaaatactgacctaactgatacagttcatcgaatagttctacagaatcagcgatacgtgcgaatgcttcttggtttttggtaacagaatcaataaattctgctgggtcagtcagaacgttacggataatgttactataagcacggctatgcagatcttcaaagtagctccactgcttcatcatgccttccaattctggacggcttacgagtggcataattgctgcttctggtgcacgactaataaatgagtcggtctgagtctgccatgctaagttcaggagggtgatttcctgaatatctttaggaagattaggccattgctttttgtcagcttctagactgatttcagtttcagtccagaactgagaacgttgcagaagtgctaaacgctcaagttcaggatgtgctacacgaacgtagtcagcgataccaagagaatcgcccaggaaaagctcagggttagtatgatcccaattcaggtttagtaaagtagtcattgattttcctctttctcactatttcaggaatattatagcaaatcaggtagcgattagcaagtaaaatttcaaagaaaaaggagacccgaagatctccttagttttattaaagattgcaaccgcctgatgcacaaccagctgatgcttcttcacctgctccaccaccgtttgcagtgttgaagttggcgtagtaccaagtcttccagccatatttaacagcagtcatgaaatcacgaactactactgggcctggaataacttcaccctcaaacttggtgtagtcatagtacatattcgtactaatagactggctgaagaatttctgcatagttgctacccatttgatccactcaatgcgatctacatcataagccagtttgtagctcatgagagtatcccaatcagttgcacctggagcaattgcaattactttgttcactgcactacccttgatagatacaatcttacgaggtggttcaattgagttagtaacacccaacaggacagaagagctttcgccaggcatctgagctgtcagaacagagttacgcataccgtattcagcaatatctgcacgcagagattcccaatccatttctagacctacggataccagttcatcaacagttttcttatacgtgtcgattaccagagttccttgagaaggtttggtacggttaaaccaatcgcatgcaccttgttctttagccagacgtacagaggctttatgcaggaagtaagagagcttttcagcttcacggtgaatccagttacgagcttcaacaccttcgtaagccagaccttctgctgccattgcacctgctgcgttcatcagaccaatacctacgttacgacgcttcttagcggtgtattccatagtcgggaatggataatcctgaatttcaatgatggtatcaacgaatttcagaagaatgtagcaagttttctcccattcagccagagaatggatacgtcctagaacaataccacccaggttacacagagatacttcaccaatgtcttctggacgcatatcatccagttgatctggagttttgtacagttccgtaatgtgatggaatggacgagttggctgagtaatttctacacacaggttggtcatacgaatcgggtcaaggaagttaccgtgacggttagattcaccaatgtggtgagcatacatacgccctgtttccatacggatacggatccaagtatctaggatttcttttgcagagatttttggcgctgctgggattgttcttccttcgtggtcgatctttgtaagagatgccacacgtttctccgctgccacatagatttcttcaaacttcgcctcatcttcaccataaaacgcttcgtgaacttctggtgcgtagaagtaagacatgagcgtaatatcttcgtttttcagataacgtttcaacagaaggttgttaaagctcagagagtagtccatcttatcgattttgttctcgtctgtagcacgttgctgtttaacctgcatcaactgaatgatttcaggatcgaagtatggataagatacagtagcagaaccaccacgggtttgctgagtgttcgcttttactgatcggtcaatgtgtcgataatacggcagttttccggagtgtgggaatgccccatttcgcaccggatcagcaattgatcggctttcaagatgatacccaattcctgctcgggctgcgaccattttgaagacgatgtgctctgctgtgtcgattgaatccagcgtgtcagtggaatccacgaggcagcaactagcaaatccacggtcactagagcgcaaaccaaccagtggcggcgtaggaacgttgattttgtggagcgacattgcgttgtagaggtcgattgcatccagaattgtccagttaggttgagataacatcgccattgccatacccatgtaggcaaattgcggggtttcgtaaatttcgccagttgcgatattacgacgggaatacttatcgaagaactgtttcagaccaccgctggtgaagagacgatcacgttcatgatcaattactccgttcagagcgtcaaactgttcatcggaaatccatgcactcatgtcttcccaagcgccaactttaaccatgtggtcgtggaagaaacgtagtgacggcggttcgaaggagtcatacaggcgtttacgcatctgtgcaagacgtaattcctttgctacctcgtcatatgcaggattatctttaatcagtccttctgctgctttgatcaatacatcttgaagtgtatcggaatctacaacccctttaggcagatttttcaatgcagccataactacggcagaccaactaacgtcagcattcttacatgcccatgcagcccaatcgttgagtttttcaggagcaaagtcttgaatagtaccgtcgcgtttaattacttttgtgattctaaagtccattgtagtttccttcttatagttctcaggatttagatagtattctactttgttttcagtcattatgcaaatacaattttacagaaagtaaaggcctggatattttcatacccaggccttctgtcttaccatttaattttgttagcctgatcaattaactgctttcgtatttctgtctgaaaaagaatatcaacagaagtgctaagctcgttataattgaacggacgatttggattagaggctacaattttccatgctagagaagtcttaggactttcttcaccctctttacgggtaatcatgtttgcagcactcagcgaagtgcggtgaattttagtcttgcgatgtagatgtacgacatttcccatattataccagccccatctctttaaagatgtcatagaatgctttagattctcgggaacgtacgttctcaataagttcaatcattgagaatggagagtaatcatacttctgatacacttccattagaagtgctaagcctgaatcacccttaatgtctttctgagcaatatctccgcaaatgactaagcgacaatcttgtcctacacgggttaggagacagatcattgcttcgaccgagatattctgagcttcatcgacaatcacataggagttgttgaaagttcgtccacgagcatgttcgatagccaggaatttaactttctgacgttctacataccctttatatgcttgatcaccaatagcccacttcatgccatctgcaatcggttccagccacggctctagcttttcagctaggtcaccaggtagcatcccaagagatttgcctagaggttcgttaggacgtactaagatcacttgctcaatagcagagcgaggattagtaagttcctgagcagcaagaacggaagggataaaagtcttacccgtacctggttcaccaataccgacggtaatagtgttgttcttgatcatattgatatatgatttttgctctttgtttttaccttctagggatttagcaacgggaatagcaaaatcagagaagtttccctgaatgatgttatcttcgtagttgctattacgctttcttgacccattacgggtttctcttttctgacgcagttttcccataaataacactcctatagtgtacttcgctaacagaggatcaacaaaaagatcttgtttatcaacttacaaatatattataccaatatctacaggaaaaagcaactacaattttaaataagcctatgacattgcagttaaataaaaattttacttgcttagagagggagatgtatgatactagataatcattttatatcgcgtacacgagcgcgtgattatactatttttatgggaggttggcaaataaaattttttgactcagatcaatttacagaatgttatagtaaaatattgttgacatccgcctttaaatgagctataatagtagtcttagttagagaaggagaatataatgaatcacaatgatcagatgaagattaaaagaatgcagtcactaattacaaactgcaaggaaattatcgaaggttcagcagacgaagagttgctgtttaataacgctaataaaccatcagaacgtttccctactcaaagggatatgttagcaggtgagttgagtaagtatctgattctagaagaaatgccgattcagattcgaaatgctcatatgattggtgatatccacttccatgatgctgactatgcagctttaggtatgactaactgttgcctcgtagctctggaagatatgttgaagaatggtatgaaggttggtaatgctgaaatcagtacaccgaactctatcactactgcggctgctattacagctcaaattattactcaggttagttcccatcagtacggtggtacttctgtagatcgtcttgacgaagtattagccccttatgttcgtaagtcttatgataagaaccatgcgtttgctaagcgttggactaaggatgaagccaaagcgtctgtaatggctacggaaatgactgagaaagaagtttatgatgcctgtcagggtctagagtatgaaatcaatacgatgttcaactctaacggtcagagtccatttatcacatttggctttggtctgggaacttcttgggaagctcgtcttgtacagaaagcaatccttgaagtacgtatggatggtctgggtatcaataaacgtactgcgatcttccctaaactggtatttgtacttcgtgacggtgttaacatgaaacctggtgatgttaactacgatatcaagaagttagccatgaagtgtactgccgaacgtatgtatcctgactatatcagctatgacaaggtagttgaagttactggtgattataaagtttctatgggttgccgttcattcctggctgctgcggaagatggagaaacatcaggtcgtaacaacttaggtgttgtttctgtaaaccttcctcgaatcgctatcgaggctgatggagatattgatctattcttcgatttgcttgagctgcgtgttgataccgcacttaaagcattggagtggagggttgatcgcttaaaatacattcaagctaaagctgcgcccatcctctatatgtcaggagcctttggattacgtctggggccagatgaatatgtgtttgatcatttctataagcgtgcttctgtatccctaggatatattggctgccatgaaatgttacagttcatgtttggtaaagatgtagatacaatgtctgacacctgcattaagtttgtgcaacgtgttttacagtatatgcgtgatcgtgcagatcagaagaaggaagagactcagttagggtacagtttgtatgcaacaccttctgaatctttatgtgatcgcttctgtcgtctagaccgtgagtatttcccggagcatgaagatattcttggcaagggctattacactaactcccatcaccttgatgtggaacgtaaggttgctccgaatgtgaagtttgattatgagtctaactttaccccaattgcttctggtgggtgcatttcctatgtggaattgcccgatatgaagaagttccctgatgcactagaatgggttattaactatgctgcaagtaaggttcattacttcggtattaatactccagtagattcctgtggtgaatgtggattcttaggcgagactatcgcttctgaggatggattcaaatgccctatctgcgggaaccatgatcctgaaactttggaggttactcgtcgagtttgtgggtatcttggaaacccaggagcacgtccatttaacccaggtaaacaacatgaggttatgggtcgagtgaaacatagagacgttcgcgctaaataagtgaatcagccaggttgctagtcgacctggcttttattttatttgctttcagctaaaaatttgtgtataattgatttataaatttgagaggagaaaatatgaaaaacgtaaaacatcttaaatatcgcttaatttacaatggccgcatggaaacggaagacctcgctcaactggcgattaactcagatgaagttacggttcgtgctttatctatcgagaagctgcgtgcatcttatgaaactcgtattatggaactagaggagaaactgtatggcattctcgaatcagaagctaccaagtgatcaacttcaagacgctctcagtaacgtgttgatggaaaggtggaatgaagggtacaaagatggtgttacttcttgtgctataatgctagaccatatagccgaatccttgagggatcgtggccaaccagatattgcaaatatactgcaaggtcttagtgaaaacttccgagagcaggtgaaaaatgcgtagactaattgttgttagtggtgcaggtttaagtgtagatagcggtgttcgtgcattccgtacagatactgctagtgggaaatccttgtgggatgagtacgatctagaggaagtgtgcagtctgcctaactttgaggctggcttccgtcgcttctgcggtgaagatgatccgcattatttcagtgctcgattccctgggattgatgaagatggcaacgatctgtacctcaagacacatgagttctacaacatgcgtcgtcaggagttgcagactgttgatcctaacattgcacatcttcggattgcagaatggttccaacgttatggagctgattctgtcaagaacttcacaactaacgttgatgatcttctggagcgtgccggtattcctcgtgaggaaattatccatgcacacggatacctgaaagaggttatctaccgtcgaggtcgtgatcagattatcgaagatgttgggtataccgctattgatcctgaagagtacgagtgggtcaaaccaaatgttactttcttcggtgagacagctccgtggtacatgggtcagatcaacttgtttgatactctgacttccaatgatatggttattgtggtgggttgcagtaaccaagttatcaacttcaactgggaactattccctgccgtaagtcgtggtactaagatgcacgttgttaacccagcggttcgttatgatgaacaactggaatatgagaaacgtggtgttactgtatggcgtgctggagctgctgaagtttttggtaacaaacacttcattggtcaaatagaagcctttatggaaggaactatttatgtcccataagagcatgtgtgatctttttgtatggccggacggtagttggtgctaccgttttgaatatgctaccgacgatttttcgtggaagagtgatgatttctgtgtcatctatgaagatacagcagaatggaaagagttcctgattaaggagggagaatatgattaagaagatttttaagggtatttttgcagttgtgcgtggtttcgtctatctgatgggcttgatcgccacgtatgtgttgctgatctctgttctttggggtaaaggtgaactgaagtggcatgttccttttacggaagatcaaaaagtctggacatgggataatactggtggatctaagtaatactccaattatttttctggatattgatggggtgctcaattcgagcatctctcaccatcatgctccagctgatgaaaaggttttctttggtggagattgggttttcaaacctttactccaggctttccagaacttcttaaaaccgtccggtataatgattgttggggtgtcttcatggtttacagtacgtaacgaaatggagaatgttgagatcatgaccagattaggtctggttgatcgttttcttggtactactgattttactggtggcggattatctagaggcaattctgttcttagatttgtggaaaagtacaaactcaagcactggtgtgtactagatgatgctggagctatgatgtatcagtatccaacagtcattgttaatggcagaacagggatcaatatgcaagatctcaatgccgttagctatatgctagagtttagtcctgatctagcaatgtgtaaagccctccaaaatttaaaggtataaatatgtttaataacctctttgaaaatacagtcaatccaatcctcgttaatttctggcgttctctgcctaatgatttgtacgccgaggctttgaatagtctcaagatttggtgtgagaataacgatatcgagtttgcctttactaaagattcagatgaagctagctgcatcggtgtaagtgtaatgctggaggacggggtagaagagattgtaaactggaaagaactggatcacatgggtcttgtttttgcattgaactacaaactgtttatgcctgtagatcaccgtctggtggtaaactaccgtaatggggaggctccggttttccaggtaaatgaacgtgagggctggaagtattcgcccgaggaagtaaatgagggcatccagaagctgcgtcagttcggctatcagatcccaggtttaactgcttaaaggaggcagaatggaacaagtattttggcgtcttattgaccctagtttggtagagcgagctgaagggctacttgcacgttggttgggggttgaaaaagttagtgtaactttcccgtttactgatccgactgaccctagtttaggtgtgtttgtggatgagcacgaggctgatggatgggaagcggactggaatgagctgtctggtatgggtcttattgttgcccttaacttctctatcttccatccgcgtggtttggccattgcacgtgaccccgaaacaggtgagtccccttatctgttagttgctgatgatggaatttgggagtacactccagatattctcgaagaagcgaaacatcaattaaaccgtattgggatctatgtcccaggcctaaatgatgattgattttcattagcacaaccctgattaccgggtctctttgactcggttttcaccgtgctcaaggccactgatagcaccgtcggaaaaattttacttgcaggatgcttcaaaagttgatataatatttatattgaattgagagacattagtaaaaattgattttgctaatttttcttgtttacaatccgcaatacggaacagttcggctgccccattaaagattgttttaactattactaatgtttatacgatattagttggttgtcaattaagtgatctgtgtaccctgaattcggaaaggtaaatccaaaccgtgcatattagcttcgttagatagggagaggcttttatgggggtgcgaacgaaaagagctgcgaatggtaacacgtccagtagtcacctaccaataggatagtgaggacaagtagaaatggcttagcggccgatttacctaatttctactctggatatgcgtatagagagcacagcactgaggtatggtaacttatccatactgcttgatgatgattaatatttgtgttgacgttagtaatagttgttctattctttttgaatagtcctaaagaaaagtatcgaataaccaacataggagtattgttgtgttctcaatcctacaaggtcatgcaggattttccagagataaagccacaggcatctggaaagagattaaagtggaagattatacctttgctaagcgattctctaaagagcatccagaaggtaaaccagcttccatgcccttcaaatttgatgtacttgaagaacttgatccgcaaagccttgctgaaatgctgcctattatgcgtaggctgacccaagatcctcatattgtagctattcgtggtaaatgtttggctccaaaggataacgttcgtcgtaccagagggaactttaacgtttccaatcctagtcatattattgcaatggatgtggatggtattgtggacactggtggttatgacaagtttaatcttgttggcatggcacgtcatatcattaagatgttaaatagtattagtgaggatatgtttcctcttgatgcagggtttatcgctcatgcatcgagttcggctggactaaaaccaggtatccgtatgcacttaatactagaatctaatgtgaaggtgactcaaggacaattaaagttcttatttacgtctatcaacgatagtagtaagcaaaagtatggctttgatattgctgacttagcttattattcttctgtacagcttcactattttgccgatcctttatttacagatggtatagttgatccgtttaaagcggagaataagccacgtcttgtatatgttaagggttcgaaagtaaatttaccaaataacctagttgactatgaaacaactagaggtgagttcaaagaagagttctattctttgctcgatcaaattaaaggtaagaaagctgcctctgaaaaagtggaagaaaccatcagcgaattagaagaagctgaggacggggtgtacctgcgtattattccaaagttatatcaccgagcgttagaagatggtgttgatttcgcatggttagaacgtgaaattaaacctgctttgtctgagtatattgcaactaaagataatagtcgtaatatccaggattactttaataacggtcgtaaacaggcgttaaaagcgtttgttaataacagtcgtagagatattccaacgaatttaaaaggtgttccactaaagagcttaaatactgattctcctgcggaagttccgtatctgaaaatcaacaaggttccaccaaaaggacacttaacgtttgttaaggcaagtctaggaactggtaaaactacggcagtaacgaagtggttggatgctggagttcttccggggaatttcattgcagtaacgaacactcgtgctctggtgtcttcaaacgccaagaaattcagtgctggtcagtatgataagtctgtagacatgctgaacttcaagcgaggtgcgattgatcgtatgtcaactacgatccactcaatccataagttcaagagctttgttggtcagattgatacgatctttattgacgaatgtgatgcggtaatgaacgatctgttattcgccccggttgttaaaaaccgtcgtgaatgtattcaggttcttcgtgatattctcatgaccgctaaaacagttattctgtctgacggtgatatcagtgctgaaacgattgaggcctatggttctctgattgacttcgataaaccggtagcgttctataatcatcaccgtaagatgctggcaaaagctcatgcttatgagttccctgatgaatccagtatttgggttgcgctacaaacgtccctagagatgggtgagaaatctatcctagtatctgattgtggcccagatgaactgaatgaaaaaggcatggcattacgtcgtaatactggtgcgttagttaaagaaattcactcaaactccacatctgatgtggatattcgtcgtattctggattatacaacgaatgagctaattgatcaacagattgattgtttattatgtagcccatctgtaacgagtggtgttgactttaactatttcgataacgtattcgttattactcgtaccagcaaccaagcgccaaacatgcgttttcaagcaatcaggcgcgaccgtggtgctcagaacatttattattttattgataaatctacgagtggattctctgctggttccgagcagtataatattgacgaaggttggattgagttagctcagcaactttatgcacgtcgtcgtgagctggagtctagaaattatactagcactctgcgttattatctgcttgatcagggtgcaactattgatatcttcagtgaaagctgggggactatcgaaggtgcaaccaaagagtatacagaagagcgaatcaagtgtattttgcactcaactcctgattattgcgctccacgtcatgcggatgcttatgaagcgaagctgttgttagttcgttattatcatcttgagtctattaaagatgtaacagttgaacatgttgaacagtatatcagggagaaacctaatgaacgtgctgcattctttcataagatgcatgaaatgttctgggaagatattaagaagtgttcaaacgtcacaatcaaaccatttattgaagctctgaaaggtaagaagaaggacttcttccttaaaacaggtcagagtgcaaacccgaaatatgctcgtatgtatttggggatgatgggtatcggcaaggacatggatactgaaaagattgtggactggtacagaacttactgtaagatcgaatgtataccgattccggttaagttcatgactgatgaagaacgtcagatgcatgaagaggctctggctgagctgggagctagaaatgatagcgaagaataaaaagtgggaaacaaggaagtttcccgtaaaagagagcaaacgttctggatatgacactgcggaaaagttatgtagggttgtaccacctcgtctcgctggtatccctaacgtatccatatggcttctgaagcaacggaagactcgtgtgtctcttcgcgttgggtttgagttagataaagtttatgctgaacttgcttctttgctcaaggaatcgtaaaaattttcttgcttcttgcaaaaattttctgtataatagattcataaatttgagagaggagtatttaaatggctggttctcgtagaaaaaagcaaatccacgaaatctctgatgatgtattcaagaaggttattgaacatctagagaatggtggtacgaagaaagctgcgtgtgaaatgctgggagtttcttctaacccgacaatggaacgaatgattgaagaatggcaggatcgccagattcaagtcgcggaaatgaagaagaaaaagcgtggcacactgattgaaggtgtcgagctcgcaaacgtaattgaacagtatttatctggtgattctttcgaagaaatcgcagatcgtaactatcgttcggtagctatgattaaatctgttttggaacgttatggtgctctgcttcgtttgaatgatattgttgatccactgaatcctcctctggttccagatgatgcaatggctgaggaatttgaggttggtgaacttgtatgggttccgggttatcagtgtatcggtgaaatcaagaaagcattgaccaatccagtaggcgcatatcgtgtttggctgttgggtgagggtaaacaacagaacgttcactatatgaactacgaattagcttctgttaaaca

SEQ ID NO: 2 - DNA, 58609 bp, Unknown
  Siphoviridae; Nonagvirus
tggtatcacgtcccgtccgctcatggagcgttacccgtggtactcctgtgactcatcctcctggattcaatctgcggcgtttggtgctattgaaactccaaagtggggcccaatgcaggtatccgaaaaatcaccgtcacgccactatcaaggacagcatatttgcaatctttcagaaatagaacaaaataacgttctacgctacttagaggagtcaggtttcacatacgaacgactttcaacgatatacgaatcccgcgctgcatacaatttatgggcgtatggtgtggtcaacgctatgattcttgctaaccacaatgggaagttcaacgaacgtctccaggatttatttgacgaataaggttacttatggatttgcttgatgctttaaagtttgttcaaggctccgtcgcgaagaaagaacttcaggaaggtttaactcacttccgtattgttgatggtactgtgcgcgggttcaacggaactatttcattgtgtagtccagtgccgctaaatattgactgcacacctaaagctgaaccaatgttgaaagctattgcagcatgtgatgaagcggtacagatgacaatgttagcgaacggtaagttgagcattaagtctggtggctttaaggtcagtgtggatactcttcagaaaccaactgcacacgtagagccagaaggaacaattcacgaaatagacggtcagctttttctcaacggtttaagccgcgtaacgccgtttataagcgacgatgcttcccgcccgtggtcttgcggcgtgttggtaaaacagggcagcatgtacgcgaccaacaacgctagtattatacagtattggttcggtgctgtattccctgtcgattgtgttgtgccacgtatggccattaaagaactactgcgcattaaaaagccaccagtaagaattcaatgtacggataccagtatgacatttcactatgaagacggttgctggttgcgtactcaattgttggaattaaagtggcctaacattgataagataattgagcgtacagaaaatggggccaatgtttatacactcgatactgagctttttaactgcttagagaaaataaaaccgttctgtgaacgcgacgggcgtatttacatggaaaatggtgttgtgcgcacccattacaacgagttggatggtgctagtgcaatgttccgtgaatctaagtcaattggcgtgtataatatagatcttattatgcagttgaaaggacttgcaacggattgggatgcttcgcgtttcaatgaaaaggacgaaaggggtctttcaactcctattattttttatggtgaaaatctacgtggggtaattgtaggatttcgtctatgagaaaagatgctattggtttcttttggcaggatttacctcccgctaagaaagagaagaaacagaaagtaaaacgtcaaccagttgaaagggtatgggagcgcccggactaccttccaggtcttgatgcagcaatgcgttttgcagctaatgatccgcgtatgacagacggtgaattagtggagatgtattttgcacaagaaacgttcgtatacgatatagaatgctataagaactatttccttgtggcgtttaaaggggttaaattcggtaaggtttattatctagaaatgactgccggtcagacgcttgacacggaaaaatacgaatggataatgaagaactttcgtaccgttggtttcaactcaagaaactacgataacacgatgacattccttgccattgctggtctaaccgttgacaagctaaaagaagcaagtgacaggatgatccaggaagagtgggctccgtgggatattcttaacagttttggggtaaaacagttttggattgaccacattgacgttcaagaagtagctcctggctttggttcgttgaagctgtatggtggccgtatgcacatgcagaagctccaggacttaccattcccaccacattgggcgttatccatagaacagattgctattgtacgattctactgtattaacgaccttgatacaacaatggctctgtttaactcgctggaagagcaaatccatctacgtgagattatgagtgaagagtataaagtagatcttcgctctaaatccgatgcacagattgcagaagctgtaatccgccatgaaatgaaggaaatgttgggcttcgtaccacagaagggtatggtggaagttggcagaacctttaggtacaatcctccagtgtggttaggtttccaaacgccactaatgaagtctgtatttcaggttgtgctcgatagttacttccgagtcgcagaggatggtaaaattaagcaaccatcaacaatgaactctttgaagtttacaatcaatcagacaacctacaacatgggtatcggtggtctgcactcctgcgaagagttaatggagattgtaccatctgaagatgaagagatgtgggatgctgacgtaacgtcatactacccgatctgtatcattaaccagcaactgtatcctgagcacctgggcccacgctttatagatatcttcgttaagatcgtagaacgacgtattgcagctaagatggctcacgacgataagactgcacaaactcttaagatcgttattaacggttcttatggtaagttcggttcaccgttctctattctgtatgcaccgcaccttattattcagactacgctgacaggtcagttagctcttctcatgcttattgaaacactggagcttaacggtattcaggttgttagtgctaacacggacggtatcgttattaaaccttgcaaagctaagaagcaattaatgacagatatcattaagtggtgggaagaaacaactggctttgaaatggagttgaaccagtacctgcgccttaactctgcaaacgttaacaattacgtcgcaatcaaagcagatggtaaagccaagcgtaaaggttggttcgcggagacaggtcttgctaaaaacgcagaaggtgagatcattatggatgcagttgttaatctgcttcgtgacggtacaccaattgccaaaactatcacagagtgtcaggatattcgtaagtttgtttgtatcaagacagctaatggtggagctgcgtggaatagtgagccgttaggtaaggttgttcgttggtactatacaaaagaagaagtacctgaaatactgatagtcaagagtggtgggcgtgtcggtaagacagcagggggtaaacctatgatggaactcactgaccagttaccgccagatctcaaccacgaagtgtacatagctaaagcggaaaaattgctggaaaaactcgcatacgccgcttaataaaatatgggccaatacatttgtactggcccacaataaaatgccctaaactgccgtacgttgcctctgcttattctggagtttcaggccaggtaatattctgtggatcattttcgtttatgcgattcacaagtacacgaaactttctccatgattccaacattgaactttcttcgtcagtagctaagttataagtcacagcatcttgcagaatactgattttataatctgctaaattaagaagatccgttttatgttgtgctgcatccgcaaccgacttagcatgttgtgcgtccggatcatttacccacatatcaccgtcccacttcatgtgttcaccatcgggggcaatataggttacattatccggaagagatccaattgtggttatcactaaaggaagtcctgtatctttatcgtatacgacttttcctctgtgatcttcacgcaggatccatacctgactttctggtctaaatattgccacatgattttctagagccactggaggctctatatcagtacaacatgccggaagacctgtgttggccaccacatacgcttcacgggttcccacatattcgcccgtatcattggagtagtcgtacacagttacagtctggtcttcattactcatttcaaaagacattaagcagccctcacaatatagttgaatgcaacgttcttaacagtgttttctgtgttaccagttgcgttaactgtaacaccgtggctgtgcgaacctaaagcgactgtatgactatgagcaccaataccgactgagtgcgtatgagcaccaataccaacagtgtgtgcgtgagcacccgcgcttgcggcactaccagacagcgagtgggtatgagcaccatctgatgatgtcttccctgcattatgggccgtacctgcgccggatgactgtgttacaactggtacgcctgtgactgaaatctgggtataaccgttaggaaagagtgaggtactattagaattcgcatatggtccagaactccggtgttggtgcccgcctgcactatttgctgttccgctaataccatgcgtatgcgcaccagtattattactcgttttagtaccgtaatcgaaactacttgtccctttagtaccatagtcaaagttggaagttgttttgcttccaagatcgacagatgcagtagacgcagtgtgagtatgtgatttcacaccgtcagcttctgtagaaagtacatcacgaccgcttgctggtttacctttgatagtttgaccacgcatgtccggaagtacacccgacgggtatgcagcagccagtttcgggtatgcagctttgtcgaattcctgtccttgcattacaatatatccggacggaggtgtatctgtaggccacggtaatgggacacctacaggtaaggtttcacccacaggaggcgggttttttgtgttataagagcgtctccactccggatagtattcaggtccattgtagacatatataaattctgaccttgtagcagcaccgggtatgctacttgttgtaggggttgttattcgtacagtatatttgacttcattctcattaaatacttcgattacagaaccagctaaagggattatgccgcaatcagtttcactatcagggatatagttatttccagcataataccacaaacatcttgcactccaggcgcgagctgagaatgccccaagagttttaagatattcaacaaactccgcagttgtcattggtacactagtaccattggcgataggtgcattcgcttttgctgcggaaatatcaagcggcgtcggcttatgtgctgtagtataaaactgcgcccactcggaccatggagctgaatccgtatccctgcgtgaacgcacataaactggtgcatgttctccgttagtaccgctccaaccgacaagaatttcaccttcgccgatagatgtggagcctttaagatgtatagtgttaccgtatgctgtcggatacccgttattgtatgtttcatacatttcaataccaacaccggaacctttgtttgtgccttccagtgctgtcacacgacctttggatccaagtctagttatttcaacgttaccagttccatcaaacggtttaccgttaaaataacgaggtgtctgtaacttcgtagcactagatgcgttaccattcacacctcgaacagcattgagcgtagtttcaatggtgaactcaccagtagcgttatcaatcataattggtcttagatcgttccaaccaccgtattgatcgcctttagcagtaaagagaagatatgttcttctaccatcattgcgccagaatgcaccgtagtccccaccaatcatacggagctgattttcaccacgagctacgatttcaccattagcgtagattttagcaccgctaatatctgtattcgtgaggattgcgtgcgaactatagaatcctctaccgtttgagaaatcaagtatagtttcagccgccacgcattctgttctagggtctacagcgccccatttgtacgttgattgcctaacaacataatcggcagatggtacaataacagataagccttcttctacatatacagagatagggaatgcttcaccttcaacatagaacacagagcatagatcatcatctgtgctacccatcatgatggaatgaatagcacgctcatttgcatcatatatgtgaaacattccataagcataacgccccctgtcatgccatccaccaggcattacaaaaccgttgaactcacagttgttcatcctatgggttcccgttctccaacctgtacttatcgttaccctagatgctaattcgcgtgtaaatccagaagaacgacgaataaccacaggataaaacttaccagcttcaacccctgcgggtgcatccactgtcgaatacttcattcctcgtttagcggccatatccgtcctgctggcagcattaatgttactcaggaagcgggacttgtctggtatatccgcaccgttctggttcttctgcaatgcaccaagagctaagttaacagtctcacgtagaccaacgttatcaatgaacagttgtttattgggaatatcagcaccgttctgatctttggccagcttactgttaataagtgtggttatagtcgttgcaaaatttggatcaccgccaagagcatcagataactctttcagagtgtttaacgcgtctggtgcatcaccaatcagtgcgcttataatttggtgtacaaattgagttgtagcaatctgattgttattaacttcaggtgctggagttggtgccgttggtacaccagttaaaacaggactacttgacggagctttagtattaacaacgtccatgactgttttaacagctttcggtgtagctgccaggttttcggcggtgctgttagtatcattgctaaggcgaacgatacctttagtagttaaggatgcgtcttcaagaccaattgcatcagcaatctcttccgcacgttgggcagcagcttctgagcgtaaagcagcagactcagatcttccagcgaatgtgccggcattagtttctgaagttttagcattagtttcacttgccttagctgcggtagcactagcggcagactcaccagctttgttagtcgcagtctgagcggaagctgccgcattagtttcagatgtagacgccgaagctgccttctgtgttgcaaccgtctcacttgccttagctgcattagctgcggtctgtgatttaccagcagaagtagaggactcaactgcacttacttcggatgcgacctttgctgcctcagcagctactttcgcttgattggcagtggttgcacttgcagacgcttcctttgctttagtatcagccaaagtcgcattattagcagatgcagtttctgatgctttagcattgttagccgcagtagttgcagcatttttgagagctgttacttcagcgacgccctcttctttaatatgctgcgtgtcggtttttaattgctggacttcagccttgagtccttgcacagcagtaagagcttgttgagctgatgtagcagaaccagccgcagcgttcttggattgcaatgcggaagacgcactagcagcagattcctgttttgacagcagagctgaagctgcatccgttgcagcagagtttttacttgtttccgcgttaagctcactcttcttagcattagcagcggattcagacgcctgcaatgcaaattgctcagagttagccaccagttgctttatttcctgaagtatttcaggtgtggtttcttctggagcccatttagtaagatacgcgttaagtgaaccattctgactatctgcatagattacaatgtcaccagctttataaggttccttaccttctggtccgatgataaccacataatgcccggtgttcacagtgacgtcgtaagcaccttgtgaatcagtcttaaataccgctttacttccacctagaactacaatagtattgcttcgtgcaagtaagaacacgtttgcgttgacgattggtttattcaatccatcaactaaaataccttgtaaacgaattgccatgagttgtgcccttatataagatcggggtttacatcttaaattatatccctatatagttgttatacacaaacataaaggagtttgaaatgaagactttaatctgcgccattattctttctatgactgctacttttgcttatgcggctggtccttccggcagtgctggtggtcctggtagtggttcatcattaggtgggcatactggtggagtaagtaacattgagcaccagacttccatctatgaaggtactactgccggtaaagctaaagctgagtggatgaaaggtaaaaaagttaaacctgactgttcaccagctatgaaccgtgtcggttgggctgaaggttgcaaataaattataggcgctctaatgagcgcctaatttttatccacttacagtgaaagatccactagacctacctatcgttaacgtcggtgctataatatctatgtgtgtaccagtacccctatctgtatccagaattagttgaatactacgtgttgtaattccacttactccaaattttataggtatcatgatattagtttggctgattatgtattccctatattgaccggctaatgtcagttttaatttatatccagctgaagttcctgaagttcttactatacaatcaaatacaacagatcttgcctgtggagacgaggatgagtcattataagtatatattttatattgctcaccagagatatccatacctataccaaggatatccgggaaagtatagattgcaactacatctccgataaatctacttgcttcaactgttcctttaaacgtcccactagttgcttgtatctcaccagtaaatttaccatttgtggcgtatactgtacccctcacgacaacattattcagttcagcatccccagctttattcaacttccagcctgcagaaccagctacatagttgttagattgaatatagttaccgatcttagcgttatcaatagagccgttctcaatgaacgttgccttcatgaatacttgaccgttcttaactgcaaatgctaaatccgctgtgctgttagttgggttatagatagcaaagttattggcgttgaccataaagtaagattggatagctccaccggaaccttccatacctaactgaataccagcaacgtatttctgacctttactatctacctgaatcttggcaccccactgagcgttgacgttaccttcaagatctacaacggacttactgacttcctgtactgtagctttgaccacatcaatctgttggccgtttgtctgaatcaacttaccatgagcatctattaactgcccctgttcattgattgtgacgccctgttgctgcactttaccgtcaacaagaactacagattgttgcactgtatctattgtctgagttaagcgtccttcagaggtctcaatttggtcgtccacataactcttgacaccatcgctgacgcttccaatctcagccataagttctttataggtgttagtacctttgaactctgtgtcaatctgcggaataagtccagcagcatctgtgaagcatcttgcagccacctctacaaatgcggaagaaccgaaggcgttaattgctcgcacgtaccagtaataagtgtggtcattgagtaacccttctgaagtccacgttgtacccataccagcacgggtggcttgtcgttctacaacgtctacagcggcggatggtaatcttgtttcaccagacgtccagaaatcatattgtgtactaacgttcgctagatccgcagattttggtttcaatgtcactgcgaagtagccttgcgttacttcaacagacgtaggggcggaaggtgcttgaatattgaattcaagatacgcttctggacttgttgcgccggtatacgccacagctttcacatgtgctgtataagcgccgcgaataagccccgtaatccgcgtgctctggcccggtacttgcaccgtcaatacggtagtaccatctttcttaattactacgttgttgtaggctacagccattatattttgccacgacagaacaccctgtacaacgtcgctaatttgtaagacttcatattgtaggttctgaggttgcatagcgccaccagtaggtagatctactagatctggtcgctctacaggtttgccaattgcatcgtcccataagtccgggaagtcttggcgtacagttatagtgacaccacctttcggatcaaactgccacttaataacacgcatctctactttgttcattccaatattaggaatgtcaacgtagacatacatacctggacggaaacgatacccacgcatattacatggtatctcgatggaacgaccaatacgtttgcgtttcaacgtcaagttagctagacgttgagcctgatatgggcttgtgacaaaacgataatctacgtcttgtgtaatctcttgaccgtcttgctgtacccattcagaaacacttacagacgggaagtctgcttcttgatagttttgcagaggatcgatgtaagtacctgtgattgtattagttcgatctttaaaagctgtctctggtgtgattttaatgtcaccagcgatgcagcttgtatccagagttaattccggaggaccgtaatatgcacctaccaggataccatgcttaccgccgatataagtcaattccccaccgcaagcgtcaagcatgtcttccaggatcttggaaggtgcttcatccatgtcaaattccccgttgatagtataccgggattcaaacgtgtcatccgcgttcttaactctttcatcacatatgttagcggcctctttgaactgctcccaaagaattgaatcatctccgcgtttaagatacactcgaagatagtccaaaatcacaagggcggcattattgctaaacaccatctgaccagttctagggtctagaacttttcgtcccttcttaacacatttgacattaggaagcccagctggaaacttttgcgaatcatacactagattcaattgcatccagcagatacctttaccaatcatgtcccttttccatgatgggcaacgattcaacatgtcttggctgaccgtagtagggttgttgtataccttataggacgcattccctgcataagtacctattggatcgtcccctaaccacacttgtcctacttcagtcagttcgtgtccagctaatgccaatacaagagtcaacttctcgtagttctcaccgtgtttatctggatcctgtactcccggttcttcttctgcaaatacaagaacaccactagacacagtcgtcccataaataactgtcctggatgcagcagcggcacgaataacctgtttgcgctcactctgaggtgtataggagtcaaagttataactctgagtttttgtaagtagagctccagcagcactggcagcaataccaatcacaagcgcggtagtggctgtgataatacctgccgctgccccagccgctgcaccgatagcaactacagctccaattattgctggtggcatttacaccctccacgcgtctgtgatttcgacgtccgtcagtttaaaggtaacaacaccattcgggcccatcgcccaaatgcaacctgtccacagtaccccagcagttaagccaagatccccgttaaatgtcactacgtcaccgcgttgagcaaactttctgtctacacgaactggtaagaatgagtccagaaccattgctaaggatgtgtctttgactcgttttagcataaagcgtttacagctaatctcggagtcatattgaccgacaacttcatccgcaatctttgtaccatattgagcatcaatgcacttagcggcaaagatgcagcaatcattttgaccccattggaaaggaacttctttgagggagttaactgtggtcagcaagcgtgtctgccaacctggaatcttaattgtagttgaatcctggtgcatcttttttacttccccaataaattgaacgctctgccatttgtgcaacatatctaaagaagcggtctccgggatgtagtcgctgttggctttcatccgtataacgatccggtataccggaagaccatttttcaaatatattggacaccgtataggtgatagcgttcgttgtgcctgcttgcattgcagtatcactaataaaaccttcaaaaaggacgttagcgttagtcacttgccctctttcatccatagtagcgatataacatttcacatcgcgtcctacgcagttttcattgagtgtctgcccaacaagtgtcatatcaagtccacttaatgtaagagacattgtacttgcactggtagtattctcttctgtgacaccacctacatcaccaagattaccgacaccaacgaatgtctgaccatcaatagataatacgccagtaccagagtggactcttgttgttcctgaatcaaaataaattgcaactgcaattatcatcgtgacgctaggttgttccatagagtccaataaagagtcactgaacggactaaatatcatttaaaaagtctcctcaaactctaacgtgaacgagttattgaatgcaggttgacgggacacaccatttgtgttatcagataaacgaaacaatccaaacgggttttcagtctctatcttagctccgtcaggtgggacatttcttaacataggtgcaaagtacaccgtagcaagaccactggcgtcgctccatacatcttctgtaacaagtttgagttcattgttgacagtaatgtaatcaccttcttgtagaacaaggcgtttagcaagccaacctcttgactgtatctgtgtcccggtattatttgctcctttgaccacaggtgtcccaactggtgggcgtccccatctaccgaagtcgtgtaactttatcatgccaaccatgccgtctaacttagcaataaggacttccagctttcgggattcccaatcgtccaagttattaaatttaaggctcgccttccaacgtgatcctggatatcctacaacctgtgaagccccgttgaagggacttgtaaattttacagagttagatacgagatcccagtccatcgtagaaggtcttaaggcttcaggccaggttaatatcgccatctttaccccaacgctaattttctaattgatccacggttagcaaagtcttggagtaccatgttataaccttgctgggcgccatctctcgcagcttgttgaactgcgcttttcaaagctgcatcaccattaccctggatgttaaagttctggttaatgataacacccccacccgaattattgccagtatttgattgacccttcataaagttagtaaagtccgcgttctgttggggactaagaactcgttcacctttattcagaagccacgtaccctcttctggaacgttagctataccatcgtgagccataccagtaagagcgacactggataatgtcgaaataatgttagcaccagcggccgcaatagttgcatagttggccatcttttgcatcggtgtcaatgctgtcggatctgctaatacctgagacagtgcggttgtaatacttaacatcgactgagcaatactgaacgatttagacagtgcgaacataaccctgtaagcaccactagcatcatcgccagcagccgccataattgtggtcattgacccagccatagagctcagactttcaatgtaagccattgccgtctggttctgtgcaagcatttgcttctgagcgtacttcaactgaatgtcatgtcgtatgcgctcatagttctctttgatagcggttagttgctcttctttgccagcagctaattcaattgctgtttcatactgagatttaagtgttgcaagttcagcagcttcttgatcagcagcttgcccagcagggttcagctcggattgcatctgcgcacgttttgtataataatccgcttgcagatttaatctggctgtatatgcctgttgctctgtcaataaaccagcttcaagcaactgatttatttcttgctgggcttctttgtacgcacgcaccattgcaacgcccggcttgtactgctccgccagttctgcacgtttcagatcatacttacgttggatagctaataatgcgttctgcaattcttcttcagttgctttagctcgttcggctttatcacgaatagcacgaacttcagcttcttgctgtaagttaagacgctgtaaaccagtagcaccacgcgcttccacacgttcatatgctttatcccattgttcagcataacgtgcggcagctttattgtctttcttattctgacgctctttttcttgctgttcatggatcttcttctgagcgtcgtagttcttcccggataaattgagaagttcaactagtccttgctgctcatccgttaatacagcagttgcgtcagcatggccgctgatatagttcttaatgaacgtttcgttttctttatacttcttaccaagagctgtctgagcatctttcaggatacttgcttgtcgtgcatgtccagacatctttaattgagcaacatctaactcattattctgagcttgaattgcactgactagctcctgtgaacgaccggcagcagaactgatattaatagacaactgctcgttttccgctttgagtgcatcagtatgacccattacagcagcagttaaattgttcagtacagtcgttaagttagatttaatctgttgtgctttttgctcaagagtagatatttcaccaatcttgatagcaacgtcaccttctaattccttacggtctttagtaagtcggttatactcacttgttccttcagttgcttcagcctgataacgcgttactgtgctaagacggttctttaattcagccagctccctgttttcagaggcaatctgttcgtccaacgtaatagcggcacgttgcaactgaacactaagagctcgttgttgctcaagagttgtttcttttaacttgttctttaaatcttcttgagaggaagcaaggttctgcgcatcctggacagcttgtttactgttttgactccacatgaaccatgcggcagcagccaatgtgaccacacctacgggtccacccatcaagcccattaccgtccgcaggcctgtcatggtgacagtaagcacacgggacgctacggtcgcggcagccatacgcgcctgcatggtagtctgggcaatagcaaccgcttccgtagcttcgcgtacctgccgtgtattctgcatgtatgcgttgagtgtcgctatacctttataatacgtttggttggcttgcaatgccgcctgaatcttggtgcgctcggctgcaacctgtgctaacgttgcttgtgcttcattatatcgagctactgcggatcttgtgataccgtcaatagtcttgatgtttatggccgagctacttgcttgtatcgcgttcagctttatgaatgctgcaatctgcccagcgagggcggtaatcattcgaccgccaataatagcagcaacacctattgctgtattagacagcaaggtgaggtggtctgtagcagtttcaatgacagcacccattgaattgaccacagtttgtaccgaggttgacgttcccgcgaatttaattaatttgttattcgcaatctccattcgctgagagaacgttggtattgtacgattaaactcatcgtcaattgttgatgcagctttagaaatggagttaataacaacgtctgcggtcaattgtccggcgttagccatctggcgaagaccagcagtaccaacaccaagaccatctgcaatcatcttaccaagacgaggagcctgttccattacagaacggaattcgtcaccacgtaacacaccagattgcagaccctgtgagaactggataatagcagcagtggattccgcagtggtcgcaccagaaacaatcatcgctttgttaattgtttcagtgatctgagcgacctgtttaccagtcacgccatactggttcagcgaacgttccatacgagcataaagggttgacgtagcttctaggctcgtacgagttctttgagcgataccaaatacgcgctcttggatatcaaccatccgctcgtttgcagagttggcgttagccagtttgtttgtaacgtccagccacgcatccgataacttagcaagcccaccgacgtaggttgtcagtgtggttacagtcattaccgtatagattgcactaatggcatgatggaatgcgtcagcacttgtagctgcacgttgaaaaccattctccatacgcgagctgacagtctcaactcttacacctgccgcttgcaagcgtcgcagtgcggtttcagcattctgaataccttcagcacggactctaatgacgatgtcagctgcatcagccattatttacctcctttattattggtctgagcgtgttgcataagttcttgttgacgcctaatatcaaatgcttgccgttcaagacaaatttgacgaattagttcacgctctctgaaatcaagttctacacctatataatcttgccaggcattaaattcgctgtaactgaatttatcaccattataaaagtcaagaaataacttgtaaatgtatctgagttcgtgcggtacggagctggattcgtactttgctagtaaggagggagtcttaccagtgacttttttaacgtgttggagatgtttaattgtgggagtcttactgcccggcgggcaactgtgcaattgccattcgagcagtaagtgatcaattagcttttcgcgggatcttagaaaaaaagggaatcttgcgctgctagacgattgatgtcgtcatacgcaaacgggttattgtcaaagaattcaataagattgtcttcgttgcattcttcttcgaagctccacgaagcaaccaatttacagaacgctcgcatattgatatcgtcgagcatgtccttatcaatcttttcaaaagatccgttagcaacgacaagcgcactgatctgacgctgtgcttttaaatccgcttcacgaaattcttcactgtgacggttgcgaattttcaaccagtgacctgtatcgccctgtcctggaaaaacaagcgggtaatgcaacagtggagcgttttctaatttctttttcaagttaaagtcgcggaaagatgcactaacagctttctttgcaacttcagtagatacttgtttgttttctgaagacataatcgttccttaataaaacggggtttacaccccgttccaattactcaccattaacagcaacaaggcaaggtgtgctcggtatagtacggccatgtgaatctgttacttcacatacatactgtccagcatccgccggttgcgcgttagctttagtgaacgtggcttgattagcacttccaataacgacaccacctttcttccacacataggtataaggttcttcaccgcctttgaccacaactgaaagggttaacgtttgtcctttagtgatagtcttgtttgcggtaagatcggtcgtgaaagacattggaggaagtttagtaatgcgaatgctgtaaccttcgtcctgatccaacagaccagtataactcatgttcagcatgatgtcgccttcaccatcgattggacgcggagcttccgtaatcttgatacgaggcatactgaaacgatagccagcaccagtggttccgtccaggatatcgatagtcaggtcactttcctgttcgttcaggaatttactacgcagtttgttatcttcgtagtaggcggtcagtgtaccactaatctgacgacgtttagagcttggcttgatagagaacttggaaccaacaacgaagcgaggctcgatgccgttctcaaggttaatagccatctcagtaataacatcaacggacacatcgcccatagccagcttaccagagaagccgtccataggtggtgtagtcgtacgagtacctttacttagaccagatggcagagtagcggcttgttccatcgtacgaccaacaataccgaattccacgcctgtgatagcttcagcacttacagtaattgcaagactgttaacttcacaaccgcgatagattgtatacgggaagtccgtaatatctgcgttatagtcaataaaagtaaaagattggcgctcgatgcctgcggtaagcacttcacccgcaaacgtaccacgtaaagcaccgcccaacaggtcatcaaatgtctcataagacagttcacccgttgctgtaccttctacgtgtcgagcaccaagacggaaatccgccacttctgcatcatctcgaatttcttcagattgcagagtagcgactttaatatcaagacccgatttagtagcacgaaagaccttcagagttccgctagacggagtgacaccggaggtctgttctttgatataatagctactataacgtgaaccttcagccatcgttatatcctctgtttaggctcacgtgcgagccagtagattgttacatattgagcatcccaaacaccttcaacaccaccgcgagtgaagtctgcaattgacgtctgcccaccttgagaaaacgtctttcttgtcagtcttaacatgcagccgtccggtgcttggagctgtcttggtacactaaagattttactcacatgaccaagaacagcattagattcttcaacaccaatattcaactgtgaatatacaccaatctgtaaaaacccacgcatttcattatcgccataagggcctaacgttacagggtcttcacttgatggggtattgatgatctttaaccacactttaaagccgctggcatcaaatgtcaagttcttccatgccatagcgtgtgacatttcagcatagttattcactaagtgtgatttcagggtatcttccacccaatgaaacggatacgggatcatttatcaaagctcccaagtttaaatccattgaatgcctgtccacctcttgcgatgttcttacgcaacatcccgttaggcgcttgcttactataaccctcatattcaatcttctgagcataaggtttaccgttaccaaaataaatactccaatcttgatggattggaagatatcttattttagtaaacaatctttgtttcgtagcagctcctgacgggtcttccggtagattgtcctgaataaggtcgggtgatttctgtatctgccaacttccgcgtaatccaccgtccttaacaggagtgtcatcaacaacagcactaacgaagccataaagtctttgttttacctcacctgaggctttctgcatagctcttaattgagcactggtaaattgatcacggaagctcttcttagccattaggaaccgaccttaacataactaatgattgtagttccaccagcaccaataggctcaactgcattgaccgtgaacgagcgacctttgtggtcaataaatttaaaaccaatacagtcttccaggctaacaccttcaggttcgtatgtaatgaatactttttcaccttgaaggattacactaccatttacgttagtctttgactgctcgtcatagaacacgcgtagtggtatctcctgttccttaaaagtcggggcccaaggcttcgattcattaccctcttcttttactttggcaatgagtgttccatcaaaaccaatttcttggtcgttcaacatctcatgtgccattgcaataaattctgaagcaattgtcatcgaattactccttgtgagctagagcttcgcaggtagtcattaatcaaagcccaaaaacgctggtgtggtgtcgcgctttctaatacagcactctgaccaactgcgtattcaagtgtcagtggaccaagaacacgctttttcagcgcatagctggtactgttgcttaataatggcttaccgctctgcaccgtatccgcgaccagttgggcctgtgctcgcttaattgctacaggtatggtgttacctggaatctccacaccgtcgttgtataagccgctgcgcgggaattgtagctcctgatcttggttggtacgcttacctttatagcggttaagactttccataaaatccatcgcgttgataagcattggtttcaacttatcttccgccgggacagtaactccacggtcttttaaatactgcgtagcatattcaacatcaatatagctatttgcattaggtacacaagacccatcttcaacaatgatagttatagtcatatgcacctcaagcaatatctatcgtagcattaagaatctgtccgtctgcacttataattttaatgtcataccttgcagcagacgattcgttaattgtgaaggtctgcaaatcaaattgattctgtgagaccaattctttatctttaaagacctgtacaacgtaaggtgtttgtccattctgccacgttgtaacgtaatcggtatctaccacacctgtcgacgggggcggcgttacccaccccaggacaccgcttacagggttcaacgtggcatctcgacgacgtctgttacgttgcatcatatgaaacaagaactttttgtctgttcgaaatgccatatgtcaccttagcgagtgcggataccgttacgaacaaccatacgaggctgattgaccacatgtgcaacttgtgccatctgatcgcggaaagatgctaacgtgtgagccagctcggtcttaggtttacgacgttcaatttcagtgttgacttttgcgtacaatttagcacgagattcaacaagttcgttcattgcagataacatctggttgtctgcattgacttgttctgaaagaactttttcatattctttaagctcttccacagaaacagtgtcaaagtcaatatctggaatatctttgagcattgctttaactgcatcgctcacgctgacttcaaaagctactcgcgtagtgacaatcgatttaccgttaacagtttccttatctgcttcaaccttagataaggactcatattgtgcattgtcggtatctgcaacaatttccgtctgttcggtttcctgcaatgaggaagtatcatgcttttcttcatgttcgacatcctcaatcacaggatttgaacgagtgaacccaggcgcaacagaattaacgtcttctcgcgtgacggacgggccaactgtaaacttcaatgcttcaattttaggaaggccatctgcagtccaatgattgtcattctcaacgttgagtttacgaagcccttcaatgatcttatctttcatcattcattcctcaaaataaaaggtgttacaagcgaagtgtaacaccctttaaaacatctagcaatttaacgtttatgctgctggagctgcggaccaggcttgcgttaatgcagttcccgtaactttcgtcccataactgtcttcaactgtacagttaacactgaacgtcttactcagcatatcctctgaagctgtaccagagatttttgctttgttgacgcccgcattttgaagggacaatgcatcgccagttccagcggcaatctggaacttataaacataagaaccatcatcctctggatctacttctttagcacgaatgtaaaaagtcagtggtgtacttactttcataagaccagcagggattgtatcttgccaaccactttcaccgtcagctgaatactgcactttacctacagtcttaattttatttttaggtgtcgcatctgaaccgtgacgttcatgacgtacataacgacgatgtcttgaatgacgttgataacgcatgtttcctcctaacaaaaaagggaccatataggcccctttaattacatggctaaagcattaagcgtgttcgcgagtgaccaggcgagcaatcttaatctgtttacgctcagggaatacacgagcccagttggtagcagtcttcagagcggcgttatccggaccaccttcagcagcagtaccaacccatgcgtgaccgacagggtgaatgatgttttcccagcggtggaacaggatttcagaaccaccacctttgtaggatgcaggtttacgttcagtttcaacaggaactttcggtgaaccaacacccaactggaatgcaccacggccaaccagccaggtttcgtacttaccgctatcgtgaggcatcatatcgtcaacgataacttcacggcccatgtaggtcgggatcattacttcagcacgagcatccgggatgaagtcgatcaggttcataagctgcatacgctggtagaccacactgtgtaccatcatcatggacagctcgttcagggagtcacccatagtaccagcagccagaataacacccgccgggttgaagttagtcacaccatcggtgaaggatgaaccagagatatcgtgggtcatatcgttctgaacgtgggtagacttcttatcaccggaactaaccggagcagcggcgttcatagcaaacacaccactcacagtcgcaacgaatgcgcgttgcagacgactctgacggtagcttgccaccagattaatgatagcatccagcgggtcaggagagatcaggctgtccagcaggtcagcagaaccccatgaatggttacgagacagacggacctgaatttcacgaccagatttgataccgccaggagtagaatcggttgaatcgcttgcgctggaaacgttttcttcatcacgatccaggtctttgaagaaccgctggttaaaggtagtaccttcacccatcaatgcagcgttaagacgctcagaaatctcaatagcaccagactgaatcagtcgggacttttcagttgtgcggttctgcacatacggtacgaagatctctggaacgataacatctgcaagttcagtgatcgcaccacgacgaacagcagacagaagaattgaattggtagctcgcaaattaagcatcggagctgacagaattttagacatggtagtctccgcaaagttaatcgatttactttggaactctaccgccgtgggaggctccaataatccttgattgatcggagcccgtgctccggttgatgtaaaactagcaccaaccggagggagtgtcaacaaattttattattttttaactggacgtactggacgcttcaagtccacgccagccatggctgccagacggcctgctttttcaggattttcacgaagaattttaccctgttcagtaaggttccaaccctcagcactccacgggttcttaccagccgcgccaggagtacgggagccaccagcacccccgccaacgtttccagggaaccagtgaggtttcttatcctgaatgtcctgtaaccacatttctggagtgatgcccggggttacaccaacgccgtcgcgggtaacaacctgaccgtcttcggtgagctcaaacaaacgagagccaatcagttccacgtcgtcaatagcttccgtgatcactttagcagacattgcagccttgctcagagcggtcttaacgatgcggttcttctcttttgtggtcagctcttctacttgcttttcataggtagaaagtttgtttttcagctcgtcacgttcacgctcaagcggagttaacttgttacggattcgtacgttaatgatttgctccaacttttcatcatcgactttatccgcacgcagtttaagctcttcgtattcagcgtcgcgctgcaaaagttcgtcaatatcacgtccgttcagcttacttagcttactcttgaccgctttatgatcgttgcgttctttttcaagtgcggattgcaacctgtcaatattctgtttgccaccaccctttacaccagtgaggatccacttatcaccttcttgggaataatactcacgcgcattttccgggatttcgtcttcagaattatattcaagttccaatgcaccaaaacgaggcatggactggaagaagccagcggaataagctaccgctagatgaatgtgatatttgttcataaaattctccattgtggaccgttccactaaaaagcgcgatagaccgttctaccgcgctataaagactaatacatcattaagaatgaagcaactattttttactcttgtcttttgctttacgttgcacgcctttacttagcggcattttcattccccgtctgttctccagttgtttgctggatatggttctgatcgtttttaacttgaggtaaaaggaacgggtattctttgcgctcctcctcaagccgtttcatctcctcttcaaacgtcaaagaggtcattcccttatcctgcaaccagttgtgcatagactcagcacataacggagcaccaagattcttggcagtttgcacctgcaccaattcctggccttcaatattagctttgctgaagtcaaggttaggtgtaactttaacttcgtctggatttaatcccatccatatagcacaaatacgaaggattttttctaacgcagcagcgccagtcttagcaataccaactaatgaagcagttttagtgataagacgtgtttccagtgcgtcaccagactcttgagcagcactttctgcactggttaaatgcccggaacgagtctgagcgtctttatggtcagcttcaagtgctttacgttgctccggtagaccttgcgagttagtaccaatgtatttggcatcaccgtccggagatacatcaatacgagcaccagcaccaacacgaacaggagctttatcatcaactgcgtcactgttcgtaataccaccacgaacaaccagcgtatcctggctctgcataaacaaagcctgtcgataatcagcttcaccctgataaatggaaatacatctgtttgctaatgcgagtagcggtggtttatctggttctgggactaagtccatagcgttacaaaatacgaaaggtatctgctcaagcggagtacctttatattgaggaactacaacgtcagagctcacctcttctggttcgtcatcttcaccaggaagcaattctgtcatgtactgcccatacacgtaaccgctatctgatggttcatctacattggcgcttccaagaacaagaactcggtattgaactttataagtccaatcaaatgaagtcttgtccattacttctttggactcatccaatacaactaggttaagattaactgaaccaagatcgtcttcaccatcatcccagtttcgtatacttaacgcctcgtataccgcgatgtacggtagcgtgtcacgggtacttcccgctggcagctccaacagaaggccaagacgaccatcgcgtagctgtagctcgtttatgcggcgtagtagctgatctaaaccttcgcgcttgctggtagcagattgacgaagtggttccattgcagcaggcaactgaataatagctgccttgctatgcaacataccaccgtggttgattactgcatccgccacatattccgggaacactgcacgttctttataatcgttgtaacggatatagccatcttcgcctggtttcataccgtcataacgcatagcaggtgtcggtggaagatacaaagtaccttgagccttaatgtggtcagctccaaggaaacagtcccgcatcttcaaccataatgcactaaactgtaaatatttaggatgaaccgaagaaatggccatctgttaaactccttatgtcccaacagtcttaccgatactaccgccacgtgcttcgttggctacgcgataacgtgcttcgtcagcaatgtggtcttcagaatcagtatcgacatcatcaagatcatcttcatctctagcaagagttggaacaagatctataaaatgatgacagttgtcaaaaataaacatagaaggtctttcacgcaaagcggcaaccttaggatccggaattgaagcagctaaatattcccgcattcgcttccaacctgctttacgtgatccaggggatttatcacttcggatccactgtacaccaggataagaccgaccattgatagttattggcttagacattgttgctgcggtactgttaccgtctttaacgtcccaaatgctgttatcagcagggcctggaactacgcgaccgtataaaccagcttcaatttccctgacgatgataccacgagcaatttcagaatccaataatcttaaaccttcgttcggttttccgttagtaccataccactccatgatcctaaataagtcacctcgtactgttcgtacacgacgcccatttggatacacgatatcgctaccatcacttcttgcccaccaaccaacagaaaaaggtttacttgagccccagtcaaacgatctatcaattctccaagagtgaggtattggaaatggtttgaccacatgtatattctggcgccataggtcgtcgaacattccacctgacgtaatatcccagctaccaccaagccatgccatacggaggttaggatcgtcaatgttcacaagctgcgcaacatactcaggtgtcaagtttcggttctctcgatacgaaccaaatatatgacagcgagttctaactacgtcttcccgtttctgtgtacgcgggttgaagacgtttgttacttccttcttcatagacccaagagggcaagagttaataaaatatttcttgacccagttatgtccgaccccaaatgggttagtcgtagaaaaaatttgcaacggcaaaggtggtagtatgaactgcattgcgtattcatggtccggttgaacaagcacaagacgcccagttctctgatacacgtcaccgtcaataattatcgggttttcttctgcaacaaaggatgtacggttacaggacttcatcgcttcataaagtccactatcaggatatttagttaattcgttccacccaataaatggaaattcctgaccgtggtacagccagtaatccttaggctttttagcgacacggaacattagttcttcgccgctaggccatacccatttataatctgacttggaagataagaatttacaaccatcattaaattcaggaaaccaacgctgtgactttgcaactaagtcatctaagtttttgtattctcggtcaaaaatgataccgcgccagtgtttaccataccccatgccgacataacgacgaaaacgcatcaactgcgcatcagtctttccaggaccacgagtaccatgataaaggatctcatctgctggacaactcagtgccaacacctgagatcctggatgtggtttccatactaccttagtggacggtgtctgaatcattgagtccatttaaagtatcctcttgcagcttagtctgagactccccagcaactctttcccaatcgtccatagaaccgaccataggaaccagcataacaccagtagatacaccaacatccatcttctgttgcttaggagcttcaaatccaaagatgctacataattgtttatatgcagcaacacgagcagcttgagaagatccagggccacgataagtggattcaaatctaagaccttcaatgatgcgctggcgctcttgttctatttcatatttgcggtcacgttcagcacttcttgctttctgctgttgaagttctttgattcgtctttggcaatagctatcatcctgaaaacgtttggcataatcaaacgccattgcggagctcatgcctacacgtttacacgcattaacccaatcataatcgaacagatattcttcaacgacagagtcacgtatagccatctcttctttagtgagatcggcttcgtattcaatgctacgtgtccaaggtagaataggctttaccataacgttactcctgtcgattcttgacacgaatataagcggtggactaattaattgcaagggttatagcaaatgtcaataaaaagcccgctcgatataaattcaaggagcgggctttacttataaaccaatctacatttccgctttaggaatgtacgttatctcccggatgtcttgtttgatttgttcaaccttgttgaccacataaacaggtggttttgaaggttgcaggtttgccctgtgtctcttgtgcatctgatcaatggcgatagcactgactccaatttgtgcaagtccaatcatcatataaatgaaaagcaatcgcggtttcttacacaatataagaagatcgtcgatgaagtgacgcataactaacctctttctctttctcggtcacatgcttctgtttttctccgtagaaacttcagcatggttcttgatcctgaccaagataacacgcctatgaacgccccactgaggcccagtgagacaccatgttccacgttaattacacctatcaagaaaccaaagaatgcagaaaaagcaccctcttgaatgaagacgctgagtctgaacctttctttagcatcatgggttcttgcagcgtagccaagggaaccccctaccattgcaatggcagtcagaataaaaactatattccaatcccagttcggcgacacttataacctcttactatgccatatggatacccgcgagcaaatcttcatcagaataaggttgcacaccgttctcatgtttgatgatcgctttcacgatcgcaagcatgattttatcatcggtcactgaaatcggctgttctgcaccaacaccacaagccttagacacggattgaatataggcttcagtgttattttcattcggcggagcccagcgcgaaataatttcccgtacagtgtcaatccctttatttccgacacgcttcatcccttcgcggttgcggtagtttagtaaaatacgcgcaatggcgcgaataccatattttacatcgataaattgacaaaaagaacggtcagtccgtttgttttcaggaacaagacctttccagttatcaccccaacgaatatttcccggattgttattccggatacctcgtggttgcacagtcataaaaaagctccattcagttaaaccgaatagagcatagttgaattatcacacgcacacaatcaattatgcgcgattaagattgaacgtttagttacgcaacccggcaaggactttgcagtttatcaccgttctttacgcgcatttcgcattgcatcatactgtagttcgcactgctcgccggcaacacgatacttttcagcctcttctgccacttgtctgtattctgtgacgctttccgaatacagttcggtgagcacacgggcgatctgggcggttgtcttgctgtcgggctgagggccggtagcgtcaccgaggtacttacggacggttgcgatttcgttgtgcaacctgtcattagtagcacgataatcattaagatcggcaaccaaagactcaatgcgagattgatactggcgttcgataacgtctttctcatatgctcttcgtttctcctcctcgaaatcaaccgctttctgagtttctttttggtacgacacaccggcatcgaaaccctcctttctagctgattctatggcattgtcataagcccagttggctagaataacaattatgacaagtggtatccaaggtgcaacaataccaattattcttctaaggaacatactttgtcaccaacccccatagacaagtattggatagcaagaagaaaggctatagcatctttcgtatcccctagatctttaagagtcttgaatttatcttcgagttgctgtacatacttttcaaattgaggcaaagcatcaatctcagcagcagctccgcgcatatacactcttgcagcggctaattgcgcatttgtaggatcactcacgatgttctccagattacactgtttcgaatttcatcattccagacgtattgccccttctcaccatttttataggatggaacagagaaaacggaggaacttggatacaaatctgatgttgttaagcgtatacgcttaccgtcaaaaggtccaccaacacaaaggaacagaccagtcttaggtttcttcaaaatggttcctcctcaggtttacactgtgccattttcagagtataagctacgtcgtagaagttaacaccctgaccacaactgtcgcagtgtacgcacgccagtcgtacggcctcttcggcggtgcaacctcccgccattgcacccatcaagaactcaaacgcgctaccttccgcaataaattcgttagtgtccggtagacctaatttcccatccccgtagataggatatacgacaagttcctgcgtcacggcaataccataacgggaatccggatttaaatccgagaaaggttctttacgcccacgaaccgtagttttcagatgatccacaatatcagttacaggacgtagtttaccagacatcgcaacaagacaaagtccaatccctggaatattgacagtatgaactttatccgtagttgttgcaatattaccccatgtaacctgacgatctacagccaatataccattacgataagcaattgcggtcatattaaacgcccatatatgtgataaattttataagcagtggaaagaccgatattgaactctttcgctgcaacctgaaatctattctctttaccagtgtaattcctaagaaattgataaatttcctctttatccaactgcctgtttcgcacaagtgtaggggacccaagccggcgcatttcgggcgtagtcgcgaatcttcgcttgatctgagctactgtaccaacgtaccaatactttgccccattttgcccaatagccgcgtgtacgcatcgcggcgtacctgttttagcgaacttacgctttgcaaattcacacgcgagttccgcattgtcaaaacgttgcaagcccataaatcaccccggcaatataatttcgtaatcaatcaggaaagaccgcagaggatacgccagatcattaccctctgcaatgtggtcataggaatagtattgtttcccttgcagacctttacatgggtcgtataccttaacatcgccgaagcgagcgtcaataatgatctgatggaaaagtccaggtaactgcaaagaaggtacagttgcaagatacaagcgcccaggtcggatctggtgcataccggcagtgatatgcggctgcgcaaagataccgtatcgatatagataactagcaacatcaatatgtccatgaatataatcctttgtgaactcgtcatatacctgctcagggtctttgtcaagaagcatagcaaggcaggtagggatgcaagccattatgcttttctgagttttatgcttgattggatcgttgatagtaatcatcagaacacttccttaaacaaatcaaatttaacatgctcgtagattttattcagctgagttagcttgcgaataaattctttactggtattctcgtcaattgcacaggtatccgtctggatcttccatgtatcggagcgcaaacgaagcaggaatgacccgttcggataaaccgttttcgcttcgggcatatagtgcaaaatgcaggatatcgttccttcaggtggtataagaacaatataagtatcattcacatcggtatgactaataatccaaccgctctgtaataaagcatcacggagctgacaatacattttcggaataacgatatctttggccattattgcacttccacaattaacaattcaccatgacgttcacgagcgagattatataaatcttgtttctgctcaatacttaattcgcagtcaagaatggcaatatcacaatggaagccgctcgtacgaataacagtgtcttcatacgagtctctgcgatgagcaaccaaacgaaggtggaaacgatcaaactgcaccacagatgactcgcgcgacagttgcacacagcgaacgaactcagaatcttcgcgcaacacttcttcgagcttccggcgatattcattagcaggacataaaacaaaagcgacacgatcgtctttcagctgtggtcgtaagatagaccaggctttaactatattctcgttcatataaacccctttaacgttaacggaataactataacaggatacgcaagttgattaacatagccggccgcaacaattaataaccacagttagctgtctcgtgtgctttaaatcttgtgcggcaaatcagttacacatataggaaaccgaatcttgtaaacctgatctcgagtatttacatacggaattaactttatacgaacaatatagggcaggtgaggtggggatataaagtgtctagtgacgagataatctacaaacgatgaatccttggcagagatctaagagccgccccgcggcgttactataacgtcccgtgatcgtcagtgaggtgattgttacgtgatgtgactgtcatgcgctctactataacgttgtttattgttgcacgcgttattattttttatttgattagtatgctatctattacatgactatactataccgtccagtataattacatctgttactatccacctgcccactatgtgtcacctatgtatcccccgcctggtgtgttcggcgcgtgctgttacctggtattttcagcagactcgcgctacctggtatttccagcacaccatctaccacatagtcccggatgttattattatgaaacacaactaaaaaagttctaaaatgtcgcggataatagttgcatctgataccctgctgtcatattataaacacgtggggtaaagggggttttaaagcgggacacgggttccgcgcccgcttcacccgaagggagattgcattatgtccattatctatttaccgcgttccatgtcccagtccatgatcaccaagcgtattatcggcaagcgtctgtatcagctgggccttactgcggaaaaagtcaacggggattgggattttgacgagtatctggtaatgctcccgggaaacgaaaagtattccagcaccgcgttatacattcgcattaacgaggacggcactgtcagctcttatagcgtaatgtatggtagaccagtatgtcaagcgaatagcctttggtctgtgttctgctttattacaatgatagccaaagctatccaacaataatagcgtgctaatggttgcccattgttacagtgggctcccactagcaatccgctagatcaacatggagatatttacaatggcaactatcactcgcgtagcaaaagacgctcgcttcttcgccactatgtctaacgctcgccgtgccttaaaaaaggttctggatgtggacactgcgacagccaatagctttattcaccaggaatctttcgaagaaggtggccgctactggttcagcgaaagcgcggttaataaggcagctagcgatctggttgaagctgataaagcgactgtcgtggaagtgaccacacatccagctccggtcgctcccgtcaaaggtaaaacgcgtagcgaaacgcgcaacggggtccgccgcccgattaaaggtaaatgcgcagacgtttggaacgctctggatagtatgttgcctaatggtgtgccaactattggtaacgtccgtgaccttgcgaaaactaatggttggaatgttaataatgcaacgattgaattctacgcatggcgcaaattccacgggctcaacaataaagggggcaattaattatgttctacttattagcgttcttggtattcggtgctccaatagttgcgggtctgtattatacggagggtaaataatatggaaactatcgttctaacttgttgggttgacctggacgaacacgaatattgcgtgaatattaacaacggaccagtcccggacgtgactttcgcatcctatgacgaaatggatgcgtatgtaaaaggtttcaccgagtgcgctcgcattgcaaatattaacgtgactgtaactttaccggagtgattatcatgcgtaaacctaaccagaattctttcgttgaaatggctcgagttgtgttgaaccgtcagtccttctacctgtaccaccgccacgagtttgatctgtggaccgaagaggaaacgtgctgccagtacgagatccacactcggaatggtgtagtattcacttccagtgactatccggaagttaaagaatactgggacaagttgatttctgaagcgtatgctgaatttcagaagcaaactattcaccctatgggccttcgcgctgagtaattattaacgttaacataatttaaggagtgactatcatggctcaagctattatcaccaaattcctggctccaactatgtcccgtggcgatcgtgtgaaagcaacgtgctggaatagctccgtgactattgcctggagttaccagttggacacatacggaaaccaccgcgccgcagtggaagagctggtcaaaaagttaaacgctaaaatggacgccgagtttaagattgtggctggtggtgagctcccggatcaaagcgggtactccttcattattactgcataagggtataattatggaacgcaattatttccattttatttatcgcggtcgttgctatcacatccgcaacaagtttcgcaacctaacccgcgatcaacttgagtacgctattaatctggtgagtgatggtcacttcgctacactatcagaagcgttagaatatttgtccgctgagtgacatatacattgcccatagtaacagtgggcaataatatgcactccgcatagttaactgaggaaattattatgcaggctatccatgtaaaaacactgtccgctaccgaaacgaaatgtcgtcgctataaagctgccggtcttgatatgtgtgtcgtcacccccatagactacagactcaacagcgaagcgaatgcagcttatgcagcgcaagagctggtggaccggtacaacgctcgcgcccagtggaaggttcgcattattggaattggtacgcttccagataatacctgggcggtattattagataataaataacttctaactgcattatacaatccgcgccctgttgaagtccaacggggcgttttcgtttttgtacccgcaccacctcccgcgttaccctgctgaccacatattcctcacccataactccaccattcgcgctctaagagcgtaaacccttcctccgtatattaccattgaaacaaatatagtcgccttatacgcgcttacagcgatccactccctgcgtccctgtacgcgattttggggcattttcacccctcactgccacccttacaccgatccaaccgtttaatcgcgctacgtgccccgttttcgcggctattttcgctttatgggcgactcgctaccccgatcccagccacccaacctcaccgaaaagccggctttgcccgaaaaatccggcatttataccataaaatagaatcgttttcgggctacaaaatttcaaactcgcgaatcgctttcacttcgagagttacctcagcaaaaatcgcttgcaatctacttttcttttgtgttagacgcgcggacgtatataaagtaatctttcgattggttagaaaacacacagtcgttgcgcaacaaatatatgtcatattgctcatatatagtcgcttaatgtacgaaatgaaaggggggtaagtgcatgaaaaataaggtaaaaatgtgtatgtgtgtgtatttatataaattttataaagattttttgtttttgagttgtctactgacgacccctacgggacccctttataaataatataaattcatacaaacctcccaaccctcaaaattttcccttgtttttcatacacttcgcttcgcggtttcgtatgttgctggatctttataaattgtgcattttttcaccgatctttataaatttgcaatttctcaccttcagactgttgtaattttttgcaaacgcaaaaactttgcacatacaaacaccgcaaaacatcacaattgcaaatagcaaaaactttgcataaattaaaacttggcaactgaatttcaaaatcaatcgattttatttaatcaagggtgaggttatgcgcaatcgtaatattgaaataacgcacgcacacgtacaggaaatgttcggttacgacgaacaaatgtatgccaaagcggtagccatattagaacagcacaaagaacagcacaaagacagtataagcaatgtggtcaaagcgtggaaggcggctggcctcgtgttgcggccgaatgcggtcaagaagttggacgacgggcggaagtatatgtgctgggcggccccgatgttgggaatgatgtttactgttgacatttacttcgggtactggttgttagaggtggattgtgtgattccgcttgacaagtatatgcacagtaaagggttcaacagttgctttgacgtgtgtcctgatacggaaggcaacggtgttatgattctgggctttaagtgggtgggcgataagtgtgaagttcggccgctgcgatacccgcgtggtaaagcacgtcgtgcgtatattgaagatggtgttgttcgctggtgtgatgtacagaagcgtcggatgggtgctaaccacattacacatatcaaggaacgcctcgttagacttcagacgaataatagtggtaatgtgcagttacagcaagaattgcaagagctcattgaatacattgatcagtttggagcgtaagatgattggcgaacaagatgtgcttcctaagtggtatcctgattatcgtaagtcagatactttgatgcgtattcaatttatcctaaaccaccagactgacttttcattgtatttaagggaggagctccgccgaacagatatgaagaaactgtgggctatcaagaaacgtcttcgtttaaggaagcatcttgatggcctgcataaagttatgcaacagcttatacggtatagcatccgtattgaagaatcacgtaaaatctggagggagtgatgcaaacagtaagcaattcacctttatataaagcaaaggtgcgacttcttgaacaggctaaacaggtagacccgaatacaaatccggatttacttgacgctattgtcaatgcgatggaaattatggattttgcggactttctgttccatcgcgtgtcgcacgtcgccaaggctttaggttacacgggtaatgtcgaagatttccaaagtgcgttcgaataccttatgcgtaaccgcgagaaggcgctggtggtggattatcaatatcaacttatcaaaaataaatcgaagctcgagcgtctgcttcgtgagactttggaactggtaacgggaggtgaagatgcaaattaatcttactcagaaggctgtgcgctacttcggtgaagtgttctttgttccagtgtgggcgaaataccttgctgttgacgaggatggtactttaactgcattcgagaatgagcctcagtggtgcgaatgtattgatggcgatggtttttgggtattaactgagccgggcattgaaatcgatatctgttataacgtggacctggaaggtgtggatttcaaagaaacatgtgttaatattgactataaagtaagcgacaacccgcatgaccacactgaatggttcgaacgtatgcgcaaagacgatcttaagcgcacattgaacggacaaaggacaccaacatgtggtcaactgaataaagaaggtgataaggatgagtaaagaactccagactccgttaactcaagaagaaattgatattcttcagaccgacatccttactttatgcaagcgtatcaaagatgcgtatgaagaaggattatttgataagcaatggaaccaggaagttcagacagatgaacaactgtggaacgcgtctactgcgaaacttatccatgacgcattgatcaaacaagctatggagcaataattatgattacagcacaagaagctcgtacaaatagtgaaaacttggataccagtgcgtatcttgatgatttggataaatggattactaaagcgtctctagatggtagggatcatattaaattatttaaaaagccatatagtgaaattggtagtcctaatgcacgtcctgtaatgagaaaggtgactgaacaactggtatcatttggatatacaatctcatataagcaaccattaagtcggctggatactgaaagtgtagaaattttatggtgattatagggtgagttatgctagtcaaacttgttgttgatgttaagtttgaagaaccaattaaaggtcagaatattcatactttggaaattggttcttttgatgtaagtaaattttttaatggtggaactaaattctttaaagataaatccttagatctaccatgtgatattaaccacaagttgccttctcagtcttctgcaaaagtccgtggaaatgggcgtatcctgtcttttgctgactctatgaaagattgggaagatttaaaatttgttgttagcgcacgtatattaaagaccgaatataaggtagcttctgataactatatgaaatatttttatccaagaatcatttttaaggatcgtataaacatctctaaagaagagataatgtgtaaacctatcacctgtcgttgggtcttagtaccataatttgcagggggttagccccctgccgatccatcagtatatactatgtgtgtcctaatggatcgtaggagaataacatgtcagatttaattacagttcactattatggttcagatgtagaagtgccgaaagacacgaggtatattgcaacagattctgatggttgtgtgtacgcatttaataatgacaagcccgtctttaatgaaaaagtcggtacatggtgtgtttacacgaattcttttaagctggtagatgtcaactttgatgttgtaccatcacgttcgttatttgaaattaatcccgctacgttttaaggtaataacatgctggaactttttcctcaagaaattaaacaatacgaacagtgggctgtctgcggtttccatccgggtacatcatcagaaaaacaaccttatgtatgggacgatgatttaggggatatggtcccacttcgtaaagacggtaatgataagaaaccgtctaacctgcatttacttatgtcttttgaagatgctgaacgctgcgttcgttattataacgagattggtcataacttgcgtttaggtttctatctacttccaagtgacccgttctgttgtatcgacatggatattaaagataccatgtcggaaatggaaaagaaagttgctggtgagcgatataagaagattgttgaatcgttccatagctatacggagatttccagaagcggtgatgggttgcacacatggatttattccatccctcaggctggtaagcgccgtgatggtgtggaagtgtattcccagtatcgttttattatctgtacaggcgatcactgggatgttactccgcgcactgtgtctggtgctccaggcagtgaaagcgaagggtatattgctaatctcattcatcagcttatgtctgagatgagtgagattaatgagtctgatggcttccaaatgctggaacttactgaagaagattttagtaacgacccatatgcaatggaagaccaggatgtctatattcagttgtgcgaacaagaaaacggaacattgtttaagcagctatgggaaggtcgttggagagctgaagaagttgatgcttctatcggtgaacgttgtttcccttctcaatctgaagcagagtttgcattaattgactttctttgctttaagagtaagtacaatttccaggtaagacgtctgttcatgtattcaccgatgagtagtcgttacgatgattcccgtcgtctgcctggtgaaaaaatcaaacgcccgtatcacctggatagaatgattcgcaactatcgctatgatgcccatgtcaaatctatgggacttatgcagatagttcagaataacgttaatgcagctatagagcgcacggaaaaactacgtcaggcaactacaccagaacgcccacctgaagaagtgttgaccacagatggcaattacactgaagagcaggcggacggtttggcttggcctccgggctttatgggcgaggttgcgcgtaatatgtataaagcgagcttgttgcctattaaagacattagtattctgtctgctcttgctttatttagtggtatgtgcggtaaggcgtggaacacagtcacacgaagtggtttgaataactactttgtactgattgcacgttctggtattggtaaagaagcgtttcgctctaacattgaaactattctttctcaagtatccaattatggcggccaggacgggcagcagatatttggtattgaacgtgtcctggatacaagtacatatgcgtctgatgctgcattgcgtaaagacgtcataatggatacgtcagttatgtcctgtggctcatccattaactataagactgaagtcggtgcatttttccgtaacggtaagatggaagttggtaaagctaaagacattatggatgaaatgctttccctttatgacaaggggcatttctatgctttctctggtggttcaaagcactctagtaaagataatacgactgctggcggtaaagttaaggcgtatagttttgcaggtgaaacgacaccagatgaattttacgggaacgtggatgaccgtatgatgtcgagtggcttcatgtctcgtattatcgcatgggaatgtacagctaaccgcccgttgatgaataagagtatgctcctggaatatccagaagcaattctgcgcactattggagctatctataaacaagctgtgcgtattatgtcagggactgctccatgttatgttgaaatggaagcagaggtacacgaagcgtttgataatcttgataatgttgttgcgaagttcctgaacagcggcaatgatggtgagcaggtgcaagacgaagtaattcgtcagatgtacacaaggaaggctctgaaggtattgcgtatagcttctcttcttgctgttgcggataacagtgaacgacccgttgttactatggaacattatcgttgggctgagtcatttatcgatcagggtaacgagcgtttcttagagaagcgtaatagtgggcaaattgggtctacagacagtacaagccgcgagaaaataatgcttgcgactataaaaaggttcttggacggggaagtgaaggcttatgtgtatgacaaattcccaatgtttaaggactcatttatagttacacggagtgatttatgtacttattgtaggcaatttaaagcgttcaagcagacaagaaacgacaacatattgcaggtcatagacaatacaatttatggtctgatgtctatggaagttcttgctgaaatgaggcctatggacttctcaagtttattcggtcccgattttgtaccaccgaggatgaagtgctatttagtggatatcgaacgcatggagaagattattaagctataaaaaaaaaatgggcgctatatgcgcccattatattattcgtgtaactttaagaacccacatacaacgtattcaaacatctcgtcgtaatctggtgttgaaaaatctccaatgtgatactcatctttctcaaatgtgaccacagttgaggatcccatatactcgtatctaattttatgagtaccatcggtacagttatgtgagaattcctctgatttgttcattgcagttctgatgtttcttttaataagatcttggtgagtcattttgtgttcctccgcttacaaactgtataatacatactatagagcatttccttaggaatgcaataggtatcaagaattattttacgtccgagggtcaaatgtccagttacaatctagcagctattaaaattgtgtacggtgctctataccaggatgaggagttcccaggaattgagcaggcgatcaaaagaatcaagtctaatcgtattgactcggaacaactgttcgcctatgctttagccataagtaagaacgaggtccgtccttactacgaaacgctgtcacgccagttacgaagtgtaatagaagaacgtgacttaatgcggcactgtggatacaccttcttaacaggtagagccatacgtgtcagcaaataaaagaaaggagttaaaacatgcaaaagcatcaacctctttataaagttcgccgtcttggtggtggactctacgcagtagagcgcaacaaacgttccattacaatcgtaagtattaaagtaggatcacgtaaattctacagcgttcctaattgttcgcctttgttgccaacactgcgtgacgctgtgctgtatgtgttaactggtacgttcttttaactcggggtgattaaatgaagggtaatgttataagactttgtgctgcaagtttagcaagtaagtttggtttcggtgatggcgatattgttgattatttttgcgaggataacaatatcaatttagatgaaagggatccacaccaaattctgataaaactggtaagaatgtatttattaccagttattcctcatgttgaagtttatgaaattggcactatacacaatccgattcgttgcgaagatcaattcatagaagagcttcagcgcagtgacatttatgttgatgtaactatacatcaacttatccaatgtattaacgaaacagaaaaggatcctatatttatggaagatcaatgtaaccagtgtgaacagactgagcaagttaccgaaggccgtagaaaattcatggtgtcgtatagctttagtaaagctggtttacttactccaggttttggaaacgtaagtgtgattatgccagatgttagtatggagtcaattcaagaagttgaaaaaataatcaaggggcaaattgaagttgataaggtaatcattctaaatattattgagctggagaaataatatgtgtaataaatgtgaagaaatgatgacaatgatagacgaaagagtgttggtgtctctggcaatcattgaagcagcccagaattccttcatggaagcctatcgcttatgtaaaccagaatcctcattagatgaaattgagaaagcctggcagaaatcaaacacatgcagcgtattagctcatcttatgacgagcgaagaacaacctaaagagaatctacactaatgcctagcaaaatatacaaggtgttagggtggaagccttatacttttcgctcaaactacgacaaggaaatgaagtgtatgcagtgcccaaagtgtggtcacactgaatttacagaaactgttgtagctcaagttgatggatactattcacctgtgtgcgagtcaaagattaattgtaatcattgcgggcaagaggtaaactattgggcatacggttactacgaaccacatcatatggtcgcagatcgtagtatgtcgatgctaattaatcgtattgaagctaaattaaggagaattagtttaccatgagtaagaaaaccgatatccgcaatcgcaatgccgctattactgcttatcgtatgcgggagaaaggttttacttataaccacattgctgaacatcttggtaagaaaccacatcaaattaaatcgctcattttgttaggtgagcgcctggaatctttaaatgaggggacgacacaatgaatgtaactgtacgccaacctaataagaaagagaaggatctgatgatcggctttactatgcccgctccacttgtgcatatcggagcgttattacgctgcacaaacgcgaacacgcggcgctttacgcataactccgtgtatagagtgcatcgcactgtacataacgcccgtagcggcttagctttgcctgtggttcgtgatgatgacgggctggaagttgtctgtacttcgctgtcattttctatgggccattggaaaaaatgtactttatgacctgtgaattctgacgaattcgtgtattgtaatcaaacacgtaaacgggttaacattatttgcgagagtggttggtagattaccccttttcgaaggctgcctctcgctgacatgttattatctattatatgcttcgctttcgggggtacttgtgtaccccctattttttgaatggagatttataacatgggagctaatcctcgtactaaaggtcaaacaggtgagcgtgagatctgcaaattctttaatgatatctacgaagaagtttacgccgctcttggaatgacttatccagaaaagcccatagcacaacgtaaccagaatcagagtgctgtaggtggttgtgatatcacaaatacctgtttctatgcggtggaagttaaacgacaggagcagctatcaattaacacatggtgggcacagtgtgttaagagtgcattggaagcagacaagtttccagttcttatgtaccgtcagaataaaaagtcctggcgtgtagtcctgtatatgaatcctatcatgcttttcgctgatgaagcgaaacatcataaagaagatcctcctagatgtgaaatatccctggaggattttcgcatgatctttaaatcacatgcttatgaatatatcaagagaaacggccacgcttaggaggtgtaagaagtgagctgtgaggaaagtcccgttcaatggtgtgaacgtatgcaacgggaagctgaaactggtgaggacgcttatcgctattatcagttaaagcaacagtgggaacaacgtctgtctgataaagagagtgaaaaacatgactaacaaagacgatatgtctaatatcatcaaagatgtaactgtcaaaggtactattgcggttcaagatggtgctgtgcaacagctaatcgtggagctccttacggacactgctcaaatgccgcgatttgccactccaggttctatgtgctttgatatctatgcggatgaaccagagcccgtgactatctatgcaggtcgtgcgtatacgttcagcacgggtattaagctacagatccctcatggttacggcctggaagtttattcacgtagcggtcacgggtttaaacacgggattcgtttaggtaactgtattggtatcattgatcaagattaccgtgatgagttaaagatacgtctacataacgactctagtgaaccttacacagttcaggttggcgaacgtattgcacaggcacgtcttgtggagttggttcgtacgcgtattgtttctggtattgtaaaagaaacaggccgcggtggttttggttctactggtaagttgtaataagctccgagggtatttacatcaacattttagttgggtaacataccctcattaagaaaaggagctagaaatgaaaaagctacttgttttgttaggattagttgtatctgtcaacgcgaacgcatatacgttcaattgcgaaactgtttcagacattgcaaataaagacattcttattaagaatgagcgttacaatattgataagaagtacgccgataacgtcattaagactagcatcagtctgtgtaaagctgcaagaacagcttcagaatccgggatgtccacgaaggaagtaatgcagttcgtagaatccacaatggataacaagaatgtgagtagtgacattcagacaagaaacttcattactgtatctttatctttgcaataaggtgataacatggtccagttaccagaaatgaacttaactgaagagcagaagtacgagctcctttacaactggtattctaagaaagaagaattagccaaagtgcaagcgcaagaacgcgcactgcgccaaagtgtggttagcgtcttctttcctgatggtcttaatgaaaatactaacaagatcaaacttgatacaggtgatgaccttgttgtaactcaaccttatacgcgtaaagttgataaggctatctttagtcaaatccttccagatcttgtaaaagctggagttgacgtcaacgaagttactgaaactaaagtggaacttcgagttgctaaataccgtcagttaacaccggaacagttggcaatctttgatgaatgtgtgaccacaactccaggttctccacaggttaagatcgctgttaagaagggttaaatgctcatcacgataatatcggatgcgtcgttctgtcaccgtactaaatgtggaggctatggaatttgggtagcctccaaacggggtaagaaggcttttggcggctctgcacatggtcacacggataataccgtagttgagtgtattgcagtagctaacggtttgtatcacggtatagaagctggacttatctatacaaacgacgttatattgttccagacggattgcaaagcagctatccatatgttcgaaggtaagcgtccaccgagaggagaagaacagcaagtatataaatggttcatggatactattgtcgagaatagacttagtttccaattccgtcatgttaaaggtcattcgggtaggatggattcccgtagtattgcacaagacaagtgtgatgaaattgcgggtatgcacatgcgaaaaggtagacgacgcatggactacgataagttaaaagtagatacagcaaaatccgttattcctaaaccgaagaaagttaacattgagaaacagcaatcttgggttaggaagttaaaacttcttgttcgggaacacacaaaggtaaatttcaatggctcgatttaaaccttatctagcaacagattgggattcagctaaacagaaataccctgtaggtatcatgcctaaaattgacggcgttcgtgggatgaaaccgtttggggagcttgttggacgaagtcttaaatcttttgcaaataagcaggtcgcaaaggtatttggatctcccatctatgatggtatggacggtgagcttgccgttggggacgaaacggactttgatttatgtcgcaagacaagtagtgcaacatctaaaattgaaggtgaatacgtttggacgtggcatgtgttcgatttgtgcgaaccgaatgttgcacatctaccgtacaaagagcgttatgatatgctcaagaagtacgtggacgaatgccatgctaacggcgagttgatggacgtgaaacttgtgccgttgtatgtggtcaacaacgaacaagaactcctggagtgggaaaatatttggctcgatatgggatacgaaggcgttattattcgtgaccttgaagcgaaatataaatggggtcgtagtacgcagcgtgaaggcggttatctccgcatcaaacgtttcactgatggtgaaggcgagatcattcgtatcattgaaggttgcaccaacgcaaatgaggcccagattaacgaattaggacagacgttccgttcatcccatcaggaaaatatgattccaaatggtatggttggctcatttgatgtacgtgtgcttacagtaccagaaggccttgaagatcttattgaagtcgggcaagagatgcgtgtaggtgctggtcgtcttacgcacgaagaacgtaaatattattttgagcatcctgatgaattcattgggaagatttctaaatggaaattctttgctcacggtatgaaagacaaattgcgtattcctacgcatcaaagtttccgtgatccaacagatattagtgaataatcacgtttgcattcaggttaattaggtcctagtattgcaaccgtaaccacacaaggaacaaattatgcaatttacaactaccgcgcaggcagttttggacactggtgtcaagatgcttgtgtatggtgaatccggtatgggtaagaccatgcttacagcaacccttccaagaccgttgctgatttctgcagagtctgggcttctgtctttaacaccgaataacattgctcgtgtgtttggtgaaaacagaccagatatctgttacgatattccaaccatcacggttgaaaatattcaggatgtggagcaggcttatgtttgggcgactaaccctgcaaacaaccctgtaggtgaagatggtttaccgcgctttcagtctcttgcgctggattcacttactgagattgctgaaaagtgccttaacaatgcgaagcgtactgtgaaggatccgcgtcaggcttatggggatctcattgagaagatgcaaacgttggttcgtgcttttcgggatatccctggacttaacgtatacatggcagctaaaatgtcccgtaataaggacgagttaacaggtattacgtcttatggtccttctatgcctggtgcaaaattaggtccagaattaccatacttttttgatgaagttttcaaaattagtgttggtaaagaccaaaatactcaagcagattttcgttatctgctgacaagaccagatctgtcaaatgtatgtaaagatcgttctggttcgttagaacagatggaatatccacatctcggtgcaatcattaacaaaatcaaaggggtacaataatggccggtttaggaatgcaatttaacgctggacagcacgcagagcgtcaacacaacagcttgatgcccgctggttggtatgttgttcagattgtaaactctgaaatcaaaccgactaaaactccaggcggtgcgcgtctgaatcttcagtttaagattatgcagggtgattttgctggtcgtgtaatgtttggaggttacaacgtcaagaacgcgaaccctgtcgctgtacagattgcaatggaagaactggcagagctgtcccgtgctgttaaagttccagtttggaacgatactgaacaactgcacggtattccgtttaacctgaaagtgaaagttcgtcagcaacctggctatgagccaaacaacgaacctcagatttatcaagcaattgataacatggaaggtgttgtatacgcaactaaggcggatatggctaacctgcctaaatcaaccccagcagcggcagcacaatctccagcatttggtggcggtgcgttcggtggtgctcagcaacaacagcagcaaccgcagcagcagggtttcccgggcgcatttgggcagcagccgcagcaacagcagcaacaacctcagaatcaggggttccagcaaccgcagcagcaacaacagccgcagcagccggtacagcagcaacaacctgtacagcagacgcagcagtctggaacagttgactttaacagtgcggcacaatcccaaccgtgggctactggtgcgcagcaacagactcagcagcctaactgggcaactcagcaggttcaaccaggagcagagcaaccgcaaactcaagctcagaacactggtactgctaaccatgcagaacctgaagtccaggacgatatcgctaaagcagctcagaccaagactccaccgtggaaacgttccactgaaggcgatgacgctgcacagtaattaaaaatcatgttataataaagctcctccgggagctttatttttctatataggattatgatatgccacatttttatcctgctactaagacaatggagttattcaatgactgtattgaacgagatcaaggatccgcttacagagtatggctcggaaaagtattaccgcatattgaagacgcatatagagagggagatggcggattccgttcgcatcttgggattagtcttattgggcaagagtgtagcagagcaattttttacggatggagatgggcaacaaaaccacactttaacggtaaaaccttacgtctattcaatcgcgggcatcttgaagaaggtcgcttcgtggccttattacttaccgctggtatgcaagtcatccaacaagacgaaaatggcagccagtatcgagttagctatctcaacggacactttggctctgcaatagatggtattgtcattggttgccccgacatgccacaaccttctacaccaatcttgacggagatgaaaacgcacaataacgattcgttcaagaaacttgtcgttaatggtgtgatggaatccaaatgggagcactatgttcagatgcaggaatacatgttgtattatggactcccagccgctctttatattgcagttaataagaacacggacgagatttgggcagagcttgtaccgtttgataaagaaaccgcagaacgctacaaagaccgtggatttgtgattgcgttggcggaatgtccaccgcctaagctcaatgaaagtaaatcttactataaatgcaaatggtgtgaccacaaagcagtgtgccacaacaacaaaatgcctgaagttaactgccgcacctgtaaacactcgtacccgcttgaagacggaacttggagatgtgcaattaaagtagcttctgccactgcatacatcaccgatggaaccgaaggtgtgttaacgaaggaagaccagatgaaagcatgtggtcaatacgaagcagcagattattacggtgagtaaatgttcaaactacgtgattatcagcaagaagctgtaaacagtacattgcgctatttcatcaagcatggtgaaaagtcaggaaatcctgttatcttgttacctacagggactggcaagtcccttgtaattgctggtctattaaagacaattcatgataattggggtagtacccgcatgatggtaattactcacgtaaaagaattgatagaccagaaccacgataaatttaagaagttgtggcctgaagcaccgactggtatttatagtgctggtatgggtcgcaaagataagaacgcaatgataacgttcgcaggtattcagtctgttgcaaaacaagctaaatacttcgaggacgttgatattattatagttgacgaatgtgaccttattagtccaaatcaacaaacaagttatcagaagttctttgcgcatattcgtgaaaagaatccgtatctaaagattatcggtcttactgccacaagctggcgtcttggttttggttctattatcaaagatgattatgcgcctaacgctctatttgatgaaatcgtatttaacgcgtgtaccgtagagtgcttcaactggttcattgatgaaggttatcttgttccgttagtaccacgcaaaacaaagaaagagtatgacgtaagtggtgttcatactcggggcggtgagttcattgaaagtgagcttcaaaaggttgtaaacgatcctgatgtaactcgccatttattagatgatgcgattagtattgcggaagaagagaacagaatgagttggcttatcttttgtgctggtgtagaccatgcaaaagatgtaaaagactatctcaatgaacgcggtattagttgcgaagttgtaactggtgatacaccgaaagccttgcgtgaccagtaccttattgactttaaagctggtcgtttgcaggcaatagcaaacaacaacgtattgacgacaggctttgaccatccgggtcttgacttgataattggtatgcgcccgtcccaatcttcccgcctatgggttcagatgcttggacgtggtacacgacctgattatgcagatggttttgatttgaccacaacagagggtcgtttgcaagctatctccgcttcgcataaacagaactgtcttgtattggactatgcaggtaacacaagacgccttgggcctattaacgaccctgtaattcctaagcgtccagggcagaaaggaaagaccgctgcacctgttaaagaatgcccagtatgtaagacctggaaccatgcgtcggttcgctattgcggtgggttaaaaccattcgatacaagtagtatgtctcatgaggaaatactctatctacaaggattaggttataccattacaaataataaagcgtgccgtgctggttattgcggtcatgagtttacttttgagaagaaactaatggcgagtgctagtacgaaagctattatcaagaatgatttaccagtcactgaggtattgaaagttgatatggtaagttactaccgccacgagaacaggggcgaccgttctaagccaccaacacttcgtgtcgactatctttgtggctcacaaactattcaacaatatatttgcctattccatactggctttgcaggtaagaaagcgcgtaactggtggcgtgaacattgcagcttggcaatcccagctaacattgacgaagctctcaatgtggtcagccagcttcgtgtaccgacgcacatttatgtcaacttgaagggtaagttccccgaagtgttgaacagttgttacgacggtagtgagttcggtaagaaagaagcaacaaacgaacgtccggttgtacaaattgcagcaatgaatggtctgtcccagtttggtggaagttatacgaataagtttgatgaagatgagcagactgattcccgtacgacagtattgcattctacgtctaatcaacctattcttactggtaacggtaaagaactaccaccagactttgatgacgacattccgttttgaggcttatatggcaaagatgacgtttagaagtgacgactattcaccggaagatggtgaatggaagacttttaaagagtgggaggcgttaggttacggtgtaattaaaggagaaagagccaaacgatttattcatggtgtagcagtttttcacgaaagtcaagtaatcaatattgaagatgagtttgaaaattacatgcgtgaagaactacgtggaatgtattgtgggcctgaatggtggaaggattaacatgtacgtcttaattgattatgatcggatgcaggtattagccaagcatccaaacttccaacgtctccatgagtatggaattctatgttgtagcgaaagttctgtagttcttccgttagaagttgaagaactgtataaggagtttgatgatgtgcaaatgcagcttttgtacatcaacttaacgggtaataagcaaggtgctttatatccaaagaaaatgatcagtaagatcatccattactttttaaatgaaataccggagacagtaatagatgcggatgtggctgaacaagcggactgggcaattgctagtaataaagagggtgagtgcatgtaccgcgaaggcagctctgttccagatttgggggaggagcctaatattcaagtacggaatgatggttcattggaatccgccatcattgacggtccaaccgtacaaacaaatatgggcatacaaggggcatggacaccgacaagagagcggcaaggtactagcgcaccggcaaacgaaaaacgtgccgcaacgtcgcgtacagccggcactcgcgatattattttcgctgttgctgacgaaatgtggaaagaagctggtgaacctcgtgacaagaaggaaatccttcagcttagaaaacaaatgatggatcgtttagaggcacaaggtgtgaagcgtaatacatcaagtaatacattaggggtctgggtaaaagaacgtggcttaaattaattaactaaaatattgcatagttcttttagaggggttatagtgcaaccacttagaacgtagttcacaaccaataaccacactgtgaggatttaaatcatggctaaagagaaaactccagaacaactggaagcagaagaagcagcaaagaaagcagcaaaagaagctgaagcaaagaaaaaacgtgaagctgaagaaaaagcagcacgtgaattgcaggctaaagttgacgctgcaatgaacgaagccactgccggttacaatgtgatcgaaggtgctacgtccgctgttaaagaacagttcgcgaccctgaacgaaggttcattgctggacgaagttaaagcagttgaaggcgtagttaccgctcaactgaagaccgctaaagaaggtctgaaagctgttaaagcggcagcacgtaaagttaaagacaacgatcagctgaaaactgccgttgcagcatctgaagatctggtttcctccattgaatccactctgaaagatgttaaaggccgtgtgtccgctgcccgcgaagctactaaagccgctgaaaaagcgaaacgtgacgcagaacgcgctgagaagaaacgtctgcaggacgaagagcgtgctcgtaaagcagcagaacgcgaagctaagaaagagcctgaacagaatggtattcgtaagcctggtgttggtactctgtgccgtgctgcatgggatatctttgacgctgtgaccctggagttgggtcagactgcaccgatcagctacgttctgcctgttgcactggacaaaggcctgaacgaagcaaacgtcaaagcggaatatgctcgctggaaaaaatacatgggcattactggtcgcgtatccgttccagtacctgctaatattgcacaggcggccgctaacgtagaaattccgtctcagaaaactgcagagtaatctgtagatacttcggaaactcagaaggggcatttactgcccctttgttatcttaccccgaggttcaaatgtttgcacaagccattatcgcccaccactgggctcaagccaaatttggaaatcatatgaaaattattaatactcaggaacctgagaagttagttcgtgaacgtggtattcttgatgtacattccatttttcataccattcaaggtgaaggcccattttgtggtcaacctgccgtgtttgttcgattagctggttgtaatctgcaatgcccaggatgtgatacaaactatacgtccaatcgtaagaagatgagtcataccgatatctggaaagagattgtccgtgttactggtgaagctaagactgaattagttgttattactggtggcgaacctttccgtcaacctgaagttgttaattttatcaactatcttattgatatgaaaggataccgtgtacaggttgaaactaacggaactatgcctatcccgcgtgaactcaactatagttgtgtggtagtatgtagtcctaaggcagcaaagattcatcctagtgtttctgccagagcagacgctttcaaatatgtaatgaaaagcggaaacgtcaacgaggaagatggattaccgttgcaggcactggatcaccgtgcaacaccatttatcgcacgtcctccggtacactttaaaggtgatatctatcttcaacctatggatgagcaggatgacgttgctaacaaagcaaacgctcaagctgttgttaaatacgcaatgaagcataattacatcgtgcaattgcagattcataaatatttaggtgtagagtaaagttatacatattcaactaataaggtaaattattgtgaataagcacgttcaattactcggtgaaatcgttccagaaaatgtgttgaaccagtgtctgtttgatgaagacggatttgtaaaacattatgtaaccacagtttctcaggctgcgtcccatgccgctcttgcatctgtgattcgagaagggtatatggtggatgttctgaacgatagttgccctgcactcactgtctttgttgaaggtatggatggacacgatcttatgaacttaaagacggtctacaacacgcatgtaacgcctccacgtaatgcactttacaaatggcgtatcaatacttctgccagaagaagtcagaaagcagaagaggaagtggataccgtgaagcatacgacgtctactcagaaattaaccagtatcatggacgatctacttacgaatgtctttaacgttgatcatgacaaagaaggtaatcctgaagtattcattaaagaaacgtttatcgacaagggttgtatccaagagattaaagctccacgtccgaataaatatatgcgcaaaattaaaacttttgaatctcacgacattaatggtagcccaatcgaaattgatgtatgggttgacgtgtacgacgtaattaaagcattcaatgtaaccagtgggcccatgcaacatgcactgaagaaattgctgtgtgcgggtgagcgcggtcataaggacttactggaagacctcaacgacattattgtatccgttgagcgtgaaattgaaatggttaaggaaggtaaataatatgtgctctatctttggtgttattactaacggtcaacctgaaagttttattatccgtaacgacattgaggaccttattaaagctagtatcaaccgtggtcgtgatggtcttggtgtacgctttacgcatggtgaccacagtatgcacccgcaacgtattgttagtgtcggtaagaaaacatcgctggaacgtcttgttaaagttgggcgcattgtatctcatgctggagctattggtagcttcacaatgattggtaacgctcgcgctgaaccgactacagagtgggtcgttgacaagaatgagtgggaccagcaaccgtatcatatggatggttggactattgttcataacggtactattgcgaacgataaagaccttcgtacctatgccctacagactaagattgatagtgctgcgatcgttgaacagttagcagaatatacactttcagcagatgaaatgtgtttgtctgactttaattacctgtacagtgtgtttcatgaagttattcgcaaattgaaaggtagcttcgcaatccttgcgacacatgattcctttccgggatgtgtgtttacagcatgtaattatcgtccaatctggattggtaagactgatactggtatgtatttcgccagccaggaagatatgctaccatcccgcgctattaagcaaatgctgaagccttattcatgtaatgtggtcacatccactgatgtatgcaatgaagttgatcttattccaaataagcagactcaacgcgcgttagttgtcgccagtggtggtatggacagcacagtagcagctcagatgtgtaagtccaatggtttagatgttactttaattaacttccagtatggttgtcgtgcagaaactaacgagttgaaggctattcgtaaaattgcggaagtgatggaagttccattagttgaattcccaatcccaatttacgataaaaaagatagcccgttatttgaccaagatgctgcaattgcgggcggtgaagaaggcgctgagttcgcacatgaatgggttccagctcgtaaccttgtaatgctttctgttgctactgcatacgcagaagctaacggttttgactatattgttcttggtaacaatttagaagaagctggggcctatccggacaacgaacctgagtttattaaccgctttaatcaggtgttaccgttcgctgtaggggacggtaagcgcgttgaagtgctcatgccagtaggtaacttaatgaagcacgaaattgtcgctacaggtctgcgtttaggggccccgttggagcacacctggagctgttaccgtaacggggatttgcattgcggtacttgcggaccttgcatgatgcgccggactgcgtttaatattaataacgcacaagaagttattaaatacgaaaacgaggaataaaaatgggttacactgttattcgttcacatgagatttgtgctgggcatcgtgtcgtagggcatgaaagtaagtgtcgtcaccttcacggtcacaactataagtttcactttaaggttgcgccgaaacatgaatgcggaaaagtagtgacacgaggaaagctggttgaggacggtctggacagcgttgggcgcgttatcgactttagtgtggttaaaactacgctctgccagtggctggaagataactgggatcataagttcctgcattgggaacaagacagtatgattaattcgctcattgttgttgcatcgactaagtttgcacgcgagaacaatttagtgacggatgaagattacgatcctttctttaattctttggtagctttaccattcaacccgactgcggaaaacttagctgcatatatggttgacgtaattggtcctcaactgcttgaccaatatgatgttgaactggtagaatgtaccattgaagaaacatctaaatgccatgttaactattgcaaataattgaccacacaaggaaactgtaaaccatgaatgaatttacaaagatgacaaacagagcagaaatttcgcacagtattgaaaagattttaaagctgatcgaaggtggcgatgatttgcgtgaaggtctggttgaaactccagagcgtgtagctaaggcttatgctacatggttcggaggttattctgtcgatatcgcatccctgttcaagacatttgaggatggtggggaatgctgtgatgaaatggtcattgttcgtgatatccctgtttacagtcattgtgaacaccatatggcccctattatcggtcgcgctgttgttgggtatgttcctaacggtcgcattgtcggccttagtaagttatctcgtgtggttgatgcttttgctcgtcgtttgcaagtccaagagcgtctgactaaccagattgcggacgctatcgtagaacacttaaacccgaaggctgtgtgtgtttacattgatgcaaaacatatgtgtatggaatcgcgcggcgttaaacaggtatgcggaagctctactattactaaagcattccgtggcgcaactgcgattggtgatttcggtatggaaactgagaacggttacatttggcgcaaagaattccttgaagcgtgtaaaaagtaactgatttgcgaatcatacattatctttaatataataagcgcctacgggcgcttatttgttaggtgaacaatgcacagacaagatatcgactatacctttcagatttatatggctgccgtatatacgaacagctataaaccaggaatgaaccgctatgtcaaactcaacgaacaagaaaaacgtgttgtcgagaatattccaaacattctcgaatcatggcactacgttggaaagcaatcatatgttgatgccatgcgtgccgatggggccaagatatttctcgactccggggcgttctcagcctacactttgggagttacgttatcggttaaagaatactgtgattacatccaacgaaacatagatattattcgtgtagaagatggttcacttatggcttctgtactcgatggtatcggggatccacttcaaacgtggcgcaaccaggaagagatggaagccaggggtgtaagacctttaccatgcttccacgcaggcgaaccttttgaatacctggaccattatgtgcgaaattatgaatacatcactcttggtggtcttgttggagcgagtacacaacaactccaggtatggttggacagggtatgggataaacaccttgtagacggtagtggacgcgcg

SEQ ID NO: 3 - DNA, 351003 bp, Unknown
  Myoviridae
ttcgtgcacgtgcaccaattattgaatataataaaaatattgagctaattaactacggtacaaaattccgtggaactgttgatctgttctctgatattattaaacctgaagatatcgttcaaaaagatattaatagtggtatacgtattgatggtattattccgcaagatggaatgcgtattctattcaccagtattggtaacaatggtgaaaacaatagaatttataatgtatatgtgaaaaaaatgcaagatggtactcgtgtttatggtttagcactagatccagaagaagaaaccgaatcacgcccaagtggtgaaccacaagatggtgatgttgttctaatcactaaaggtaatgagtatggtaatagttctatgtactggaatggatctttgtgggttcgtgcacaatcaaaaactagtgttaacgtattccctaaattccaactttatgatcgtaatggtatcaaacttgacaacagtactacatatccatcaagtaactttaaaggttcagagttgtttggttttaaaataaattacaactatgcaactgatagtgtatatggatataacattgaacttggtgattataattattacatttatgaaaactttttacaatcccaacgttatacctatgaccatcttggaaaagaagttgaaattgatggtttatactattataacattattgatgaaaataatgaaatgaatcttcaaaccgattgggttcgttcagaagagtactctaaacaatttgtaaaacaaactccacaagtccaacgtactgatatgtatcgtgtattcagtactgtttatgatatggaagtttttaaagaaccagttgatggtatgtatgcatatgttattgaagttgatagaacatatcagtactataaagctgaccgagaaacttatctagattggcatccaattactggtgatggtgttcagattgtaaaatatgaccatacattcgaattggcacaaaaagttttagataatgactctgatattattgaagttgtggttgatggtgttgatgtgtccaaatataccaaaaatgtttcaaaaggtcaagtacaaagcatcactctagatagtactgtagaattggatgaagattctgttattcaaatcagaacttatagcagtactgtaactcctaataaagaattaggtgcatatgaagttccaatcaacctacaaaataacccatataattctaatattatatacattaaccaaggtgactacactttacattttcaggatattattcaaaagaacattacacgtggttcttctgatgatttcaatgactatgaagaacgtttggctaaaggattggttaataatggcgtaggtactaaaattatccaaaatgaagcatctatgcttccattgatggcacatactgcaaatgaagatattgatttgtttgaagcaactatgtttatgcaatctgaatattttagattcattaataaatttaatacacaaatgcttcgtatgtatgatgaaaatccatcagactttttacaaaatagtgctgcaaacattgttgatgcaattttaactactattaatatgggacgtgatagttcattcccattctattatgataatgttggaagtacttctggattcattcgtgcatttataccaccaacaccacagttcttaggtattcttcaagcatatgtaccagaaaaagcgacattcctcactgctggtagtaaaccaagctgttataacatcagtcatactggtattatttccaaagcataccgtgttatcaatggtgttgataaaatggatgatgttgtatatgaattagaaaatagaatttttaatagtattgataataaattcaaagatgttgattacgtaccagtattgaatagtgatgaccttttccctacaccatatttcactaaaactgaatatagtgctgaagagaaacaaacattattactacgtggatacattaacttcaccgcaactaatggtatcagtaatagtacacatgattatgatcctaacaattggagaacttggaactatactggcacttattatgtagttaatggtcaaagtactgaaattcctgcacgtggttcatggcgtgccatttacactgaccaatatggtacatatcgcccagctacccatccgtgggaaatgtttggctttacacaacgtccaacttggtggaaccaagaatacgaaccaacggctgttcaagttggtgaacgtgatagtgatgttgtatatgtatatgaagcacttgttatgaatgagcaaggtgatttagttcctagtggtctttgggatattgacggaactattggagatagcagtactggaactattttatttggtgatcgtcgtggtcaatatgacaaatataaaagatgtggtgtacagccattcaaaattacaaaaactggaaataaaacatcttctggtattgatatttgtgtggttgaatatattgcacctgaaattttaggtttagtgtctggatctttaaatcatagagcagaaccttggacatatggtgatatgggtgacatggaatttacatacatgaacactacattgtttgcatatgaccaaatgatgcttttgtataaagctaaaccagcacaatttgctaactatttctgggatacccgcaatgataacttaaaagaagtattcactgatggttcacaattcctttatggtgatacacgtaagcgtattaattttgataaaaatacagtagttcatggtgaaaatagcacaagaaccattggttatcaaatgtttgtaagtgaccatttgatgtatcaaaataaaaatattaccaccaagtatggggatgtagttcgttcttcttatataaatgttggtcataaaattggaggatttactaaagcagatcagttaacattcaatgctaaatctttcggtcttatttcacaagaaaaccaaaccattggtcttgttcgttctaataatatccgtgatgagcaaatgagtgcgatcaaaattacttggaatggtagtgcatatcagattgatggatatgatctagttggtgctaaatttaaatataaacttcccgtaaaaaatggtagaaaagtaactcttaaattggaaaaccgtaatgttgttcattataatgaatggaagtctgaagcttcaattgaatatggtaaagttttcaatagttaccaagaagtttatacttttatttgtggatatggtgaatatcttaaagaacatggttggatttttgaagatgtaaatgatagtggtgctcaacaagattggaacactattgctaaagatttcgtgatctggagtcagaattctctagtaactggtgaatttatttcttgtaccccaagttctgcaaacgctaaatttggggcagactttggttcagtacaatctattacgcaaaataatggtggtgtatggtcattacttgatgataataaccaaggtattcgccaatatgaaattgaaacttctcgtattggaaatatcttcactgttagaactttagaatctaataaacgcattgcattgattcgtttaagtttgtgttcatatgaacatgctgttatttttgatgataaaactatttttggtgattacatttatcagccaacatatggttctattcaagaactaattaaaatgtatggatatattactggttcatggactggtcgcctacaagctcctggatttattatcttggaagctggaacactaccatcatttgaaaaattagtgtcggatttccaacattattatgatagtgaaactccagtaagtgatgtacaattacaagagttgtcaaaccatttgattggttatcaatctcgtgattatctacagcgtatgattagtagtgatgttagtcgtgttgatttctataaaggattcattcacgataaaggtactaaccaagttttagaacgtgtacttcgtgtttctaaatcatatgacactgatgaatataaagcattacaagaatgggcatttaaaattggtacatatggtaatattgatggtaagaaaaaccttcaatttaaactaatcaatgaccaatttaaacaacaaccacaaatggtatcttttgatgtaaacgctacttcaaatggaaatggaaacaatattgtatacttcggcgaacaaggtaaagatcctcgttggattacacgtccaaatggtaagttctcattcccgatgcgtagtggaagaagtgaaaacattcaacttccagatattggtccagtaacattggatgaagtatcttacactacaaaagatttcagtactgcatataatgaccgtataacttacactaatggtaaaggtgaaaaccctgaatctgtttggatgtttaaagacggaaatggtttatggaatatttttgaattagttgatactaatgtacaaatggtttctataacacctattgaaaataccgatgtgtatgctgaacaattttgtaaagtaactttaactgataatgtaccacttgaagatggtgattattattattttgttgatgaaactaactttatgccagatactttaacagtagaaagtcaatattatactgctggttctgatcctaaagttatggtagttccatttgacacttctattgatattgaatttactgatccagatacacgtccacgtttgtatcgttatgtatcacgttttgccagtgcagaagagcgtcaagcatatattgacaaaaagtatagttacaaagcaccacaaagtactttttttgaccgtccaactacatatgatgaacgtactaacattactgcattatatctaaatgtgtatgaccctatcaatggggttattcctggtgcagcaatgcaaaacgtaacttatacgtcaccaatagacccagcacaatataatagcaatggtgaattaattcaggcttggggtgctgataaagttggtcaagtatggtggaatacaagtactgcattttatttggattatacacgtgcaatttatgatgcagacggaaacgttgatattgatgcaactaatgaatacaaacgttataactggggtcgtttattaccacatagtaccattgatgtgttggaatgggtttgttctccagtagagccatataattgggataagtattgtaaagacgttgctaagaaaaacaaaaataatactatgtatctaccaagcggaaccgctcttgaagataactatagtacatttttggaatatgatagctcaactgatacttatgttacaaaatactacttctgggtacgtgataccatttatgtaccaccactacataccagaacaaaatcatgtactgatattgctcgtattattaaagatccatcacagttaaacattccttggtttgcaccaatcaatgaaaactcgtttattcttagtaatatgcagtttaaagttaatgatgatactagtattttgacaatttcttattacatggataatactgaagttgttaaacatgatcagtaccaactatgcaaggaaggtgatagttataactttaaccctctaatttgggattcaatgtggaattctttaattggacaagaaactactgaatcaggttctgtgattaatttattatatccagatgttgataacggtttaggatcaaacaaaacttggttccaaaatgttatagaagctcgtagaaactttgtagaaagtgctaataattattatagatcacaaaacataaccactaatagtgttgttatggaagatgtgtttaatgttaaaaccactgaagttaaccctaatgaagtttctttccgtgtgttgtcttacaataatgaattagttattgcagttgaaagtgataaatttaaagaaaatgacgctgttattttaagtactagtggatatctaccaaatccattaacttctagtgctgtttattttattcacttcgacgaaaatggatatattcagttaatgaatagtccagcaaacgcgggtagtgttgttactataacgttagaaaacaaaggtgagggacaacataaaatgattaaacaatctgattatgttgaatcactaggaacctcattagacatgactcagtactggtcatatgctgattggtatgatgttggatatgatagtaacacgacttatactcaagagtcaagcttagaagatgctaatactaaaaactaccaagttggcgatattatcagagttaccgatagtgaaaacatttggacattgtatattaaatcacaatcacgcgattcaatttattggaaagcgattggtcgtgaaaacagtacagttgaactcaatgatatgctttacgcagattatagtgttcataatgataatggttcactaagcaatcgtgaaatcaacgttcgtaaagcactagctttactcaaaaattctttcgatttacatcaaagcgaaattgtttttgatatggtcaaatatgtacatgttgaacaaagtgttgtggattgggtatttaaaacatcatatatctatattgttggtttggaacaatcattagttcaaaactattcaaacgataatttgattaatcaaattgttgaatattttgaagaagttaaaccttatagaactaaaattcgttcacaaatagagcaaaagacatctgatgatgatttaataaaaggtctatgtaatgatttagatcctaatggatatattttcgttgatggttattggatcaaaactgaaaaagatatttgggattatgagtacgctcaatttaatgaaattacccaaaaatgggaacaggtaggttcactaccaagtgatttcgttacaccaaatagaagattccaagaaattgatattattatgcattatgataatattcagtgtaaaccaaatgaagatttggcaagcataaatgaattagtaagtgttaataacaaatatcaatccaatgaaaaggatgctgttagtaactatgaattacaacgttatatatattctttcccagaatatagtgaagaaactttcgatcttcttattgcttatcaaatgcaaatctactatccagaattggatgtaacactaggaacagcatatggcgttaaccagtggtataaagaccatgcggaagatttagaagcaactgatgaattcactgctacattggaacgtgtttataaagaatcaacgcataacgatatgtttactgaccttagacaatatgttcagtataacacattggcaaaccgtttgaaactttataaagatataagtgatgagaaaattcacgatgaagttggatgtggatttagtggacttacttataatgacaatcctagtactagacttccattaggcttttcttctagtaatgattataactatggatattttgaaataagcagtgaattgtatcaaaaatacatttcattaattaaagataaaaatcctgacgcatcagactatgaagtaaaagttaaacttgaagttgagtatggtgtatatgtttatcgttatgatgaagtaggtggtgatacccgtttctatactgatgctattcacgtattagcaggtatgagagggttattcgacaaagacgctactgataagtacgaaaaagctgaagagattcttagtaagaccccaattgatatctatgcaattacaatgattccacgaaaatatgtttacttaaatgttaacggtgtatatcaaagtatacctgatgaacaaagtattgatgatttcatggaagattattttatcacaaatggtgaaatggttgaactagctgaaataaatcttgatgatttaccactagatcaaaataatccaatgtattctgattatcaatatatacttgatagtattactgaagctaagtacttcaatgatatgaatgcatttgataacctagcattggaatctcaaacttcttcaataaaatgggaagttaaagatgatgaagttgatccttatattgtggatatatctgacataaacccttctgggcgtgatgtaggtcaaattagatttacagttgatggatatgggtttgacaatgtatctcttgtacaattacgtgataacagcagatatcaaactgaaggtatggcaattatcaatccatataaacatacagaagcaattgtaagtattccttcatatgctaagattgaaaatgatattaataaaacaacatcgaagtttgatgaaaaatatttctatcgtgtgagatctattaatagcttaactgaagcagaaatagttgacaatgacctatctgatggtgataaggtgatgattttcactcctgatggtgaagattttgtgagatatcaaaatcacacatgggaaacaatcttgcgtgtatctaacatcaaaaacaatacaactccgatcctattcactgtaagaaatacaggtaaggaaacgattgaattgattgatgagagtactggtgcagttctccgttatgataacatcactcttgcacaacaaaatgagccagtacagcctctagcattgaacattgttcgtgttagaacatttgctgaccctgaatttgtcaagaatggtattaaattgtatgaacaaaatagaaattacaccattgatgtaattaattatgatgttttctacgatactactttaaatggtggtaagtacaatgacggaataacaccagatgacgttgacgtttggataatctctaatgaaatatttgatgttgatggaattactatcgataacggttataacttaccaattacgggtgcgggagttcttagtgaattggcaagaactaaaatgactgatagtttagaaatcaacgttatcgaatatgattcaagtgttattcaaccgtttagaaataatgaagggatatgggtttatggattcccaatggttgacggtatgtatatcggtgttgttggtggtactgttactaacatcacaaccattagtgaagaaaatacaacctatgtttctcaacctaaatcaataagtccttatagtattagaaataatgttttatccggttcagccgcaaacatgaatgatattatatcgattggatatgaaaaagttgaagttagaaatgcaaataatttactccgtggtgtaatgtatagtgcagaacatgattttaaacttaatactacatattctttcaatggaattaatttaggtaattatgatatgttaaaacgttacacacaaaatagttacactatagatctttcagtatacactgatagtctacaagttagtggtaatgatattaaaaatatattattagttaagtaataaaaaaaggagagcaatatgctctccttttctttttttatactagtgctttatctacagctttggtacgtttcggcttaataccgattttaccatcaataacatcaaatgtaatgttaccaccattcacaagtgaaccacacaacatttctttagctagtggcacacgaatgttttgttcaatggtacgtttcattggacgtgcacccataccaacttttaccccatttttcgcaagccattcacgtgcagcttttgttaatgtaactttaacattacggtctttgacttgttcattcaaaccacccatgaacttatcaatgatgctgtcaatagcttcactgcttaggtctttaaacgtaacgatactatcaatacggttaataaactctggtggcaagaatgctttaattgccttgtcctgtgcagtgtcactaccgctcataccaatgctacgctttgttgaatcagccgcaccaaggtttgtagtcataataacagttacgttattaaaatatacagttttaccttgagaaccagtcagacgaccttcatccaaaacctgtaggaaggttagtagtactttacgatctgctttttcaatttcatcaagtaacagtactgcattagggaactgctcaattttatccaacagtaaaccgttaccagaatcatgaccaacataacctggaggtgaaccaattagtttagaaacagtatgttcttgagaaaattctgacatatcaaagcgaatgagttccgcaccagttgcgtctgctaatgctttggtaatttctgttttaccagtaccagatggtccaacaaacataaatgcaccctgaacactagatttgtcacgcagtcctgcacgagctaccatcacgttatcaactaatttttgaatagcttcctcttgaccgtatacacgtgagcgtagtgcatctggtagattacgcatacgatcactttcagtacatgcaaccacgttgatatccaaattggcaataccagcaacaacttcttgaatcaaattggcagtaattagcttactattgttgtcacgtgaacgaactttagccgcagcagcatccattagatcaattgctttatctgggaagtgcttattcttcaggaatttatcactgagagaaattacagcatccattgcatcagatgtgaactcaacattatggaatttttcatacgttggtttcaaaccattaacaattgcacgagtttcatcaattgtcggctcaactacgtcaattttcataaaacgacgagttaatgcactatctttctcgatatttttacgatattcatcatatgttgttgcaccaattacacgaatctcaccacgtgaaagtgctggcttaagcatattgctcatgtccatagaaccattacttgcggaaccagccccaaccataatatgaatttcatcaatgaaaacaatagtattttcacgtttctttagttcttttagcaaattgtcgatgcgttcttcaaattcaccacgatacttagtaccagcagtcaatgcaccaacatttagtgaaagaatttcaacgtctttcaggtgttcaggtacgttaccatcagcaatagcttgtgcaagcccgtcgatgatttgtgttttacctacaccagcttcaccagtgagaatagcattctttttggttttgcgagcaagagtctcaatcaatgcagacaattctttctggcgaccaatcataggatctagtttgccttcttttgcaagagcagttagattcgttgtatagtcttccaaacctttttgtttagatgattgctgctgttgggccacttttttatctccaatcggttcgtcattaatactttgtaagttgatacccttatcaagtgactcaacgtgtttctgtaatgcacgtgcagcttcagtacagctaacaccttcttcttttaacgcagcttctagtgctgtgttagggaaagacagacattcgaatagaacaaaatatgcatcaatcgaaaaatcatcactttttagttgttcaataactgattttttagaaagctcatgtacaacgcgattcactagaagtgaagttcgattcgcgtcttcatctttaacactttttggtgcatgtggaactgttgtatttttaagatagttcatcaggcggttgtgcagtttgtctgcatcaatgttcatatcttcaaatacgttcttgatgctatcaatagtcagtactgtggcacttacgtggtcaatagtcaagaatgtatgacctagagatgttgccagttcgtcgctttttttgaacaattgagtaagattcatgtattctcctatgtgattcacgtcactctaattaataaacattatatcacattcttacggtttgtctacaaggtaaataaagatatacccgatttattttggagacaatcatgacatatagaatgtggaaaaaaggtagaaccaatgattacaagttcattgattctgccattgctgaacaatacaacattggtggagttgacatgtggctttatgcatatgtcggtccaaaacaagttgctgacaacactgacttatcctatggaggtgattatacatcttcaggatcagttgtgtcaagtattggcgatttaatttttggtgacacaccaaacagaaactacaaccttgaagctatcacacttagttgtgtctatcaagttcaagaagcaactccagacttgaaaatcccaggattgttctttaatttcaacactatggacatcacaatccattataatacaatgatgcagcgtttaggtagaaaaatcatgccaggggatgtgatagaactaccaaatttacgtgattttgatgtattgggtaaagatacaggtctaaaccgcttctatgtcgtccaagatgcatttcgtacatctgagggatactcggttacgtggcaacatcacatttataaacttagagttaaaccgctaaccgactcacctgagtactccgatttactcggtaacaataattatcctgataatccagatgaccctaataatggtaatggaaataccgatgatggttcgtcggaaaacagtaactatggcaatgaaatggatatcatgaaccgtatcatcatgcaagctgatgatgaagtaccctatattcattatacaaatgaacatttgtatgatgatcgacctgatacagtagatttatcaaaatatatgcttaacggttatgattttccagaagaacctgccgatggaatgtattttttgaaaaaaacatacccagtactcaaagagtttgttaatgatacatggatttctgtggaagtcaagcgtggaaccatctttcccagaaaaccaatggatggtgacttcttctttaaagaaaatgacgcagatgtgacaggttatacgttgtatcaatatgataaaagtgctaaaaaatggttaaattgtgatgtagaatatactaccagtgatgttccaccagaagatgtggaagatttttgtattttttataaagaaccacacatttatcagtataatgatgacaagtggggggaaccaaaggtaacttatgtcaatgaaccattcacgtccaattgtgtatatggtaatattgattcgcaacaagattatcgtcctaaaattccaccagcacgaggtacagtccctgaaggaaatatgttcccaactgatgcagtagatggtgactatttctatcgcaccgattatactccagttacgttatgggaattcaatgcaactaagaattcatgggttatttttgattatggtggaagaaaaccgtgggaaggtgcagacttagcacttacacagtttgtaaatagtgataacaaagttccattacatgacgcagttaaacctaatactgtttatcgcatacataaggacacagaatgaaaatagattattattatgacggtcaatttcgcagagtactgaaacatcttatcagagtttttggtgaatttcaagtacaaaatggtattgatgctaatggaaacccaaaatacaaaaaggttccatgtcgctatgccgatatttcaagaatggcagcagcaattataaatgggaatagtgaaaatgttctcccatcagcacctataatgaccataagtgttaatcaactaaagttggatcgtaaaaatattcgttctaatgccaacgaaactatagtaatgggttctaacaagtcccctgctattaatgagtacacaaaagatcttgacacacaatacaaaattgtaagacataacccagtaccttggacttttacgtttgatttgaatatttgggtaactcaaactcaaactaaaatggaattattcgaacaaatctcaactttgtttgcacctagtatacaacttcaattatctgataacccgttagattggacatcgcttagtgatgttgaactaatagattgtcagttttctactcgtggttttccacaaggaactgacccagatttggatataatggttttaacatttgaaacgacaatatggttttctttaccagctattgttgaaaaaccaaaattaatccaacagattactacaaatattaaaggtgctcgtgacgaatttgattttgaaatgggaaattattcagatataataacagatgtttttacacccaagaatttatgcattaaagttgaagaaattactaattccaagtataatttacctgatacataccaacttaccttggttagccaatcgctatctgcggtttctcccaacggtggaatatattcatgggaaaaatatcttaaatatctagaaccaaattttgatgacaaaaaagtagggattaaatttcaacaatctattgaagaagacaacccactaaaaggtcatatagcgtcgtatggtgaaaatgaagatgccaacaaaattatagtacagcttgataataccaattatactgttgattacactatacatgggtttgtgcagaaagattcagtactttcaagtgcattacctgaacaatattatgtaaataacagtatacataacatcatttataaagaaaccgaaatcccatcaaattatttgtttaaaattacaaatgacggtgcacaattaattgatccatctactgtacgaaattacatttataataaagaagacaatggttattatagatataatgacaaatttaaatggcataaaagtatcatgccagtgtatcgtcagggatattggaaaataactttcactgacaaataaaggaggtgttgttatgaatgaagcggttggtgctatatttttatcaaaaagtactggacatatgatgttaaacttgcgttctgaaagaagtacctattctaacaactgggcatttgttggtggaaagcttgaacataacgaaacaccactacaaggtctgatgcgagaaattaaagaagagttgggcgactcaatacctaacattattgatattataccgtttgatgtattttgtacaaaaaatggtaaatttaaatattattcatttgttattgtagttgagaatgaatttgtaccaactttaaatcatgaaagctctggttatgcttgggttagaattggttcttggcctaaaccattacaccctggtgctaaaaatactttacttaacacaaacttaatgaaagatttttactcactatgggaaagtatacgtgaaggtacacagtttgtcaacagtttaccatatagatattaaaacaaaaaggagccgtgtggctcctttttttatactccaataatcggaatacctgtaatatttaacaacacggatgcttgtagtttaacggattcaccagcagttagattactaatgctaccatcaactcgaaaacctaaatttttatttgagtttagagaattgataacccaattttcataatcagctttagatgttccattaggatttgggatagatggatctacaccattaataacaatatttacgtcccagtttgggcgactactggtaataacatctttaatggattctaattgtgtaatcctacgtgggtctggcatttgacttgcccccaccgaaccaggaacaaaagttccttgattatctacataaaattgcccttttataaaaaaggttttggaattgtatggaagagaaactatctcaccagaagaatcatttacttctctaatcataatttttaattcatagaaatagttgctaccaaattcaaagacacctgtaccattagttaatgttgtccagttatttgtatctacttgtgaagtaccacctaagttaaaatacgcaatcggtttagtactattactttgtgtgaactctatatattttttaccattatcatagttaatatctaataatgatgaatactctttgttttctggtctagatgtttgaatttcacgccattctttgtttttcattaacacacgaagagaatcaccgttactagttaataccatacgacccataacactattttcaccatcaggtactgtgttaaaaacagtaatcatagggatagacgcccattcagcttcacttaccatatcagcaggttgtctagcattatcaactaatgatatcaataactcaccagtactaccagtgtttctataccaaagttgaccattgacgttgccacgtggtgcagatgctgaactgaaattttcaactaaatgtaaaaagttttcattccatgcttgaccgtaacttactttatttctaccaactaaatttaacggaactgggttacttccgggctggtttggtcctaaaataacattatttggaatggtagcataaacactaccattacttctataaattgtataattaacactcattatatgtccccattattgtaattgtacacgaactgtgtatttaatttgtaagacacggtttgcacttttctcaactgggtgaaaaatgatatgggttaaaggaataccactatcgccatccgtgtataatcccaattcatcaaacacataagttccatccatgcttgtccctgagcttacaccttggtcggatggttcacctaaccctagagtacaaatacatacaatatcagtataggactgtcctggtatatgtacagttgtaatattattgtattgtgaatcaatacctgccgtaattcttgggttgatttttttcaaatatgtttgtgaatataaaccaccaaatgatgtaacacgtggttttttataagtaacacgaccagtacttaaaactactgtaccaccattaccaaaacgcatctcgctaatagaaccaataggaataccagtactgtcttgattatatgctaacgcattagcaatggcagtactcatattttcagggtgaatagcgttagatttatctaaaacgattttttgatttgatggatcagtaacgtcagtaattaggacatgacctttaacaaatagttttggttgttctgtttctaatttcatttctaatccttagtagttaattaaaatttgttctaacttcccagctaaacttttttggacatctgatggatacttactaatataatcacggtctataccaactttaaggtaagtaaaattaccagttactgtttcagcaaatgttccggtagttccttgttgtctaattaaatccccaccatttggatttaaaataaccatatcagtaaattcaagataataattacaactttcagtgaatttaattggaaaccaatcatcatcagtaggattactagctaatgtagctaatacataaattctaccaataaaattacgtagtgtaaatgaaatagtatgtaaacctgtagtacatccatagtagccaccacttgcgagtggtaacgtttgttcattccagtgataatccaagttagctggataccagctatcagattcaggaaaatcttgccatgaaccatcttttgtttttcttctgaagagaaagtcttttgatcttaatgccattgtttaagcccttttagtagtgaactttcatttatttattaatgataacgaaatgtattttgtactgataaatattggtatatgacattaactcatacaagggaaatattatgacaatttcatttaacaatgggtccagtggttcatgtaataactccggcatcaaaagtctagttattaatggtgctgggcatttaattgtaacctatgcagataacacaattcaagatttaggtcttgttgtaggacagaatggcgagaatggtaaaaacttttatcctaatgagattggttttgaaattccttccgaacaatttaaagttggtgaaccacttgggtggtgctacttaagcttggctaacaataccagtactctatactttaaatcaaatgatgcacaagatccgacaagtacatggattagtgttgagtttggtaaaggtgatacgggtgaagcgggtaagccgttccacattgatagtgctggaactactttcccaacaactggtctttttgataactatacattttataatactcaagatggtaaactttatttctatcaaagtgtaactgctacttggagtgatggtatacctttccgtggtgaacaaggtccgcgtggtcgtttccatattgatagcagtggtgatcaatttccaagtattgaaaatcttccagttgattattgtttttataacaacactgatggaaaactatattatgttgatgaagtaactacaactacccctccttcaaaagagtggagtgagggtattctattccgtggtaaagaaggtcagcaaggtattcaaggtatacaaggcgaaccaggtgcaccaggtaaagatacaatttctattagaaatacaatagatagctcatggactaacgcactattagttattggtacgtgtcctgctggatatgtagtttctaatattgatgtaaacgttatacaaccttattctcttcctgtaactgatatgtttgtacgttttggtggtgaagcacaagaagatattggtgggactgtaattgcaccaacttcctactttgatatcaatcgtcagatgcgttttattgttaatgaaactaatcatgcagcatccgatgttgatgaaattatttcatgtgtattcaacgattctgttaacaacagtccttatggaaaaatggaaattatttgtactctttcatggcaagctcctatccaaccgattcaagataatatttaagggaggatgtcataatggcagtattttctaattttgaaggaactatgcagcccaaattcatattggggaaaaaaggtgcttcaataaattttatcaatgattcagtttctataaaagattatctaggagaacagttcctaccactgaaggtaggaacttcatctgaccctaattcagcagttaacgtaaaatatcttgaagataaccctaatgcattatttggtgttgtaccccctaccgatgatgtaggaaagaacaataatacgtattttcaaattgatgaagatggtattgttgatatttttgcaaaaagtaatggtacatgggtaaaatcattatacattaataaaaaagttctatccagtaaaaatggtggcgatttcatcggacttattactggaggtacagttcaacaggcccagttttatataacaccagaagaatttggtgctaaaggtgatggcgaaactgatgacactgctgctgtaaatttatgtgctgcttatgctaaagaaaataaaatccaaattcaggctggtggtaattaccgtatcaaaactgcaatatacctggaagatgtaacttggtttgggggaactattactggtaatggtggtactatggtatccgttattaattcccaaatacaatttgcaacacttactggatgttatttaaaattcttcggtggcgatggtaagttttattttaataaatttataaacatcacaagtactgctgcatttttaatgcaaggtatgacacaaccaggaacaatagatttttgctttaatgaaatgacccaatgtaagtatggtgttcttcaacaaggtactggtgagaaaatgaaggttggtagatattcatataaccacatacatgatatatatggtgatgcaattgaactaaacgtaattaactcacattatcctgatggttttgtgattgaaggaaacgtaattgaaaacgttgatggttctaacgctccaatcccactttcaaactggggcattggtattggcgttgctggttctggtccttatggtttagatgcaccagatacacaatatgtcagaaactttgttattaaaaataacagactatataatgttagacaatgtatccacgttgaattaggaatggactttaaaatacttaataatgaagtttatccatcatctttagtttctgttggtactggattaaccactgctggtgttataacttatggttcgaaagaattcattattgatgggttgactggtcatttgcttaatgacccttctatcacaaatagaatggtttcaataaactggggtgtaacttctggtcgttttgctggaccacctagaaactttaaaatttctaatctctatattccagagtcttctatacttgtttatacttccggttctgataattggttaaataatacagaattgagcaatatcacctgttctaaaatcctttggcgtggtttgccatcatcatctaaatttagtgatattagaactaaagaattagatgtaattggtcaacacctctctaccgaaggcgaaggtggtggtatctatactcgctctaaatatacttatactaattggactaactgtgttgttcaagatgattgtaatgtttcaaaatatagtttttctaaaatgtatgtagacagaatagaccaatcatctaataactttaaagttacaactgcaatcgatggtacaggacaccgtggcccagtactgatacctgtagttgagcaatattatattccatacgatacttttcctgggggacgctatttctctgaaggcacgattattcataaacaatcgggtggaaaatatattgtaactgttggtggttcttttttcggaaaatatgacacaattagacaaacggtagcaggacaaacatacatagaagcattgggtgtgtcatggggtgaaaaccaatatgcaaaagctgctggtactgagatcattatatccggtgctggtgaaaatggtggtgatttgagaacgtatataactcgtgcagtgtatgttgtaaacaacgtatatagaattgatattgcagatcctatcataacagcaactgccgctggtgcagcattaaaagctgcccaacccgtaacttacataaccctaccataaaggagattatattaaaatggcagttttttctaatttagaaggaaccatgaagaagtccttcattcttgggaagaatggtgcacagattaccacaaatggtagtgttgtgcaaattcaaaactactcaggaacacaacttcttccaatttcagcaggtgaaccaactgcaaacacacacttggttacattgggatatttaaacgcacacagtggtggtggtagttctggtatcttacgtggaacaacagcaccatccgattcgatcggtctagatggtgacgtttactttttggttgatagtactaatgttcttcaaatttatattaaagatcttggtatttggaaaccatttaaaggtagctcacctgggactgatagctcatatgtaactactgaaatagttcctgtttctgcatttacattagtgccagatactactgatcattatacttacacactaccagaatcagttcatggtagaggttctgatattatgatccaactacaaggtgacccaggtaatgttgcattggaatcagtattccaaaccacagtaacagttagtggtattggggatataacaattgatgtgattggtcaaatcacagattatgcaagtgttaaagtaaacattataggagcaacaacaatgacagtaccttatagtaaattggtaaaccaagcagattgggtttctagtgatggtgattttacaatcactattcctgcatctgaacacaatcaaacaccagataatttgtatatttcaatttatgcaaataaaacacctgggagtgtttcgtcatctccatttgaattggtagtgactgatacacaaattagtagtactggtgatgtaatcttcacttctgatatttctttcagtggtaagattgtcatctctggtaagtaaaaaaattaaccagacttgttctaaataagtctggtttttattatatttgcttttgtcaaataacatattaattgttggataacagcataataaaactaaatatatacatattaacaaggttataatggagggtataaatgtactcaataaaaactgacttagatattactggtgctggtacggttggtaaggatcttttagtcaaaggaaatgctgttttcaacaataacctaactgtaaatggtactgtaacttttgcaaatgcaacttttactgccattgaatcatcaactgccaacattacatctactttagatgtaggtggcaaagcaacactttctggtggtcttggtgttgagggtaatactacaatcggtagtgcagttgtcgggtctgatacagcaacaattaattcaaacgctacctttaacggtactgtatcagttggttctgattttacacaaactgctggtacaaccactctacaagcaactaaagttaaaaacttagaagttgctgaaacaacagcatttaaaggtaatattactgctgatgttgggactactgctgcatttgataaaattactgctaataccgcagaaattactaatgtaagtacaacagatattagtagtactggtactgctacatttaacgatgtgacaattagtggtacacttggtggtgagtttaatctatctgacttaaatgcagtaacattgaacgttactggtgcatctaaccaacaaggtgcagtaactttcggtgctaacgtaactggtattaacagtactgctacttttaaagacattcgtattggttctaactctgaatcacaaaccttcagattaagcttcccttacactgctcctggtaaacgcccaactgttattctacaaaacgaaattcagtccgagctaatgtcacctgcaaacttgacagtattgacctctgcttcttttggtaatgcgtcattatcttcttatggtattactggtaatggtctaaacaaattagattatctaacagtttctggtaacaatacacaatcaccagacacaccactattagaagttcaaaaaggaaaaactaaagttgctgactttgaagtaaccggaactgcaactattccaaatatcgaaagtactggtactgctaattttaataacattaatgtttctggtcttcttggtggaacgttccaactagacgatattaatgcagtatctttgaacgttactggtgtaacttcattagttggtggtgttactcttggttctaatattactggttataacagtactgcatcctttaaagctatcagcttaggtcaaaatagtcaagatgcggcagtgaaactaggttttggatatactgcaccaggtcaacgcccaacagttattctacctaacgaagttcaatcagaagtcgtttctccttctacattgaacgttcttaaaacagcaactttcggtaacgcttctctttccacttatggtattactggtaacggtctaaacaaactagattacctaactattactggtaacgaaacacaagctccaggtacaccattcctacaagttggtggtaaagcaattcttaatgatgttgaatttactggaacagtaactggactaactgttgatgttagtgggcaggatctaacacctaattctgttgtcgcggcagcaaatattaaaggtgcaacacttgaaagtactggtaacactaccgtgggtgctaaactaactgttactggtgatattgctggtacaactgcaactctttctggtgcattatccgctggttcagtaagttctggttctattactggtacaacttctgtatctgcaccaacaattagtgcatctactgaagtaacggcccctactatcactgcgagtggaactgtaagtgggcaaacaattaacggtactaatattagtgcaacaactctgactgcaccaactattagtggtaatactaactttacagaaaatgttgatattactggtagcttaactgttggttctctagacttgagcactaccgatattaatgctaaatcaatcactactactgctggtgcaactattggtggtgatttagtagttcaaggctcttttgatttatcagcagccgaccttaatgttaaatcattaactacttctggtattgttaaaagtaatgatcttgttaatgctaacgtacttccagtacttaatagtactaccataacggcaactactgttaatgctgatgatataactgttaccggatctgctaatttgggtacaatttactcaagctcatctgttctagttgggtcaactttaactgtaactggtgaaactacaactgcatcgttggttaccccaaccatttcaaatgcaagtggtgtcactatttccaataatacaaatgtaactggtgacctaactgttactggtgcagttattccaggctctatcgatctagcaacaactgatgttaatgctaaatccattactactactgctggtgcaactattggtggtaacctaactgttaatggtacagtagatcttactacggctgatgttactgtcaaatctttaactagtactggtgcaattgttagtaatgaatccacaattagtagtgttctacctaaacttcaaagtactgatgcaactattgcaacccttggttcaacaactgcaaatattactaatttgaatgttactggtgcatctaccgtagctgacgtaacttcttcaggtaaagttaaagcagtttctgtagaaaccccaacaattagtaacgttgatggtgtatctatttccaataatacatctattactggtgacctaacagtttctggtacagtaacaccaggtgcaattgatttgagcacaactgatgtaagtgcaaaatccattactactaccgctggagcaaatattggtggagatcttgttgtttctggtacagttgatttaagtggtgctgatgtatctgttaaatctctaacaagtactggtattattacagttagtagtgcagaaggtatcaacgttctacctaaagttcaaagtactgaagttacagtgtctgctctaaatgcaacaaatgcagtagtttctggtgatgtttcagcagcaacagcttcaatctcaggtgcaattactggtgggtcagcaacactatctggtgttggaactgctctaaatgtaactaataacgcaactgttggtggtgtacttactgttggttctattacttcagcggcagaaaatgtatccattactaaaaataccgcgattactggtaatttagcagtatctggaacactaactgcgggtgttattgatcttagcacaactgatgtgtctgtgaagacattaacttctctaggtgatgcaaccgttcaaggtaacttaactgttgatggtactattaacctaagttctgcaaacatcgtcggtgtaacactagaaagtactggctccactaccgtaggtactgatttgatactaactactggtaacattacaggtagtccatctatttctggtaacttaggtgtaactggcactacaactttaactggtgcaacaacagtttcaaatacattgaatactgctggtaaactaacagttaatgctggtggaattcaggttgttgctggtggtatacaagttgattctggaactattactgcttctagtgctaatatttctggtagctcaacacttaatagtgctactgtaaccactacactaggtgttactggtgcagcaagtatgaatggtggtttaactgcttctacattggatgtaacaggtgatagtacagtacaaaaactaactgttaagggtgtatttgttcctgaaggtggtttggacttatccggtgctgatcttagtgtgaatagcgtaactgcggcaaccacattaagtgttactggtgctagtactctaactggtggtgtttccacttcaactgttactgcatccggtaaggtaaccgcacaagaactaagtactggtacattggatgtaaccacaaatggaactgttggtggaactttaggtgtaactggtaaagcaactgttggatcactagattcaggtgcaatctctgcaacatctggtacatttagtactacactagatgtgactggtgcagcgacctttggtaataatgttaacattactggtacattaaccccaggtgcattggatttagctagtactgatgtagttgctaacagtctttctgtagctacaactctacattcagatggcaacgcaacaattggtggcacattaggcgtaactggtgcagtatctgctccatcaatcgctcttaatggtgaaggtgctgcgttagcagttactaataacgcaacaattggtggtacattaggtgtaactggtgctacaactttaggttctctaacaacctctggtgcagttaaaactggtgctgatgttattatcggtactaaaattggcgatcaaccagagacagttcagattttccctaatacttacattgctggctccttgcgtgtagatggtggtatcaacgctgatattgacgttagtggtcaaacaattgaaccttatgcagttgttgcggcggacactattagtgcagcgggtaatattacttctggtgcagagttgatttccaaatcagcaactattggtgatgttggttcacaaaacaacaacttaacaatcaatggtaacgtagttaacaacggtaactttacagtaactggcctacttaacgcaacactaaaccaagcaaactctgacgtggctgttaaatcattaactgcaaccaacagtgttgctgctggtactagtattaccgcaggtacaagtattactgcaactggtctactaaaagggaacacccttgaagtaactactactggttcatttggtggtgcagtaacaatgtcaagtggtgctaacattactggaaccgttggaattacttctggtaacctaactgttggtggtgatatttctgcaacaggtactgcaaccctagcagcaacttcagtaactaccattactacttctggtgcagcaacacttgctagtgcatctgttactggagcagcaacaatcggtggtactttaactgttactggtttaatgactgcaaatggtagtgttgttttaggtgacgctgctgctgatacattaactgtcaatgcaacatcttctttcaaagaaaatgcagtatttgataaagatgtaactgtaactggtcaattaacaactactaatgctgacctaactactacaacagtaactactaaaaaatatgatgttattcctaatcaagtaacttcttctgttatcgcaccaactggtacttggaccccagacggtactagcaacgtatactttatcactctagatcaagataccactctagcaccaatcactggtctaatcggtggtggtaaagcatcttcagtatacatttatgtgaaacaagatgcaacaggtaatagaaactttactactgatggtacttatgcggttgttgatggcacactgaacaaaactgcaaactctgtaactatctaccaagtcatttatgacggtgtgagtccagtaacagatatgtttattgcacaacgtactgcttaataattataataataaaggtgtcactcattttgggtgacaccatcataacaagtgaggtagttatatgttcacatatgtgaaaggaaattcaaaagaaaattatgaattgggaaacattatttccaatccaattggtgtaaaaggacttaaagaacgtcctggtgcaacaccagaagatccacaaacctatcgttatctttatagtgatattagaactctttatggtatttcaagtaaagatggttccccagtagaacctaatgatgctgttagaaaagaagaaggtttttggtggttagtgtataaaaatgttggaaatgttaatgctattgaacaaccgttggagtttattaaattaaaagatgaaaatcaacctattgttgaatttttagaagacgctaccgaagaatataaagcactaactgttcttaaaacatatcattatattgatatgccaatagcagatgttaaagttgatttaaaagcaagaactatatcagaacgtacaaatcgtatgaattctggttatatgttcaatggtcatcgttacagtactgatatgtctggtcgtcaaatgcttcttaattactatacacaagtcacttcaggttctgaaagtgtttctatttttcttgatgacgcaattgtaaaattatctgctactgaaatgacacaactatacactggagcctttgctatgattgagcaattgtttacagaatgtgacaatcagtgtgcagcaattgatgcagttgatgatttagatcctgatgcaatttataaggcacaacaagctgcaacttgggtatatgaaggtgttgatattcctgaacgtatacgttaattttttaaggtcaagcctatgcttggccttttcttttaactaaaataaatacatcatataaatctattctgaggaaatatttaaatgagtataaatcgaattagaggtgatggtggtgtaattattgatagtaaatcttttttagagttaccgaaagcaccatcaaaagaaaccgctgatgtaataagatcagggatgattagatacaataaggaatggaaatcatttgaaggtgttctggattttgaagatggtactatggcatatcgccgctttgcaaacttagatgcaaatggtaaacttcttacttcccaattaccagattcagtaactagtggtttacagtttgttggtacatacaatcctatcccagatgatattgatccacctttagcacaaacaccactaccagcaccagcagcatcactaaatggtgattattatgttgttcgtggtattatggatgccgcacaagcccattatgaagcaaataatccacaaacaagtcctgttacatttacacctacgaacccaactggtcaaggtaattggattgaaattttatattatgttgactccaatccaaatatatctggtgctaaacttgtaacatacgcttttgcaagaattattactgcatctattcctagtactggtcatgatggtcttaaaaatttagcaacagatgctgacttaaccaaaccatttgcttcaggcgttccaatgaaccaaaccgcactatcagatggtgattggatcattataactgaagataaaaacatacgtctacgccagtcaagaacaagcatttctgctgcttctgtattatatgacaatacagtaatgattgcaaaccatcgtcaatttagaacaaacgcaggaaccgtacaaacatccatagataacgttgtgattgaatgtttacgtagaactggtgattccatgtataatgatggaacaagcggctcagggcgttttggtgtggtctatggtagtgcagcagcaccagcattgacatttaataacaatccatttgatccaaccaataacccaggtaatgatcctgcaaaatggtcagacgctaatactggtatgtttcatccagcagatgatgcaattggtttcagtactgctggaactgaacgtattagaattaataattcaacattaacattataccaaacaacttcaaccccagcatcaaccccagtactaagatttgataatgcaaccaatactaatgttggactaagtgctagtagtaatattatttcatttagttcaatgaataaagtacaagttgaatttaaaaatggtgaaagtgcgtttcatggtaatattgtggttgatggtacaagtacattgactggtgatacatcagctagtaatatcactgctagtggtaatttgaacattcaaggtaatactacattaggcgatgctgcatctgatacaattacagttaatggagttagtacgtttacagcaaacactaatttcaatggaacaactaataaatttaaaaatataaatctattagctaatggtataattacattagaaagtactactaatcaaagtacaatccaattagttagttctgatttaaaactatcaatgggtaattatgctgatgtaagtatctatgataatggaactataagaacacgttttaatagatatggtatccaattaccagtactagctactattgataactctgttggcgttgatggtatgattgcatactccaataccgagcgtacttcaatgcaaaaagttcaaggtcaatgggttccaattggttcaggttcagtgagaaccgatgcttttacaatttcatcttgggtattaagtggtaactactacacccttactgtaacagcctcaaacatcgtcacagcagagatacaggaacaggttagtcctggtgtctatactcgtgttgaggtcgatagcgttacgtttaacggcactaacgtagtgtttagtataccttcaactcctgatgtacgtttcgacggaagaacattggtaacaattagataataaaaaagggagaactgatgttctcccttttcgtttatacagccataggtgctttaattgttggcattgggttgtaattcactaatttaaaagaatccatagtgaaatcttcaatattagtaattgtaggatcaagccacaattcaggtaattcacgaggttttcgctgtagttgttcttttacttgttcaacgtggtttttataaatgtgacaatcaccaccattccaaataaattcaccaacatctaaaccagtaatttgtgcaatcatatgagttagtagtgagtaactactgatattaaatggaactcctaaaaatagatcagcggagcgttgatgcagaatacagcttagtttcccttgcactacacaaaattgcacaaagctatgacaaggtggtaacgtcatatcatcaagctcaccaacgttccatgcacttagaatgtggcgacggccatatggatcggactttatacctttgattagttcttgtaattggtcagttgtacgtttcataacaacaccatgtgaaccagtataatcgataactttgtatcctttatcttttaattcttgaatttcttcagtactggaactaaatttataatcttcccattcacgccattgcttaccatacactggacctaactcaccatcagtataaccaagagcaacgccttgatttaggtaattatctgtccaaatagttttcttttctgtatcacgagttccatgcaaaatttcacaaaggcgacgctcatcatgggaaccttcaataaaccatagtaattctgaagtcattgctttccaagctagacgttttgtcgtcactgctgggaaaccatctttaaggtcaaaacgcatttgttgaccgataagtttgattgttccaacaccagtacggtcaacgctttctacgccttcatctagaattttttgatatagttcttgtagttgtttcattattcttccttgaaaaatgtaataaaatgttccatatgtttttcggtggcattgcgtgaaccaataccagtccagttaccatgtggtgctggaacgacgaatgtttgtgtgaactctttcagtactgtatcgaaataaaatactgaacgtgaattcatatcataacaataaatttcaggattttcaactgaatccatatacatctgtactgcccatgcagtaccaccacttaccttagttggtgatgtgatatttgcaatacaatatattctttctgtattaagtatctgataactattccttgcaagtaagttgtaaacataagaaccaggctttggtacttttcgctgcaacgagtaacatgcaatgtttagttgatttaatatagaaatatcagatagaatattggatggtatttctaatatagtactttcatctacactatgctcatgacctttgaatgaaaaattaataacttcaaatccattattttttgcatagatagaaaaaaggcggtcagcacctgctgccccgccactaaaacatacattagataaacctttaattgcttcatctaattcattctttttcatattttattttgctttacgttctgcaaatagttgttttactttctcaatagctttagtctgtgaaataccttctggaatttctagataaattgttttactatctttcggttgttcaacaacttgtgtttgcggacgcaagcttggctctaaattgtatgcacgttcataatgttctttagccagtttttcatatttttgtgcatcagtgagaagttgttctacaatagtagcttcttctactttagtgtccgcttcttgtggattgaatgggttaaagtcttttactttaccatcttcttgtactttcgcttgattttcatctaatgctttgtttagaacatcaagagaaattttattattaccaccagtgtgcatatcaatgtcacaagtacgaacgcgacgtagatgctgcatgttgtgtagaacatctagcattttgcgtccatcgagataaccaattttatgcattacttcccacaaatcaatattagattgaccatgacccataacaatatcagttactgcgtgaacatatgcttctggtagtgaatcacgataaacgataaggcagtgttcaggatcatctggtagtgaacgccaaacaacaaaaacacgagaacctgtattacgcattacaccaacatgacgaatagctgccataattattctcctttatcttcttgagtttcactatcttgtgattcagcttcttctttagctgcatcttcttgtgctttaatatcttcaagagctacatttgcaaaagaaacaaatttagatacaactggagcaacctcaacaagttcttcaactttaaaggtgtttcgtgcaacagcagcttccatgatttttgcagcattgattaggtctagaagggttagttgaatttgattattttcttgttccattttaatactctccatgtatattggtacattaactattatatcatatttttataagttgtcccacttataaaagaagagaacggaaaattccgttctctttatttagtacttaactacgttgacgctttttatcagcttcatattcgtagtgtacagtctcaccaaatggtgcaactttatttgggttactgtgaatcacgaacagtgttttacagtagtttggatcaccccatgactgccacggttcaccatcagtaaacattacaagctgtttaggcttgtagttgtcgttcttcatatgaacccatactgcttcaaagtcagtaccaccaccaccttttactggatattccagaatcttacgttcttcgccagttttgtaatcctttacagtataaacttcagtatcaaaagtcatgatacgaatcttaaactgtttgaattgtttagtgatgccaagaacttcactaatgaaatcacgaagcatatcttcagaaatagacccagaagcatctagtgcaatcgcaatatcaatatcatcatctggtttcatccctgggtaaattggattaccatagaatgaaccattagaaccaaaaccagcaccccaagaacgacgattcggattttgatatgttgcatcagacttcaaccaactacgaagtgtacgttgaagttttgaacgccagtcaatctttggttctttaaagttgttaatcatacgagcgatttctgctggtgtaccacctgcacgagcagcattcatcattgctgttttgaaatcatccatgtaatcacgtttttgctgttcacttgaaccaccctcttgaccttcttgtggaacgtcatgctggtcaatggtagtaccttttggtttacccttaccatctttaatatcgccaaaagtaccgcgatttttaccttcaccttcaccgccgccactttgtggttgaccttcaccttcaccatcttctttttgttcttcttcttcaagaagaatgtaaatctcttctgcggtcatgccttcatattttttatcatacaaccatgaactttggattttcccaattttctcacgaacgatgatttggttaatggcataatccgctgcacggttataacgttgtggatcacgcataccacgacgaaggaagtgatcgtaagcacagtgtagaatttcatgacaaattacagcaacaaggttttcatcagtcaaaccttcagtcatttcttttaattgttcgtctgtaacttcagggtgcttttcacgaatagcttcttcatattctttctttttagatgggtcttgaatgcccattacaaattctacgttgtagaatagatgtttaccatccactgctagagtacgacaccatgtattattaggaactggacgtaaacgtgaagcgagtacaccaaagaatggtgcagttaacatcaaagatgtacgagccagaaccagacgttcttgacattctttctggagtgtcggagatacttcattgaatcttgaagtagatttgttatctgacatgtatatttcctcgtttagttaagataaaagaaggataccattaggcatccttcttgtcaacaactctttgttaattagccaagagagcgtgctttacgtacaagatcagagtacttagcgatgaaatctttaaacgctggtacatctttaatggaaatcgcaaccttatgaagcgtgatggtacgaattgccagtactgccagttctgcttgagttgcagagaagttatggtctaggaaggtgatgaagttgttacacagtttaccccattcttccactggtagacgttgttcttgcttctcattgaacaggtcgataattttataaaccaagttcagagtgataaagtagttcgcagaaatatccagcgttgcgtcgatttctttgatttcaccagacagaatagacatagtatctggtaatttagcaacgttctcaacgtactcaatgtattcagttgcaacaccttcaccaacacgaccagcaatcattgcacggaacacttctttatcaattgtcttagttttcttgagatcttcgtagcgtgctactgcttcccatgaacgtggagaagtaccaccactgtgagaaggatcttgtggactaagtgtgttaaagtacttagaaccagtgttgttgatgaacgcaacagttgctgggttcaaacgttttgcaatcgcataatcgttaatccaatcttgatgataaggaatcatctcaatgtgagtcatacggtcacgcagtggtgtagcaagagagaaagttacaccgccatcagtttcacggttacctgctgcaagaatcagtgcagtcttaggtagcttcatctcaccaacacaacggtcgaggattagctgataagacgctgcctgaacaataggcattgcagagttaatttcgtcaaacagaataacacctttccaatcttcggacaatttcagaactttaggtgcagcccatactaccgcagtttcagctacataatcttttgcttcggcaagctcagattctttcagaagagaaccgtcagttttacggaaaagcttctctggtactggaataccgcgaaggtcacttggttcgatttgagacaaacggaaatcgataaagttagtatcttggtcgattagttttgcttcaaatgcagccagttcacggcgtagctgatcagcattttcagggtcagcttcgatttgttgtttcatgaactcgattttagctacgttatctttacgcagtgggtaattttcatcagcgtattgacgagcgattgcagacttaccgatacctgggctaccccaaatcatcaggctatcttgaatcatgtcagctagtgccattgcttctttagctttctttggagtcagtttaacgttcaggatatcgttttgagtagtcatgtatatatttccttttgttggataaaatcgtttaagtttctattatagccaatccgtgggcaaaagtaaaggaactgtgttaaaataatttaacttatcagttcctttgttacttcatgaatcatccgtgtgtttaaaaggtaaatctctttgctgtcttgatgtgaacattatatcacatcgtttcaacttgtcaatcacttttttcttttttttcaaactcacatcttgtgtcgcttgaaaactttatgtctgatgcttattgtatcacatcattctatcttgtcaacatttatttttaattcatttttcttacatatgaatagaaaataactgtttaaaatcatcacaacacaatgttaattcagttattatcattgcatctgtcagatatatgtactgaccttcaacataataaggtgaagtacatattctgtcaagtgatgtaaacattatagaacttttaaattctctttgcaaggggattttggtaaattcataaagattattttctttacaaattccatacccaaacttgctaagacgtaaaccaccgccagttctgaaattttcaaaaattgacatcagaagcatacggtctgttatttctgaatctgattcatgtacttccctaactttggaaagtacattattttgatattcagtactgttatgtgatggttctggaaacatatattagtctccaacaaaaccttgacgtgcagcatatgatggtgcaccaggctcattatagtgttgtacgccttctttgtcaattgttggtcccataccttcagttccaaaacaacctgcaatggcttccaacacttcttcatcagcaacttcagtactttcatcattatatcgaatgtcagacaaaatgtcacaggctttttgtagtttatctacaatttctttttggtcttcaccagatttaatcttatcaacaatatcaataagacatttggtaatatccttaagaacatcaactgctacaacatcggattcaacttcaactgaaaaactttcgtcttcatctcttccggtaatttcgtctaacgcttcaactagttcacgataattatattgcatattatttgtctcctaaaaatttcttgtatttttcttggagactttcaaaaatatcttctacttcttcatcagaatcatcttccaagtcaatgttaccttcaggtgaatcatcttcttcactttcattaacatttagtgggttatctcctaatgcagtgcctgggaattttggttcaaatttatgaacacgattttcgttcccttcattatcataatactcaggttctggacgattgtcaagatcttcatctacaacacgtctccaataaaattgattgccttttgcaattacaacaaaatggtcaccttcaacaccattagtctttagttgaccatcacgaacggcatcagcttctgtatcatatggaccataatcagtactgttagatggttcttcatcttcagagatacttagatctggtagaaattgggtatctttcatttctttatcggtagcaggattaccctctactgaaaaatcttcgtcttcttcttcgttaataccagcaagagatagcatacgactaaaatcgaattcttcttcaataatttcttcttcttcctcatcgtcttcttcaactgattctagttgaggttgaccactaaggtcaagagaaaaatcttcttcaccttctacacctggttctgaaaattcagcatccatactaacttcatctgtgtcagcaccaaaatcaccaacatcagcggaaagatcatcaactgccgctgctagtgggtcttcaactgaagtttcaattccaccaatttcttcttcagcaccaatagaatcgagatctagtggagcaataggtggaagagatggagtcatagaccccatagatggtactggagcggcaactactgggtcttgacgttcagcttgaccagcaagagctaacatacgtgatagagtttccaaatcatcagattctaaacctgcgatatcgattttaacttgtgcttcattaatttttttagccattttaaataaatccttttagttatcaatcattattatttaatgattttaaaatttgcactgtttcatcctttttacctgaaagtaaaatgtcagcagcaagtagagaaacctcatcaccacgagttagtagtactgtgatttttttagcataaggtgactctttaattttagaagctaatgattgtacatcatcaccagcaattgtttcagatttagtttctggttcagaaacttcgtctggtttttgttcagattctggttctttcttaggttcttcttttgattgaatttgctcagtaccagagtctacttcaggtgtttcatcacttttaacttctttatcttgttcatatttggcaagtaatttagcagcagttgcttttggtataaacttaccatcagcactaatgaatctgtcaccaccaacatacgaatattctttgccttgtttggatttaacttttgtaccgattttcatagcaccggaattgttatgacggaaaatatcacgctgtgctgctcgttcaacacttttagaagcacttgtgttaagttgctttttactttcgatatcataccacaagttatttttcttagcgtatgtttttcctttagaagaagtcattctataaccgtcaggaacagtaatgctttcaaattcttcaatttcttcatctgcttcattaattgattctttagttgcaaatactggctgtttagcagggtgtgaagctttatgtggcttttcacctgaaccaaaacgttgctcactatgttcttgttcacccgttaatgtaggaaaatcacttgggttattcttaacaaattgctgatatgcattaataattgcatgtgcattttgttctggaattactacattaccatcattatcacaaaattctttaccattccactcacaacgtgtattgccttgaactaaggttgatttgattggaattagtttatttttagaagctaactgacgagcaatacgcataccttcatctgatagtttacgggtcattgctggatcaactgctcgtcctgatttcatatcaacaaaacggtgattctttggcacaaatttaaaaccacttacttccatacctgctggaattgatatatcatcagcatatggtggaagaatgtaaaattttaatgcattccattctttttgtagtgtttctttagaaacattatatactcgatgatcatctgccattaattcagtgatgaattcactttcagttaatagaattccatcttttgaattgaaacggttttcaccaataaatgtacactctttaccttcaacaatatatttgttaccaatcttatattcatttgaagctagattgtgctcgacaatctgttgtcgagcacttgcgtacatggatgggtattttctagggtctaccattaacatattattgtcattgaaccagaatccttcaagaaatacatattttgcaccagtatgtgacgtatatacatatccattaggaactgtggtagtttcagtactgaaaaaattatccatgtgttgattctccttaagaaagcatacgtaacagttggtcgcgttgctctggacttaatttttgtagagcatcagggatactggaaccttgtgcttttggttgttcttgttgtgctggttgctcagttgaggtcgattgtgatggttgtgattctgaactttcttcgccaccttgttggtcacggtagtcattcattatatcacgagcagcatttaatagagcagtacctacatcttttggtgtaaaagaacgacgaggattgttccctaaatgtttaatatcaagattgttacctttaaaaaactgtgccacatcagcgtaaggtactgatggttgagctttaccatatttacgtccaacataacgtttaaactctgcccataagcggttggcttcagcaccaacttcttgtgcaccttgttcaatctgtccactaccaaaaaagccttttacttttccttttgcactatcaactgcactttgtgaacgactataaggacgagcttcatttaactcattgtcttcataatctaacatttcattaagtatactcatgtgttaatcctttttaccaaaaccagcactcatatattgagagtatttattgtcttttttcgatgcttcaattgcatcatcaacggcagtgtttgcacgttgttgtccagctaagtcataactgtcttctggtttaccaaaatccactccaataactggttcatcaacatcatcaaaatcgatatcatcttccaaatcagtcatttcaatttgacgaggttcatctttactacgaacacgaatcaatgcttctgtcatgcttagtaaattgccaatttcatacattagtacatttgattgaacaccacgatgacatttaaagtcaaacatccaaatttcaccacaatctaattcatagaaatctaatggtttttccataaaaattgttttctttagtgctccaatttcaaacgcatcatagcgatccattagtcgctgtgttactttactaagttgctcaggtgttggttcaactgcaaacttaactcggtattcataaactggtttcttttcagttaggatttgttgtaatctattcattttaataactccataaggtcgtttaagttatttatttctgttcattgatgcaagcatttcattgcgggttttgtgaactacggtttgcccttcaattgcatctgggtcaccaacagactcaagttctttttttggtttcaaatttagttcaatttccattttgtcttttttaagttggagatcaactaatttaacatctgaatcaattatttttgcatgagcatcaagagctatttttagcatagagtttgcagcattaatcatctctgctgcaaaacgatcttcacaattaaatgctctatcaaaaatatcctcaaactttcgttctgccatttgtgctaaacgatccaattgggtttttcttgcagtaatatcaggtaattccctcaactgtacacgcattgctttgagcttttccattgcaatctttgcatcttccaatgatatttcagtttcagttttgtcttcatcctgatacaaatccatttctgtatcttcttctggttcttgaccagtcatttcaatccattgttgagcactaggtaatcccagtgcttcgtctatttgtggtttagatttcattttttgtatagattcctttctgttataattttaaactccaatccggttatttttacaaaattccattgcataagcccatttggattgatttatagcaactgcaattttttcttttttggatttagccaactccatgtggcattgtttgtatggcttgacttctagtacttgagcatgttgcttaccatcagcaccaatatacagtacataaaaatcaggccagtactggtggacttgtccatctattggactaacataaggaatactaaacggctcaatactccattcaatgactgctggattattatccaatgaaatcattatgtccttttcccacgaactacggtatattggttgattattacttttatactttttaatgttttttataggaaagataccttgagcttgcttagtatttgttatctttgctgggttaaattgttgattgaaagccattaaaaatctcctaaaatgttacctaatccgaattttgaacttgcttcagaaaccaaactaccaaaccctatggcgttagcacctctggttacagcagaacctatgtttcgaattgtgtcaggagtaatgtcgccacgcaatatatcaccagcactacttattatatcactaactgacgtacctgctcggataattttaccaattgttaaaattcctttggttttgtcgtctaattcaccaaaatacttaaaaaacccactaacaccaagaccttctgtgtctgttattagttgtgctatttccatagttggtacaccaatgctcaaatatccttctggtccgaagttgttacatgcttcatatcgcatagttaacgatattaatgaagggtctgcttcactttccatagatttggtttctaattgtacgtcttcaatgaatacatttatcatgttatgtacagtatatgtttcattatcaatctcatatatgttaattgatttgaaaaagtactgattatcgtagtttccattgttcattactgaacgtccccagttaccacctaaaccattaaagttttcaggtgtacttagaacatcatttcgatatgactgtggatttttatcaaagaaatcaccataataaaactttctatatgcatccattagtaagtaaccagcaccatcaacggtatcataaaaaacgacattacttggtttgtaaacaatgtcaccagtaactagtcgttttttgttatattggtttactgtttcaatattaaatgaaaaacttggtaaagttacatctttaacaaaacatgatacattattaacatcaaaatctgtatgtgtatctggtaattgagttttaataaagttttttgcaaaaggtgttaaaacaaattctatgataaaactatttttgaattttggtaaattataaaatgaaaaccccatttcacctgctgtaccaaacacacgttgtgcagcattatagttctgaaaagcaggttcacgaacaatgtttatattatcaataacgccatttacaatacttgtaccagtactgacaaatgaatcaaaaaaatcactcattcattatctccttaaaatcctacactaccaaaaacacgatcaatgatatctaaaccttgattgacattttcaggtaaaagtgaattaattctggtactatacatttcttcaatattatcaaattgtatacaattatctggtttgatagtaactaccatttcaactggagaacttgagctataatctaatgaatcgtatgatatgttttgaataacacatccggttaaaacaaagtattccataacaccagcactgttatatgaagaaccaccaataaattgatctactgcatttactaagccagaattatttgttgcagcagttgcagcatctactagagtatctcttcctagatttcctagtgtatcatctgagttacgtccactcaacatctgtataaccaaaccaaatttataagaaccataatcttggtcatttctggaagttattctacgttgaaagtcaagttgtttttgtaattgtcgtgataatgcttttgctgatgcattaccaactgaatcacggatagatattgtaattggttcccaatcatgactacctatataggaagtattagtagtaaattgatatagtttatgagtactaaatgttacagtaggtctatcaattttatcaacatctaatgcgatgtgatcacgttcatctatatcagtaccgaaattatacacaataacacgaaacttgtattttgctttcggttgtagcattgaacgattacgccccgatggtaaaggaacgccatatttattaatcatgttatttgccatagcaacctctttttattttataaggcattatactttatttagcataaaaaaagccccgaatagattcgaggctatatattaagtttaaataaaattaattttcgtagaagttactatctggtagagtagtactactaatattagtttgtgcaccagaaatagaggtagcagttgatggattaccgaagccactaacttcatcaccgaacgcttcgccatttggacccaatttagcacaaccatctggttgaacagtcattgaaataacttgtgcttcacttgaggaataatcccaatcaccaaagttgctggattcaataaagcaaccttgacatacccaagtactcaatgttccttcaaacaagtttgttgtattttcactattagaaccatcaagctcttgaatccacatttcaaatttaaattgtgaatctgtcatgcgagattcttgactgtagtagttgaattctttacgcatttggttgtatagtgctttagcagaagcattacctactgagtcacggaaagcaacatcaattgtatcccaagtgtacttacctttatagtgtgcagaactgttgtaactatgaacagtaacattttcatgtgatacagatactgccccaactgtattggtgtctagtgtaatcatattaccatcatcattagtaccaaaaccaaagaaaataacacgaaatttgtattttgcttttggttgtttcatagagatacgaccaccgccagcgagcggtacgccatatcgatcaagcattgtagccatttatattctcctattatggaatgacatctttatattatttatctatctggaagtatatttttaattaactaaagtgtcatcaacagggaaccaattaatattaacacaatataagtatctttttcgtttagtgtggtcaatatagtttactgatatagaccattttccatttgtgtatacttcgtatttttcaattataccgacaatcttccaaattttttaaaaatatatttagtatgtgtactgattccaactgagttaaaactattttactgacatcttgtattgttttttttagtatttcttccatatccataatgttcctttataacatcaatataaaggtatttaattttaatcaataaaaaagggaaccaaaaggttcccttagtgttttattgagttttctcgatacggattggtacgtaaatgaagttaatactcttagttggttgaattgcaatatccatccaaagttcattacggtcaatacgctctgcggtgttgttactttcatcacaaaccactgcgaagttataaagaccctgttgttgaacaatttcagccaagaagctattaactacaccactaaattcctgacgagtacttggagtattcaaacggaataggaatggttcggaaataatttctagttgacgacgaatataaacaactaaacgagcaacgttaacacgacttagtgcagaagtttgattagcagatagagttttatctccataaacaagcaaaccacggttaggacgcattgcaattgggttaatgttgttagtatacataacgtcacgttgaccttggttgtatactactggttgatattcaccttcgctgttgataaaaccagtacttgcagcgtttgttacaacaccacgagttgtaccagcaggtggataccatacataactaacactatcactgtatgcatatgtacgcattgcaatagtactaccaggaactgcaacttcttcaccatcaacgttagtacttagacaccaacccatatactgagcagcataatcataagcagttgtacgaccaactgaaccgttacttggtgcattgttagcattagtagcccattgttgtacagcactaccgtttccggttggattcaaacgtgctggaacgtcagtaacaataaatgcagtttctttacgatcagtgtttaaagttacacattcatcaagtgtttcaacgtaaccaggtacacaaattaggttaaaatcaataaattcagaacgaatgtcatcattaccaataataacagcagctagtgcttcaactactagttgacgttgtgcagcacgaccaaataggccagcaccatcaagacttacaccactaacaacttcccattgaccattaaccattttcttaacaacaccttcagtgttacctaggtcaactgcaagcataccattttgatacaatgccgccgcaggaacttggcttgggaaattaaagtcttggaaaatcataccatttagtgtactttggtcagtactgtcaagtttaacccattcaccatcaacgttgcgatagaaatcataaccatcaatgccttgagacaaaggacaaacccaaattaaacggtcagccgctggttcatcaacttgtacatatttgttttcttcttgtactagatcccattcatcattagcaacatcagcaacatacatagttacagttaaattatcggagttcccgaaatcataccagagagttccttcttttgctacactacgtggtactgaataactaacacggaagttattaacgttaattagagagtagttgttactatctacagttagtttttgtagttcagattcagcaaaaatatcatcaccactttgtgtgattttgaaactgtaaccttttgtattggaaacaactaaaccaccattagtttcacgtttaaatttaaaaccatcgttaataatttcagcatttgcatttagattattgatgatagtttgggtattaataacaccgccttgtggaactgctagtactttaactgatttattcaaataaacaaaagtcatatagctatcagcacctgcttgttcaataatagtttcaccaagtggcaaagcaggagcactaattgttgttagttttgcactttgaatatagaaagagaaactcttactatcttcatcaaaacgagatgcgatataactattgtttagtacaccacttttcgcttcaatttcttggaatgaattaccagtatatgctggtacaatattccaaacttgagttagggatgcataacgtttaataacaaaacgagtaccaaaatagtttgaaccattttgggtgtaaccatcacgaatccaaatgttacctttttctacagttgagccaactggaactttgttaattggtgataggtaagtttccatttgcactagcccagaagcagaacgtttatacattagcatctgaccattgcttggtttgtaacgtagaactaaatcatcaacatttaaacctactagacttacatcttcaacttcttcagcacttacaatagttactggcttaagttgccaatcataaaaactgcttggactatctttcttcgctacatacgcttctacttgtgattgtgcggtatcaaaccacaaagtaccattggatactgggccagttggtgcttcagcacttggtgctagttgtgctagatcgatatcagcacgaattacatatgcacggttagtaatgcctagataagaatatactgcatgtaggccatattcgtttagttcatcaccttgaacaacagaaccgttattcatttgaaaaattggtgtaccataggtatcaagtgagcttttttgtgatgttagaagctgtagttttccagcgtttgctttagtagttcccgcagcaattgcactgcttcctgggacaagtttgtcttcagcagtagcgattacaaatagtggtacagtgccaggagcagcagcggtactcatactttcatcagttactgaaatggaaacgccaggtgagagtagatctcctgccatattaaatcctccaaaaataattggttattcgaaatatattcgtatagtcttatttattgaaggatttaattgtccagtccttattgtttataatttatgtattagaataaataatgtccattgcttttttatgtaaatcatcaatagtactgttattctgtacaattatatcaggattgtttattccaatccaagcccactcagattcgtgtactgattcaagttcaactggtttaatattaatatcccctttattataagaggcagccaaaccataccaatgtggtagaacacgttgaacttcaataatagtcccattattcgatctaatcatttttaattcatttggaaaacggcaatcagtgatgatgatatttccatctatgtcttgcattgatttttctaaactgaatacccaaatatcattatgaaaatacttacgcaaaatattagtaccataattctgcaatacccatcgaggggatacatcattacgacctaacttatcacaccagtactgatccggttcttcacgaatcttacgactttccttagttgacccctcaagcatttcacggtcccatccaaagatggcagcaactgaatcttttagattggttgcgaatgacattcgtgtgtaaccattattaataaaagattcaccaaatgtatctttaccacttccaatagttccgttaattgcaattatttgtcttcccattatactactccatgtattttatataatttctattaaatcctttcctactaaactttcaagtaatccaagaattgactcattaccataatatatagaaacataagtaataaaaaatgtttccccatcatcatcacgatatatactcgcccatgcatttattcgatctctaccgataacatcaatgattgaatctttgataaatttccagtacttttcagttgattcgtaatcaagcgttggtctaccacaacgatatctgttatacgttacatttatgttattattcatgacaagttcctttagattaatattatcattatatcacataatatgaaaaaagactccatataggagtccttttaatttagccaataatcataccgagtggttcagcaccatcttgataacgtgtcaaacgctctttaagctgttcttgaagctgtaaaccttcattgcgtaaggtatcaccatccatagaaaacgttccctgtggtccaggaagcgatgcgaatttagcacggttacgacccaacattatcattgcttcggataaagcccaatcacgcaaccaaggataactttgctgcctttggaacaacaatggttcaggaatattatgatacacgtgtaatagtacttcttcagtacctcgaatatcacgatctataattaattttttggtcattgggttaaattgaaatataatatcacgaccaaacatacgacctaccagttcttggaactgaaaactaaaatcatatgtagttagatcatatccaccagcatttcgtgctgaagtcaataagtaagtgttggtgaatgctagagaaaacgggtctactgagttcccactaccagaacttaagtaaccattaccataacgataaatctttttaacaatttcaacttcagttggtagcatatatacagattgtgaatcataaaatttcatatttaaaaatgcttcttctttagaagcagaactccacgctctgtaattcgataccgcattatcaattgcaatttctaattgaccatcagtaatttctacctcaacggccccagcacccaacatttgagtgataacatctttcagtttttcacgatggtcaaagttaggagcatcagggtttccacccatataatcgtaagacataaaaaagcacctcattaatgtttatatacattatttagaggtgctaatagttattttgaattatacaagcagtacaggtataccaatggagtaaaatgttcggaatctattatatatattaactgagtaacatatattccatatagatctcgtgatttatctctgtacattaacaatgatttatttaagtaaggatcaacccagtacttaatatcattgtacttcaacgtgttgttacggtaacctgatagttttgaatttttattcaattttcttacaattactcagtaagtgaatgatatcatcagcagtgaatggtcccaataccagaacttcttcaccatttccgaaaatgctcaatggcactgattgttgaccagctagatattcaatttgttccagttcgaaaatgtcatcagcagcatatactacctgctccatttcattatctttaatccatgactgccaatgttctttaaacttcttagcttcgtattcttgaacatagttaggtgattcagggttgtattgatgtaacatagtcatcccagccattactaattctttaggggatggtgtagaatctttcagtactacgatagcttggatagtttttactttaacgtcattagcagccattatatacctctattatagaatgattttattctcaggaacgaaaacttttggagtgttttcgattgctttaatagcatcaacataagcatcaactaatgcagggtttgcatcactaacactaataatgttggatttataaaaaataacatttttctccatactaacaaactctagataatcacgaagaatgatttcaccattttcgtcagtccctagttgtgctgggtagttaactacaacagcttcagcagaatcggtttgaagaactgctagtactgggccaatgttattgatgtttagtagtttaacggtcatagtcatttttgtcaagtccttttgtttattttagaatgtataagtgtttttctgcattgaccagtcggtgatcaatgatttctttgataacgttccagttaccgccgcccaaatcggctccaattttcgggaagtgtacatgaacatctcgatcaactttacaaaaataatttagatgtttgaacacatcgtcgattgcatcataactgacatatttagcaccgtcattaccgtacattttttgggtaatacagtttgcaataatcaaattatcgttaattgctgaatatgcaatttgtccaattctaagaaatcccatttccttttcatatgctttataatcatcatatgccattgggtaacgatttcttagctcttttgcaaaacctgaacccattttaccctgtgcgttacaaccatgagcaattatatgtattgctgttttatcatctgttacagtactgaataattcaaacagattacctcggtgttcatgaatcattatattctccgaaaagaaaggactctgtggtcagagtccttattttaaattattcttcttcaccgaaacggattttctttaattcttttcgatgctttctagctattgtacttttgtgaagtctattactgcgttttgtgtcttttgtaatgtaccatgaatcttctggtgcatcataatcacaaaatccatcttccgtaattgttcctaaaaatgcagattttttaggaatattagtttgagctttagcctgaaattgaccttttgctaattgttcacgaaaactgagcataatagtatctcccaaattgttaagaagaactttttgttcttcacatttatttagggttgccagaaaccttcacatgtttgataaatgccaaaatatcatctttactaaaagattttacaataaattcgacagcggaatcatactgttcttgtttagatagatattctttcatcttgttaattttaatctgggctttttctttagctattgaaatatcaggaattttgaactctactcccaacgtatcagctagttgttttgcacgagatgatactttttcaatatccattagttccaacgaccttctttaagaccttcaataaacccagtacaaccacctggtacataaatgtcatttacgaaaatttgaggaacttgacgaactggttcaccacaaatttcagacagttttgaaccatcgataccttcagcaacaatatctacaaactccatttcaaatttattttgttcacatacagcttttgcagtgtcgcaaaatttacaaccagtcttgcgaccataaattttaactttcatgttatttccttctatttctttgaaaagctttaacagctttaataatactgttacacattcgttcagtcaaatacttttgacattctcgtacatcaatgtacatgaacttatccaattctggatgactcttaccatatctattagtgtaagtacttttacaaactaattcatctggtattggtttgtctttggcagtataaaagaaaagtactaacctttttccctttctataggatacatcaccaagaaacagaagatcatcttcatcgatttcgtatcctgtctcttcgaaacattcacgtacagcagcttctttgaaagtttcattaccctcagctttccctttaggtaaatcccaatgattctgtccgtgttgtatgtccgataagtatctgaccatcacgataaaatattataccacaactataacgcatatcttatctctttgtcatcaatcgatgttcagatactaataattatatcagttattggttttttgtcccactattttttagaacatttgtttgattgcttcataacgaagttcacaaacaaaatcacgaatttctgacgtttcaagttcaccatctttgaccatttgctgaatatcaggcaattcaacatcagtataacgatcataaactttaataattagatcttcaagttctaaatcaatttcttttcgcaaaatgaagtattccaaaactttataaaggaattcttcacctccgttatttttaatattcatatccaataaaatattacccatttcaataggggtctttttacggaatgttttgatatcatcacggaaacgtttgatataattactaaatttaacatacttaactggaactttaatagcaccgttaagtactgaatcattatttacttcttcattttcaagaagaatagaccacagaaaatatggtttatatacatccgtacagttctctgcaatataatcaataaggtctaaattctttttggtcaaagatgtattaaacaccttttcgtaataaccaaatttacttagcgtcttaaggaactttgcaggcttttcttcggaaaatgctttttcgaattccacaaaaacacggtcaggaacaagatgatttagctcaccactattgaccattccaatagctagttcctcagtgctttcatggatagtaaagtctgaataacgagtagcaaatcgagcaagacgtaacacacgtaatggatcttctttaaaatggtcagaaacatgacgtagtaccttgttcttgatatcagctttaccaccgtatggatcaatgtgaatttgtagtactggatcatacgaaattgcatttattgttaggtcacggcgatacaaatcttgttcgagtgttacgccttttgtatccacttcaaagccaccatatccagtaccagttttacgctcagtacgggctaatgcgtgttcattaccttctggacttagatatacagggaaatccttacctacttgcttatagccaatactttgcaagtacttaatatcagattcagttgctccgacaatgacataatctttgtcttttgcacgaagacccattaaacggtcacggacgtagccaccaaccaaatactttttcatattattcccccatcaaccaatcacgcaaacgttcccagaagcctttgggcttatattctgggtattcatattcatcagtgccttgctcggaaacaccccaatcttcttctaacatagcaatcataatgcctccaattaaattaatctatcacgtagacggtcgtaatatttttcgtgtatagctagtatacactgatatgcagaatagtcaatgccaaatgtatcatcaatgaacatgtactgatcaagtgtttctggtccattatcatcaactggtaatgtcccttctttttttgatagggtgtgccacatcaactcactttcaatatggtgagttgcgtatgtcaattcaatcttactttttcttagtaaaattaacaattcatcattgtcgtcgagtgcattacgaaatttaatacgaacagtaccctgaaaattattagtgtacataacacgatgttgattatatgtaactaaaccacgtctttcagtactgatttcatgttcagcaaagtactttaacgtttcattaaattttggaattttagtaacgtccaatcacataatcctcataaagttcgtataccctcattatactctgatatgtatcaaagtcaatgccaaaggtatcctcaatgaactgatattgcataaactcttcctctgtagcagcaataggaagagtcccgtttcgttgttctgttgattgaacatcctcaatatacatcaacactatactttcatccagatttatatctatcataaaaacatcttcactataaaataagttatatgtacggatgaagagatttcctgttctatcataacttgacacgtgtgtttcataatacattttatctaaactaaagaacaaacctgtactatctggctttttagtattttttaatttaatttcgatagcatcaatcataggtttaatatcaaactttttcatatacaaatcacatacttattactatgtggatcgtaacaatatgaatcatttaccttaataccaggcttaagttcaatagttgttcctgtttctgtactgggttctgcatcacaataaatcatcacaccaaccccgactagtaaggatatgatacatataactatacatattgtatattccataaatttatctccattataaaaagtaattatacagtttattgtacaatataaaaaggtctttcacattatcataagtaatatcagatacatcatgaattaatgataactgaaaaaatgaagcttcgtctatttctgctggaattataacatcaccatcgtcttcgtccattttattggtgtagtattttatgtgatctacattcaactcaatagagaacgcaatgttggtttttgtataatcttcaattaatccaatatattgagatttttcattaataaaaaatccaatcccaacacaacggttatctggatatggatagtaccatctattaataactaggtgttcaggtaagtccatatcatgtgttgatattagagattttacaatttccatccaggaataattcataattaaaactccataagaaaagggacagaattaatctgtccctttagtatatattactcttcgttttctgtcaaatcatcaagaactgggtgttctggatggtttctgcggtgtaatttaatgcttttgtctttactgaatacagtttccatcttatcaaaagattcaacaattgctttatacaaatcagcatcatcagcagttactgatttactaccagcagttaaagttacagcatattgagttttatgctctttcttaacatgaacaccaatgtctagtactgaagaagtacggtacttatccagactttttgcttcattgtaaatagcatcttggattgctggagtgatatcaacgttgccttgaatatttagatttagcatacttcaccttccttttttagagtgaacttaacaacaaatctgctcggtttgtaacttgacgataccataaggaattcataatttcttttttaaatttcttagggttatcatttttcacacttttccaaagtttattaaacgttgctaatttatcaacacccattgtataggacatttcataaagaatacgttgttgttctttggtcagatttactgcttcttttttctgcatcaataataaaaagtcattatatgttcttttcatatcttgcattaaaagtttattggcttgagctttggtaataccgtttctgtacttaatcgcatcagattcttttctacccaaataatgcccataacctattgtataattacctttcatgtccttgtagggatgaaatttagaattgtggaaaggaactccgactttcccaccaagtaaacggcgtttgttcttggactgaaattcaattgaaccttcagcttctttgatgtgattgacaatttctggatcattataatcaaacagtacagtcacatctggtaacaatacgttcttcaaatcctcttttgttgggataaagataccctgagaagtatgaagagtagcatttaaattgatatttttcaacaaaataacatactcttcaagttgtacatttttaggtttaaactttttagcaatagaataataactatcaccaggttgaaccgtataatgcttctcgccgcgtggaacatcctttgatatttctacctttggtaattcctgcttttgaatttgcgtaacttgtggttttaaattgtgtacctgactttcgtccgatgatgatacacgatcattttgagaaaaaccataaaatccaatcgcagcgacaagtactgtgcaaactagaacaccataagtagtcttagttttcagtgcttttttcgcttgtttcaaaacgcctcctttgttgattgttaagatgggcaatcacaaagatggcaaagaggccatttgcaaaagcctcatcggactttctacagtacaaaaacgttcttttcaaatgtttaagtagtatagcatatttttattttattacaagacatatttactgtaaaaaccacattaatcgtagtaagttctacctacagtgatgtgatatttaaagtacttggttggtagtcctagttcatttctaatatgtgtgatgaaatcatcttcaaattcaatgataaagaatgaacctggattctttttatcttttactatctcaatacaaggattgaactttatctttactttcattccatcgtactttttccagtactctggatttggtggcacttcaccacgaacgatactgacatgtgctccccattgtgggtctttaatatcaatatgtaagtcagttctgatgaagtactggtagtatcgaaccaactgtaatggaagttgtagtactaaccagaagtccttcttctttttcatagtgccacgatctggatcatacaccagagttccttccatttcaatcatatgttacctataaaattacatatatgtttttattttcaatacgaacatatgtttccaaaacatctttcggaattttattacttgttttgaaccatgtagtattctctactaaaacaaaagtttcaccttcagtttcaccaaatgtacttagtgcataaatgaagtaattgggtgatgcactacaatatatatcagcattaatttcaatcatattttacaccacaataaagcttaatacaacgagtgtaataaacacacccacaatggcagtcatttctggatttgcatcatatgtgtagcgtatgcattttagaaaatctttaccaaatttctttagtccattcatatattttccttttatttcttgtgtaaaggttcatcactttcataataaattgtatcattatttcgctctatagtaaagctcttttgacacaactcttcagctaaaccctttgcatagtttaatacatctcggttgagatatacttcttcttttggaaagcgtgggtactgaataatacgagcacacatcccactttcaagaccaccagtgtagatatattcacagggaattaattgtacacaaaagccatgcttaaacgcaaattttcttgtgtattctcttgctgtttgaatatcaccagcaatatggatattccagtactgtgtctccactgtacctttatcgatgtatttcatactcatctccaattatagcactaaaaatctcactttcccaactcttctatgattctttttattgaatcatggttttccagacataaagtactgtaatttctgccagttttttcattgaggtcgtcgatttcaatcataagatatccatatgtaatatcttgaaccctacttcgttttacccttgagtacagtctgatgggtacagatacacgagtattcaaaaagaattctgataaatcataacgatataccaggtattcattcttgtaacgtttacgactgtacgattctaaacactgtggaaaacgtctatcaaacatactacttcttagttgaagtatgattggatctaacttatgtgagtaatattttttgattattttatcaaatctttttacgtgtcgtttacgccatctcatgttctaactcctttcaataatacaataggaaaatactgtgtatctgtatcagaaatactattacagtactcaataatttcttgatggagtgtgtttatataaatgctaggatatggaattggtgtttgtattagtccagaactataaacacaatcagttctttgacaatcaatatagtgtgttgttggtatacctttaccacgttcctcaactacaattgagtacgagtcagcaataaaaatgaacgcattgttaattgatacatattgtagggaatacacatcatcatgaacttcaatcaaaggaccatcaaaatacatcaataccgaacggcgataacctaacacatcactcattgcatcgaactgttcttgtgatgaaagataacaaaaacacgtatcacgacatacgtcaataaaacgcttaaatgtttctgtttctataagcatataattttccttaaaaaagaccccacatagtgaggtcaaatacatttaatcgttatcatcatccaatgcgtcacggtaaacataataaacatgtgcacctagcagagcaataagtacaataaagattaaccagaatggtacaaaatgcagtactagagaaaacgccagtactgtaataaccattacaactgaactgaaaataagacttactgctttttcaaatccagatagtaattttttaaagatttttttcataaatgaatcaaccatttttaatcctcaagaaagtatgcttacattttagtttattaccatagaatgaaataggaacattaaacatttcaatcttatcttctttcaacaaacgtagaatatcaggatcgttttttgtttgaatgcaatgaagaccattaacctgaatttctaaacctttctttagatattcataaattttttgacgacgcatcccaccataactatcattatgtaccacatcacgtaattctttatattcttgcttcaatgctcggtctacaagtgttccatctttcttcctgatctctgcaatacatttatattgatttgaacctctaagagccatgttgtacctcattagggtattttttcatcaattcatgtaaacgctgaatctcttgttctttttttctatcactctcgtattttcgagaaagtttcttttttgtatttgcttcttctaatctaatatcagtacagaatttgtcatttttaaaaaaattgatacgcaatgcatcgaaaacagacttgaaatcgtttcctaattctttagacgtgtcagtgtaattatgaaaatacatgttatttgtcatatttacatgttcaattactgcaccattatgagttacgataaacattatatctccatactgttcacgtggttcggtacgatatagatatatatgttgacgtaaataatcttttaattcatgttcaatgccactttgttcataactttgatatactaaaacctcaccatcagttgaactgttgtcagattcatatggttcgcggataattataagattatacatattactccttataccggagatacggtactcaacattagtaaagctgtattttcatcaatttcatgatagttgtcgcatacaagtgtttccaacaaatcaggatgataataataatgttcataatcagtatcattaggaatatgatgatatacaaatacaatatcaaaaacatcatcatcattttcactcttgaaacgctttaattcatcgacactttcaacaaagccatattcttcaaaagcagttgtaccatctggtagtttcatccatgcacttgcaacaattttcataaatttgtgaatccttattattttgtaatgtttagtttagaaacgaagtattctttggcttcttcatatgtcattgaagtatacataggattccatttatcgtcaagatcagtaagtactttaacttccattacatcttctggtgtatagaattgccatgtattgtgatctggctcatagttagggtccagtacaaaaaccgtaccatcctgaccataaacttctccatcctctaatagctcacggaagaaatcttctccagtagttgggtcttcgtatgcattataaaaacgaaaaactacattctcaacatcagttcgggtagtaccatcttcttcatcatattctaccaaacggtcctgatgaaatactaggtcaatagcaccaatgcgaggtttattatgtggagttttgatttcttgctgggaattataatcaatacgttcagtactgatgaatacgccactaggggtaatttcaataccagacacattttctggtgaatagtaagcgtcacacatgtcatcaatgtgcatgtgctcatgatacacttccatttcaggattctgcaacaacagtgctgctaagtcttttgctttcaatcttcaatctccatagaattatcatcatcataatcatcactggtgtacttagtttttacctcaataccattctcatgtagatatgtgataaaaccattaccataaacgaattgattataatatgtattttcttctacatgtgcatcataatcatcttcataatatgtgggtattgtaacatcatggcctacactttgcaagtactggaacaattctttcagtactacttcgatatcaccttcttctgtaccataacaataagcaggttcaccgtgagtgaatttgaaacctttacaggaaactgtataaatgtcactcatttgtataccacaatcatcacattcatgtatagaacaatgctggtggaatttaatctttttgatttgcatttagaaaatcctgtaaagatgtagtagacattggactatcagcaccatcataccacagtgatgtatatggctgaactgaactaatatcaatacagaatccttcacgctcacattttcgagcgaattcttcagtagttagtttgttaccaaaagaaatctcaaattcataactagacatatcaatatcagtactgtaaatcaatgcaccatcatatgtaatatggagtttagaatctgcgtcaaaaagacgatctgaaatagcttcataatcatcttcaggaactgcttcaataagacgtgccattagtccagatgttacgcggtaatcactcatgttcaacctcttttatttttcaattttatcaatcatagaaggtgatacttttacattgaattcagaatcaggaaaatctttagaaaatgattcattttgttcttgtgaaagttcttttttcggtggaaataacattttggctaaatttttaccacattcaattgcttcatcatatgacatattttcccatgtttcatgccaagtattaggatcatattctgtcagtactgaaatgaaatcaatatcatcagatgtataacaaacagcatgttgattagagaattgtgttgatttatttttacctaataaaacaattggcttttcataaggaatgttaaataccaacccatattctaagctaagaacagtttgaatatgtgaaccctccaattttggagtaatagtaccatccttaaagaaaatttgcacatgacccaagaggggggtttcgtatggtgtaagtacattttcagaaactgatgtaggttttaccgttgtgaaaataccagatggtgtaaccattaatctattatcaaaattctgataatgcaagtcactctctgcatcataatgataaatttctagatttggttgagatagtagtaattttgctaactcatgcgatttcatattatttctccaaaagaaaaggagagtcatagcgactctccatatagtttattgtaaaactttaagtttgtaaagtgttccttcaacaaaactcataatatcttctaatgtgtttacactgccgtaatcacccgattcttcaagcatatcatgaattgctctgcattgctcaacatattcttcaagaattggtacacaatcttcaattggtgtaaaacgataactattaccagtcccaacttgcaaagcaccacgattattcatgataccttcaacaaatgcgtctacatattctggtaattctttatatagttcatctaattgtaaatgctttgtataaaaatgacattgtaagtgccagttatgtgcagcagaacttaaaaacaaactattttcaataaaagttaatagtacttcatcatacgaattatcttcttcagtacttccgataaagtccattacgtgtcgtaaatcattaatatcttccataatatctctccttagagttattctcttattatttagttaataataaaggtaatttcaggattcatttcagaaactgcattgcgtttacttctatcccatagtattctgttattatacaaagaagaatcacatactacaagtaagcaatttcttaatctacttacagtactttgattatttaaatcagtttctgaaataaaaaatacattttcaggaactactaaaggaatagatttatcaaaaaacaaaactacaataggtcttgttgtatgaactgatttaacgaaatccaaaatactattataaaaattagtttctttagtaattactgacggatctttaattcttttcaaatattgctgtggtaattgatgttcgtcttttatctgaaactcaaaatattctttgaataacatttgtgttaattcggatttatcggatattttcgttgtgttactcattcacttcgttctctcgtaactcaagaagtcactgcgtttacttcgtaaactagttccttctgaaaatgataatgtactttaaaaacttgacgggatttgttgaggactattacatccccccgcaggggaatgaaggtaataaaaaagagacaattaagtctctcttgacgatgatggcatcggatattatcgaattgcgaatttctcaaattttggacggatctttcttgtaccaaaatttagagagcgaaagcgggttgctcggtttctctctatcgcagtcatatgcaacggtcgctggtcttttcatcaacagcactcagtactaactctattcgatcaaagtagtacttgttctcaaattttggacgcaactttcttgtaaaaattgcgtccgctattcttgaactcccttagcaaatctggtaaggtgcgaaccttatacatctatctaggaactctctgtatgcttatcggagttctttatacagccgtgtcgccgtgattcgtggtcttacatcgtgtttgtttgaatgccagtactctaacaggtttcttctgctgttcgctacaacggtaaagctcatctatcctttacattttcaagagaagtaggttctcagtgtccatttttcaatgtccgttgtcattttctatatacattatatcattggaacatataatgtcccattacatgtatactttttttaaatccttagaacaacgatcaaaaattgtgtttatgaattcaacatcttcgataatattcgaatcgttagcaacattttcatttcttgtcgtgttcctatatgtgtgttcaggatgattgtataccaccttgactacattatttaggtctataaaatttgacgttttttgcgtataggaagcctgaagcttgatgagtttaccatcattctcaagattggttttatgaattagttcttcaatgccagttaaatggctatagctatctttttcttttacaaaagtaatagtaacaagaactgctttctcatctcccatatcggaaatgttttttacagcactgataatttctaagtttgaaaaatctaattctttaagcattttacaaatatttccacaaagttcgataagtgataatttcttctctggtaacagaaacttcattgcacttaacaccatcagtttcagtactgaatggttgtactggtctatcttctgttaaacctcgttcataagtacaatgataaaacttatttgtgctcatgtcaagaaatacgagatcaaattcttcagtccaccttctgtgtcctttgctttcattgcagatgattttatattttacatctggtttaaaagtttcagtactgtcatcccatgcaccatagtcagtatattcatcattttcatctaactctgctagatgccacattaattgtggtaaaaagattttagatttcatttattttctccaaaaaaaaggacttgaatactcaagtccctataatatcatatcaatcatgtttattcaatttcttctgttcttttttcaaagctttcatatgacgaccaaactctcgaacatgccatagatgatcagtttcccataattcttgacgtaacctacgttcttctagtagttttgacttgtcaatgttatttttctttttttgtacattaaagaaattattcatatgttcttggagaagattacgacctttaactttctcaagaaactcatcaactgtttcagttttattcgaacgtagttgattacatctggagcacatagtattaaagtttgactctaaatcaggtccacccttagatgccagatgattatggtcaactgtcattaaaacttcataaagaccacatacagcatatacatttaaatgtggtttaccatatactggatcagaacataatgaacgttcaatgcgtacttcagtagcttcaatcccacatgccacgcattttggattcttaacaaaagtaagaactttttgtgggaaatatcgaaaagtaataccatttaaagtgtagcgtttcatcttagtacttcgttgatttaattcttcaagaagtgataattttgtcgtatagtaaacatgatatttgttcattttattccttgatattgattttaatatctttaccttgtaaatcacgaatagttttaatcaatgcgtcatgttttaaagcacattcattgtatactgcatcccaacgagtaagtactttaagaatttctgcaccatcataacctttaaaaccatttttgtcaatcataattttttgtggtagaggtgtatcatcatcacatctttctaacagaatttcttgtttaattggtgcgggggattgtagttttacttgctcggcacacccacttataattaaaaaagaaatcattggaactaataattttttcatttgaatttattcctcgctgcttgagaattttgttttagttcattcagtacttttacaccatcttcatctaaacatacattcttataaacttcacgttctacaataaaaggaacctttgtttcaataactttagcattatcttccatgatttttttagtttcaaggtaattttttgcattttcttgttgcattttatccaaggcggtatcaacttttttagctatttgttgctctatgctttgttgatatccactgtaataagtattagcttcccaaccagcataagctgaaccgccaattaataatacaaaagaaattggtttccaaaatggaataagaatttttgaaacaattatttctaacatactcataataatatctcctatagttgatgatattatttagagtatacaattgtatagttttacaacattttttgaatatgttctactagttcatacagcttcgtttcattattctcgaacttttcatcaacttcaacattgaatttttcttctagttccatgaccatttcaatccaatcaagccaatcaaaattgaatttttcttcgacttccaatttagtaagattgaagttcgctgatacctcattctctgatgtatcacagtaacgagtagtgatgaatttgacaatttctttttcaacatcgtttaattcacgagtttgatattcgggctgaagataccaccattctcccttattaatagattccaattcttgtttgatttcatgcattactttataacggtcagtacttttatgaatagaattgacttcttggttcaatacatgtagtgcatttttaatacgttcatttaacattttatcaccttataaaaaaaagagaactccatatgaagttctctgattatacataattactttttctatgtcaagttataaatcacggaaacgatttggtgtgtttaagcggtacattgagtataatcccaatccacgcataatctcacctgcccagaaaccaaaaaacataccattatcagtaccttctctaactgctggactccatgaaccattcattggtgaacctggatttacaataacataattcttttgaagttcgagaactaagtcatcagcgagtgttgttagaccttctattttacatccagccaatccagcagcacaagccccagctaaccacaacccacacatatgacctgtaaagtcccaatctggaccttcaactgtgccatctttattgaagattgttggtgaacgaccatcattatctttttgaaattgaattaaaaagtgaatccaattctcacaaaattcaacaagatctgctggtggttcaattcctctctctgcgagttcttgccatgctctggcagccccaaagaacgcacgtggttcatacccactccatgcttgatcaccccaatgtagcatagtaaatgtatctggttcaccatattttaagttatcccagcggttccaaacatatgcttgtgcacacggaccaacagtaccgaattgttgagtaaaccatgtttgggaatctttcataaagcttaacatgtttcctaagcgtgtgttatctactggctggtctttaaaacaatatatcacaggatattgataacctggatacggtaaaccacgccatcctgaatactggttcgcatacgggtcagtgatgttagaaaatggtattgttcctggtgtgtaatgcaatgagtttaacaaataatctttgattacacaatcccctaactgtgcagtatatggtgattcacctgcaattgttattgaaaatgtcatagtatagtcatcaccgtcagcatccgtgtataattctggaatgtcattaatacaataccaatcaattattgcagcaacaccatctactggggttgtatcaggtaaaatagtaatatcttctagttcactataaactggtgcatctggtcttgggtcagaacttggatgatttggctgatacccagataaacgtaatgtatcggaacttagtgtgattgtagtccattccccgtgtgttgcaggaatcatccaccaccatctccaaccattatcatctacaattcttatattgtaatcatcttcatatgaacgataggtaaaagatttaacttcagacttatttgttgctaatagccaaaatccaataacagcaccatcatcttcaccacaaactaactgattaatggtatcgcggcgtgtaactaatatatcagtactatatatcatttcggacgtagctgcaccataaggaacaacaattctactatcagcaattatataaggggaaccatctgctttcttttctctaacaaatgcacttaaaggtgttaatgaatgtgtgatattttggtctttactttccggtaagccacaacgataacgaacaacatcatggtcattttttgtttttgacaattccagtactggtttaaatgataacggcttaccatcatcacatacaccaccatagtctacaagtaatttagaatcagcattgaccctgaaccaaatagcttgttgttccattgtactttgtgcactttggtcttgcctgatagtaatatatcctagagaatttctaccaaacttagcaatagcatcacttggataaaaatattcataggaaataccatcagtgaatggtgtggttacaattgtactttgtctgaaaaatttatctctggagtcaatatcaccataagcataacacgttagtagtgaacatttccaacccaaataatgttttctttcttttgttattttatataacaaataagaagcatcactaaaccacaattctgcatctgatgcgttatccgcaaattccaaatcaattggaacatgaagtgggcggttgtgttgcatttcatttcgttgaattatcacaccaccatattctactggttgacgatttgcaaaatttaatttatatacaccattaattgttgtattctttaattgaacagttcctttttcagattcgtcaaaaccttctgctaaaatattaccatcccagtcgatttttctacccatgaaatcgataatccagtcaacatcatattgttcacctggtgtatcccaatcaacactaccatctggtaataatgcttttactgacgcatttatttggttccatgctaaagcacctttgaatgcaaatgttactttatccaagaactgaccataataaggtgcaccatgtggtattttacattgtccatttgtaaatgtaaattctacacccttgaaaccaccatgtgtaggccatccatcatcagctaaaggccagttagccaatataggttctttggcattaactatccagttacattgtagtggtgtaggtggatctggtaattcacgtccagcataaaagtactgatgatatgcatcccagtaccatttggctttatctaaaaacattggatcatttgttgccagatacgcataaatgtatcctaaaattaatagactttgaccttctgttgtcccgtcaccgtttggttgaccttccattgcagaatagttaataaaatgacggttgttcgccaaaacaccctgattattcaccacataatgttgtactgttgggtctattgtatcaccagtatttctttcaataaatttgtgatgcccataaagaagttgtacaatattatcaatattattgtttaacatatcatactcctgctctaattaatgcaccgtaccatgtaactcctttatcatatgtttctaatgaaataatatctttttcaccaatttcataagaaagaacaactggtctgttatatgaccatttaacattagaaccccaattaactaggtttgaacctgtttgttgtgttaataggatggtaattgaataaacttcagtaggagccgcaccaatcgaaatagtagtatttctatcagataaattaatattaaaaacagcattgcccgacagtggattaattaaaatattattagaacttaatacattatataacttattacttgcactatcatataatgttacccattctgtttcatgattctcgttagtagctttagcttttatcttaacattattttcagaatcagtcattccagtccatccagatataataaaagaactgtttttattagttccgaatgatgcaatcacagaatcactaagagaactatcttcaccatcaatagatccgagtactgacaatgttaaaaccatcatttttaatgtctacaccagttgcacctgaaaaattattttgaaatttaataactccggtagtgtggatatctgtgaaaatttgttgtgccatacttaatccttgtgttaatttatattgagtatttattgagtgtaatggcatttttagtaccattacacttgtatatgttacttataccattgcatttctctaatatcaatgataatttttgatgctaacttgatgtttggttttttaggaagtactgatttcttatatagaacatcacgaatgtattgtactttatcatcgaaatattctaatacttcttcatacttccatttaccattacgaatatccatcaacatttgtgcatctggtcgtttaacttgaataattccactttgtaatgcttcttctgcactattcaaaagtcggattgtgtgcatagcatgtttacaatcgtatccgtgttgtgattctaaaatagcacgtttggcattacgattttctttccatttatgataacttttcctattctcactattttcctgatattctttttcgttaaatttgacaattagttctggtttggttttcaactcttcagtactacgctctttagaaaaataacgcaatgatccatcaccgttgatagtgctttcattcggatttttaataatcgcaaaaatgttttctccgtaatgaattagttcataaccattattaaaattcaataaattgaaatcacgatcaagaattttttcagtagtgtagttatgcactaatcttacaaaatgatattgctttaatggatttttcgaaactaactgcaatgacgtatcacgcatatatttttcaaaatcaatctttttagcattaaatggatgtaagttggatgtatctaaacgttcaacaagatactgtgggaatgaatcatacatccacgcaagaacctcatcgacagggtgttcttctaaaatctcatttaatcgtttttcagcaatacgctctttatccatccaaccgtgatgatttgtcatacgcttaatctgattatatgcatatccagtgtatgaaaatgcaatcttggaactaagaagtttttggttaaatgaacgaagatagtcataaatctcagtactttctacaatgtgttctggatcgacccatagtgattccaatatattagggttggcttcagtgtataattttaaatactgatttaactcatagaatttagtatcttcttcatttttatcagctacttctttgaccttatagaatggcgtaagaataaattctttattagcaagaaaaataccacgataatcagtatcactttcaggtgtactggttccgtaggcttgtgacccagccaagtgtttcactattgtttgttcaacatattggttattcatagataaattgttaactcctttaagaaaccgttataataacgattaaagtcatgttctaatgttttataatcatcaaaactaaaacctaaattgataattgtatcttcttgaaagaaagtttcttcattcatacattcaattggttcgtaattaattccacctttaaaaacttttgtaaaaaatattccatcattattaatttcaacatacataaaattattttctgggtcacgagggcagacgatattcagtgaactatttccactcgtgttgtactcataagaaattatatcaaaagaatcaataccataacacttagatttttctttatcaccaaatacttttctatctgtactcatattgcgtatagtgctgtagatatcatcaactgtagtcatcgttaaccaccatactttgacttgtatgtttcaagtgataaagaaatacgattttgctttttaattctttcatcaatatcctttgaattcttcacacttcggtatacgtcagctagtaaattataatcttctttatttgagctatgctgtgcccaacctatctctgttttaatacgaacatttgctttatttgacgagtaaaagaaactgaatccattggacccatcaaaaatatcaaaagtatctacccaatcaccataaggaaagctcattggaactgactcatggtctattgtgatatccgataaattttttgaacagtacttcgcaaagtgataaacgattggatcacattttgataattcgtatttgtattcaatgatagtttttctattagcatcattgatagcatattcttttatcaatggactttttttgatgataagagtccatagaaacgattctaatcctgtttcatcaactttttgtttctttttgaaaaatgaaatcatttatataaacccttaattttctgtctattatgtatatcattttgctggattttcaatttagtaaggttgtttcttacaccttcaacaccacgcattatttgtaacataattagtgattcgtcatatgttaggacattgctattattatcgatatatactttcactccactttcaagataatcattttctttggagttaaagtttctaataacaaacttaacgccatttgatgcatcactgaaaacatatcgttccgcaccgtagaatgtttttccacgaaataaaccgccgtcttcccacttccaacgactagattcataatcattaacgtaatcaatgattaaagaaagtaaagggtgtttgctcaatttatattttgcatctaacaggatacgtctatcattatctgtggtgataatatcctttagtgagtagcttttagatataattttaaagataatttcatgccaaattaaagtactgttttgttttccaactgatccaaaaaacatatccattcctcattagtataaatcagtaatgtctttgtatgcattaatctgtttttgttgtaatgaaagttcattgagtttagttaccatcttatctacaccaacacgtgtatagaaaataattaatgaatctaaattgcctagagtaattcttgaactgtaagttgaaagttttcttgcataaacataaatttcttcttcacttggtaaacgtttctcaatctgcaagatttcctcaccattcggctcataatcgatttcaaattcaactcccatcactgtgtcttgaatgcgatctgtatatgaaccaccgtaaaaatactctcttggtttggctctccaacgaggactaaatgggtcagatgcgtattcttttacaaatttgtaaaaggacattttactgagcatatacttcatctcaattagtgctttgcggtcatcatcagttttaaactctgctttgagcgatggacttttacacagtaacttaactaaattgttgtacatctttaatgtacgttgttctttcatttctttgattttgtgacgttttggtggcggtaataaagatttgaccataatttcctcctatttttattcaattatacacataaaagaaaagcccgtcaatagacgagctttaaatttatttccaacgtgtacctggacctgatggtacaccagtactggcaggtatcgctgaaccacgtttcgttgtacttggacgatatgtcaaaaaacgagttactttttctgtatcaattgaagttattcctgaagttccagtaactatcttaccaatgtaagtgctagttaaagattcatcaattgtttcagtactaataacatatgacgctttcttagtattcctgttcatttgtatatacaaatagaacgtagtattagctgggttactttttacagtacttaaatcaacactttgtataggtagtttgtcgaaaattccacctaaaaacaccggaacttcacgtgtaaagtacactgagaatccttgtgcaacgtcttgtgatactaccacaatcttttctttaatgctaccatttccgctaattaaaccatccatttcagcagatgttgtaccaaaaacgctgaatacagatttggtttgatagtcagaatcttgaaaattgtaatatccaaaaccaacaccaggaataacaccatgttgatatgctgcaccaagttggatgtaactagatgataaaaaacgatttgatgttatgacaccatctactgttttagctatcatcatcttaaattgtgcattacctggttgtgaaaattgatgaacagcatcaacaccaatgtaaccaaatcctgaatattttgcaactgttagaccagtacaacgtttcatatatgcttcagtaataattcctgtaacagaactcagtgtttcatatctagtactcaccaatgtagctgaagttatgttagttccagataatacaacatcaacttcggcatagattgcataaccttggttattgttaagattatatgctgaaactactgcgatggatttagaaaaagtattatcaggtacataatataatacaatttgtccagatagtgtaccaacaatgccagagtttcctatattagcaaaaatatcttgttttaatgattctaataccgttggttctattgtatatgtttcatcaaattctaaagtatctggatttaataatccaccacttgttttatatacaccttcaatgaatgatgttccatagcatctaacactaccatcggtatcaacaagagaaatcatagcagtgtatgtaaaatcatcgcctatttgtttacgattagattgtggtgcaaaaccatttaatgtagtattattttgaactgagttatattgatatgttggttgtgaacctatttcagaaaaaacagtattattataattatatgttacatcatcatacgtaccagaacatgctaataatatttttctattatcgatgaaacgtacacctaaaaggtttgcaccaacagcactaccaaaaactggtaaaacgtttgcatttataacgttacttgcggttctagtactggcaacccatgaatcaaacggtgtaccactaaccttatatcgttgtagaccataaaattcagttgaactccatctaaatttagatgcaaataccaaaccatctttagtttgacataaaccacctgcgtttcctaatacaccagcagcagttgtccctgtgaagttgaccatattaatttcaaatgggttagaaacttgaaatccattattatatgaaacagttgcaggtgcacgagcactaccatctagtgacatagattttgagtttatattataaacaaaacttattccagtaccataaactgttgaaatatacaaaggtgtaaccattcgatgtgttggatataaagttacacgtatttttgataaatcaggactaacgttggcttgaatgttaaagtctgtatagtctgaaaattctacacgtgatactggtgatgtaacttcgaataatgaatccgagctagtaccaacactatataatttatcgaacactcttatgttattagatgcagaataacttgtgtttcgaacagtttgacctgataacccagtaacttttgttaatgatgccattgagcttgctttcacatcacttagctctactgtataaattgaaagtgctaatcctaaattagaaacacttttatctttacaccaaatataaacctttgtcccaacaatatgtgtatatattggcatatcattaccaaaagaagtacttggcactttagcatgaatatgtgatatttcgttaaatgtgccattggttatagtaaaaatataattatcttcagtacttaaacatccaagcatctcataaccattagagccaataaaatacttaatattttcagtactactcataattgaaggtttatacattgaattggttgaaataacactttcttgtgaaatcatagttatatttcggagatctcgtataaatgaataataaaaacctttagtactaccattggttccgctacgcagaacaacggcggttccatcatcttcaataattgttggctgaactacttggtcacttgacataggtgtagcaccttcatacgatccacttacgtttaatggtaagtaatccatttctcctacacgtgatataggcaacatatctaaaatactttgaacttctgaacgcttatatattggatattgaacaattccagtattggcattcggtgaggttccattaaaagtacgcatagcgtacctttgtccaattgccaagttcccaaggatctcggcacttcctataattcgttttgatgacatctttcttttccttaatttaccaaccaattgtaccagtttctgatggttttccagtactgactgggaatgaagaacctttttgtgtaacactaggtctatatgtactaaatctggatactttattaatgtttatatttgtaataccacttgtaccaacggtcagtgttccaataaacattataatttcagattcttgtatttgtgttggtgatattttataaattggttcaccgagaactaacgttgcatatacgtattgtgtttgtgttccagatgaaacagttgaagcaaaaatagaaactgctggaaatttataaagataaccaccaataaatgatggtatctgtctattaaatgtaagactatagcctgatgaagtaatatttagactagcgtcatcatacaattctccgtattgtgtaagtggtaatccattgacaataaagttaacttcatctttggtaatagaggggaatgtacattccccatttgaatttgttgggtaataagtcatattattacctaatacaccaagaccagtacttttaccctgaactgtaacttgttgcattgccttaaggtctgctcttattttatatgccattatgtaatcctttaccagtttatggttcctgtttgtgatggtagaccgtagctaactgggaacgatgaacctgctgattcaagtgaagcaccaaatatatctaaacgggaacgtttttgtatattaattgtttcgatttgaattgcattagtttgaattgtacctatccaaaaaatattatatgcagttgttcctgtttcagaaataacatcagtagttatgtaatagtttgccaatccttgttccaatttaacatatacataaaatgttgtatttgctggattagacttaatagttctcaaatcaatatttgaaactggtagtgaaaatgacttacctgaaagaataactggtgtttcctctgtaaaatatacaataaacccttgagcaacgtcctgggatactacgttaattgggctaccttgtgcagtccagttattatagtcggcaatcgttgttccatattttttgaatgtcattttatttgagtaatccattggttcaaaaattccaaaaccaataccaggtaatgctgctggttgacttccttgttcataactggcatgagatccagtaattataaaacttgtaaattgtgcagttgatttagttacatatgctctaaattgatgagttgcagtattacctattgttggatgtgataatgggtcagaaccaccaatgaagtagaatgaaccaccatcatatattgtcaaaccaacagaagaagatgcaatcgaaccattcccagttggtgtaaagttatcaccatacgtattctcaagtactaaacgcttaaatgtaatagatgtaatattaccaactctagtattgacattaacttcagcaattctaatatagtttctataatcattagtaattgtactcaacataacaaaagctggaatgtctgtttgttgtggaacaaatagtgtcatatcacggtatgcttgtgctgataaattccaatcacttagaactttggcatattcagtatttctaaaattgtccagtactgattgtgtaacgcttataattcctgtgccatttaagtttttatcataggataatgattgtgaataacgttgcccaaccataaaaataccaccattggttgtgacagttgacccagaaatactactaataaaaattctattatttgcattatcatcaacattagcacgttcaactgtaggttcataaccttgtattgttcctaaagataatgatttaaatgtaaaattaggagtacttttatgaactgcatatgatggtctaaatccaccactacctgatgcacgtgaatattgtttagtactgttatctggtagtaattctacaccattaataaatgaaccaacggctgaaccaaaagacgggcgaactataccacctttgaagtcagtagaaagtacagcacggacattcagcatactataaactatttgaataggaaacttagctttttgcataagtaatggttctgctaagtttggacatgtagtacaaaatgcttcacctgaatttaaataaaaatatgaactataaatgtttcttgcatttgcatggttatacaatggatcgttatttaaaacgttaccagtaggaactaatgccgaaccagtattagttataactaatggtgcttgatatgaaccaatatcgttacccgcatctaatgtacattgtttagtactcatattgaacacaaaactgtaactatgctgtggacgtgtattatatgttgccattgtaaaccaagcatccccgttcattctaaagcggaaattctgcgttcctggctgctgtgcaacatataaatcaattgatgtcatgtaaatcccaataccacgtagattttgtggaacatacacataaggtttatcagcaatatttgttgatgttacctgattagtaataaccatattattttgtgcagaatatgtcgtgttataaaatgttttagtagtccatccagtaattcgagttgcagtataagtaccattgcttatattataaacaactttaactacaactaattgtagttggttattttcattaagtacgttaaaaacatatatagaaccatcttctgccatcatagcatattcaataccaccttcaggtgatatatctgcttggttaacgaaaaaaccagtatgcaatttatcatctaatgtaccattggtaattgatatgaacaaaccattagtactgttagaagtatcaatatatctaccgagtaaaatatttggatcagtattgtataaaccaatcgcaactctatttgaaccaaaaaacccaggcttgtattgacgactggtgttaattgtacggctcatgtcatcaactgataatgcgttagccaaatatgaataaaataatccctcaacactaccgtttgtcccactacgtaaaagtactagtgtaccatcgttttctaataaaattttatttctacgttgtgactggttttctgatgcaccattgaaatccccagaaacacccgcaggtagatagttttgtgaaccataatgggagattggcatcatacttactatatctagtacttcatctctggaataagtatctaattccaagttaccgttggaatcaaaaacttgttcatttattccttgaattgttcttttaccattaactgtcacattatgtgtgacatctaagccaccatatattttctttgacattatatatcccttataaattagatattagttaatgtatttatatacataataaaaaagcacccaacgggtgcttatactaaaaatctttatttttatatagtattctttgattatttgaaccacggaaaggtaattttagattcttttcggactcaataaacttaccatcaactaatacatctaagtactgaagtatatctttagcatgatttttcataatctcatctaaagtatacccactccagcaccaaatagttttactaggataagtttctttaactactttgcatagatttaaaacttcatctatattctttttcattaatggatcgccgcctagaagtgacaaaccactaacatatggtttttttagttcctgtagtataatctcaactgtttcagtactgaacaattgaccacttctgtaatcccatgcttcttcattgaagcaaccatcacatccgtgcgaacacccactaacaaataaagagcagcgaacgccctctccatttactaaatcatccttgattatcgtctggtaattcatctaatattgcactcactatttcgacaagaacatcgccgtgacatgattttggtttacagaaacaaccaaggcgtttccctgcgagttcaagtaattcatcaatcttaacttctccacaagaaatacgttcaataatgtattctctgaatttttcaattgattcttctcttgtactaacaatgaactcggctttggtttgtttatctttaatatgggtaaatgggtttccccatttagacccacgtccaatatacacatcatacggttctttgtatttgttaaccacaattggctttaaatccataatttaccttatttgtgctgaatacgctcacaacactcttgttgcttgcctttattgaagccacgcgaagaaggattacccaagtacccagaaacacgacgaatcactgagattgtcttctcattacgattatcacatacaggacagtggaaaccatgtttatctacactgaactcaccctggaagccacattcataacaatggtcaactggttggttaataccaaaatatggtatcttagtgtacgcatagttaactaatgtttcaagtgcttgaatgttgtttgctaagtttggagattcaacataactgatgtttccaccgttacttaggtaagcaaacccttcttcataactccatttatcaaatggagaactttctacccatactggttgatggaaggaatttgtgatgtaatcacgttttagtactgaaggatattttgcttcaatgcaacgtgcaaatttataacaaagcgactctgctggagttccatatagactaaaagcaatattactttcttttttgaactcatcacattttactttcatataattcagtactgacatacaaaactccttactgatagaaccagtgaggatttctgaacattcaacaagaccaacataaccaatactaatactagcataaccattgtaaaatagcttgtcaatggtttcttctgcacctaaacgtgctaatgcaccttccatgaacaaaattggattctgcttcgctttagtgccttttaaacgctccacacggttcatctgagcacgatatgcaatattcatatgctcgtctatcttatcaaaaaactctccatcagaatcactctcaagagcaattagaggtaaattgatagaaaccacacctaaattgaaacgaccgttgtattgttcatttccatttgaatcttcccattttcctaagaatgaacgacatcccatcggtgttacagcagtactactacttcccgtcactttgtgatttaatggaactgaaacaaagtctgggtagattcgttttgatgcacaacgcatagctaactgtttaaggtcataattactatcattggtattcatgtttataccatcttgtaaaaagaaaattactttaggaaacactggagtaatcttatctttacctaaaccattctcatgaacttttaagtactgttcagtgattaatttaccaaatttagaagtattaagccctaaactaagagaaatgaatgcagcttgtccattagtgctaatcattgaattagtctggtaaagtaatgtttgacatccatcgtatacttcttttcgtaattcttcttcaatgaactcatcacttagattatatttcttttgtttttctaacagcttatcccatgacttttgaacgtaaggttctaaaccgacatcaatgtgagccaacgattgaccgccgtattgggaactagctacagcttgtacaatctgtgtcagtactgtacatgctacactaaaactctttggttcttcaattttggcacaaccaatggtaaatccattttttagcatatctgggtagttaactaagcaacagttggttaatgggctgatatagtagtctaaatcatgaatatgaccataaccatcattatgccactgcattagctcatttggaataacatcttgtgaataatgcttagataggatacctgcaagtaaatccctgtgtgtattgacgcatttcgcatctttgttcgcattttcgttggtaagatcagtattgctctgattgaggaaattcgttacgtcagtatataatttatctaattgcattgtacattccttgtattttgaaatcatctgggggtgaagatatttaatatcaccagacaacattatagcgtcagaacaggttatttctcttgacctatatcaaggaaaagtcacattggtttttatttgcacaaatagaaaaagcaccactagggtgctttaaagtactgctaatataacaactgcccaaattaacagtaatacattggttggtgcggaaaaaagcatatatgcagcaagtgcactacaacctatgacaagtttagctagtctcatctggactccatgtaatagtcactgtgaaagtgccttcctgaaaaccaaactcatcttgtgggatttgttcagctaatgggttaaatcttgaatcgaatgcttcatgtacgtctctttgaatatcatagagactttcaccatcgtattcttttttgaagatttcattctgcatttaaacgtaacgaccctcggattgtatatggataattatctaatagatcgattagtctattaaatgtatgagtactgatgaatggatgtttcttagctagttcaatgcgtttttcaaaatccattattgtaatctcggttctattgaaactacctttacgtctgtacgttagtaaacgctctttatgtccatcaagctggaaatcaaaatatgttgttgcattataatcactatcatcactgataggctttgaaagatccagattatacgtagttccaatcgcaaaaaagtatccaccatcttccaatggaatatctttgtcgcttagattgaaatctgtttcatcacctagtatatcaaatatcttgatacttagtgacataaattcatcagctaacatttctttttaccttatttgataactctacagtagtactgaataatgtaaggaaataaaggattatttacgtatgttgcaaaattagctattgtaacttttttatagtacgaattatgaattgttataagagtgtgggggtctattgattctctattagagagttcaacataacgcccacacttcatataagccttaccataataatcgtaaattatatcgtatttttccatttattcaggatctttatttttatcaactgtgttgtttttattcaaatcaatttgcaaagccattgcagcttcagcattttcttcatgtgtgccattgaatttatacccattcttgatgagattcacggtgtagtacttattataaagaaatgcccatacaaccattgcaattgtacccacaatccaaaatgacactgcgttgaggatgaagtaaattacaaatgcaccgatgaacgtaataaagtcaccacgaaacaatgcagggaacggtccaaagaataatgttgtccaagaaaaaccaaagaaaccatctttgcgttgtcctacattttcattttttaaagaaattgttttagccatttttaatctcctactttttatttgggtttggtatacagtacacaaatactaaatgattaaaatgttctgtattcgcatactttgctaagtcggttatgaggaagtttgtatctttaaatctgccatcattgtatgttgtgatttgaaaacgtagttcaggtgcaaaaatataataatagaatatatcatttacacacccaacagtatgcttagcatatctttcaattttcatgtgtggataatctctttcaccccatattcttttattgctaatgagcaaatttcacatggtttagccggaacaggaattccatctttacttatccgtgcaatcagtaaagtatgaacatcagtacgagcagccagtaaacatgaaatttcagcatgaagaaactcaccttgcggtcgcccagcacgaatggcgaaacccttctgtactgggtgagtctgtgtataagaatttgtgcgagttgccagtactctaccttttttatcaagtgcacgagcaataacacgataccgtttgtaatttcctacttgttcaataggtggcatctggcgtaattcttcgattagtttctccaatttactattcataagtctaagtctatacccttttcaatagatttctctagaacccaaagtttacattcttcactctccaaatgtatctttgcctctttctgttgttctattgtacaagacattatgaattcacgcaaggcttctatcgtattttttaaattttttatatcatcgatgattttttctttggtttcttcatcgattacacatgaactccaactgtgtcgttcctcccaaacagttttagtgggattaaaaattgatggagtagatttgaatgcatggatcttattaaatgtgttatctgcttcttgttgggtgtaattaccatatgtgtttagcacatttttgtataatttttcaatcgcctcttcatacgtatcaccaccacaatccaattgataatcatgtgcttgtacccattcgtcgtcttgctcaatatacattggtgaaagaaattctacccaaaattgagtctttgtattcaatgctttgaaatcttcaattcgatttgtcattggacacacatcatgaggttctatatcaatcctagctggaaccatatctttgtttatgaatttaggatgagccaaaatccaccagtacttttccgatgtagtcatagtaatctccaattaaaaagtactgccattatgacagtactgatattaaatgtaacgtttctttttataatcataccctactgctttgtaaaagtcaaacaaagaagcatgttcaaatgtaggtaataggtcatatggatgctgatagttcgcaataccaacaatagccagcattgattcagcagttcttacgttctcactatcccattcatccaaacgccacagtgagcaaagtacctctcgttcatgtttcttacccagaaagaatccagcttcacggtcacgaaatgcacctacactgatagtacttttgtaccagtctttttcaccatataatggcatacggataatatgtttttctttagcttctccaaagcgatgaagaaatgctacataatcactcataatttataacccattacaggtttggtatgatccggttcgtaagacttttcagtactgaaccctctgaaattaccacgacctggattcgggcaagccatcccttgtactgaatgcttacccttatctttgccacaatttttacatttgtagtcaattacttctttcattgtgcatccttcggaacagtattaagacgtttgcgattcacaatcttcctgcacatgagattaagatcttgcccatgacgcatagtatgacatgcgtatagtgttccttggtgatttagttttgttaaaccttgacggatgatttcagcatccatctcatcaactttaggagcacatccactcagaaatacaatagaagaaataataaaaatatataataatttcataatttaatcacctatacataagtactcgattgatggtttaccattaactaacacaattccagtgtgagttaatacacagttgtcgggagcttcttcaaatactgatacgtaaatgtatgaaccattactaactgaacaagataataccataagaactgcgattagtacaagtaaaaatttcatatcatcctactttttcgattggaacaatgcaatctgtacgcgtgtaatgaactcacgctctacttcttcagcactgtgtccttcatattgtgtcttgaaaagttccattgcttttagtgccatctgtacagaaatgtctgtaatactttcagtactggtactttcaaatacatttttgaggcttagttcatcatcactaacatcatcaacttcaactgggttgttgttttgttcatcaatgtaacgtaaagctttgtactctgcttttgttagattttcataccaacgtgggtggtggaacaaatcatgcattgtaacttttgctgcttccatgagaagtaatagctcttcatttctgcgaatatgtttttcttcacctttatgatttttgtaagtatatgcacaacgcataatggctaatcgaacttcacctgctttggtgatagtgtatgaatgtattgcattatcataatcactttcccatttctgaccagcatattcgtaccaaagttcattagtttcccatttaatgaaatcaaattctaacaaactgtcaatcaacttagccaaattaccactgtactcacggctaatgatattgaaaccaccattgtactttgcaaggtacagaatcttttcttgagttacatttttcattacatgtaatccttgatgtattttagcagtttagatttctcttcggtacttaatgatttcttgttcattaagtgtttcatttcttgacgttcaatttcttcacatcttttagattcagcttcaattcgtgtattatattcttcgtcagtttcttctctggtccaaattacattgtatccatcgaacccgccgtaaccaccgtctggtgaaagactaatgtgaccgttatattcagcacgatacttattaagagtgtcaataaaggtatcaatgccacacggttcaatttcaatataaccaatcactacagtaacgtcaattttgttcataaagttcacctataaaattagggagcattagctccctttgtattgatgtttacgtttagtactgtatttccagccagtactatgtcttgttctgatatcgtcccaatacgatggtaatgaacgcatcttacgtcttccacgtatatcaggttccccctcatccttcagtactgcacaagccatacgacgctcttgttgtgtcttaggacgcttgtatcgggagtggttatgtttgtacatatacgaacgcttatgtcgccattccgtatcacgagctttacgtttatgttcccagtactcattatagagtatcatgtattcacccataagtaaatcaggagatacaagtaatcctttttcagtacaaagataataacccacaaacttttctggaaacatttcgtaatagaaacggttcttccaaaatgtttcacgattctttttgttgaattcagctaaatcgaatttcatcttactgtggaaacggtctataccgtcatgttccgcaatgtactctaacagattatcaataatctcaactttaccagaatcgtgatacaacgtaaatgtttggtcaaaaaacatatgaaatctcctttaagttaaaataacctaatggaaagtcattcttcctttaatacatgttctcatgatttgttccttttgtcaagatatagatataaaaaatccctgccaacagacagggacgaaaaactgaaataacacatggagttctttttaatttaataaaaagtattattattcttataaaagtatttattaagaactccacaatatgtcttcaaatgaatcaaaaacctttctgagctactagttcacggtactgtgcacgagttagtacaccttgtttgcgtagagcttgaagaccggatagggtttcactcttacgttgttcgtacatacgttgttctttagattgaataactttctctttcttaacttttgctactggttcttttttcttaggttgtttagccattttatatctccttctgtattatgataacaacattatatcatgtatgggacataatgtcccatacaatattacatattttcttcagcaaattctgcaagtggtgaacgaacaacaccttctagttcgatgacacgacaacctgcccaatctttaaacttctcagttacatatgtcaaaccactgttaacaggactaataaacttactgtcaatctgactcaagttacccataattactactttacagtttaatcctgctcgtgtcaagattgttttagcttgtgcaggtgtaatgttttggaattcatcaactactagaatagtgttggtgaatgaacgtccacgtacaaagtttagtgctttaaattgaataacattacgtttcataatctcttcaatactaccttgagggttagcatcatctttatgaagaaactctaacgcgtcaattgcggctccacagaatggaatcactttttctgcttctgaacctggcaagaaaccaatatcttcaaactgtgagtcttgagttttagagaagatgattcggtcgtatttacgtttttccagtactaattctaatgcagtcgcaatcgtaattagtgttttaccagtaccagcagaacctagcagtactgttagatgtacatcaggatcgagaatactgttgatggcgagtgcttgttggatattctttgctttaatatcccatactttagcacgtaaagctactgattgtccaatatcttggaataccaaaatatcttctggtgttagtgttccatcatcttcctcaattgctgattgaccttcgtacacaaataatacgtctgcatcatcatatagataatcaccgatgcatagattttgtggaagcaaatgttcaatcaagcttttagaaatgtaatgatacaaacgacgaccaacttgttcggattgaatattagtattggttaagttgctatatacttcccaaaaattaatttccaaatggtgttgaccaatgtgaatcaaatcactatcaccaataacaatatcatggcgataatcttgtacctcgacaccataacttagtgctttgatacgcatgttgatatcacgagttaccagtactgattctgttgctaaagctaccagaatgattttatcatcaggtactgtgcttttgagaagggtttgaactttctcttctgaacctttagtacgaattagtgcttcagcttcttcgtttgtaataacaaacaatttgctatcaggattcatattggtatgaacatcagcaatattaacaccagtactactaatctcatcatgtgatgcatctgcaataattgcttcaatgttacgaatagcaacacgagcatcgcgtgaaacatctacattacgactcttaattgaatccaattcttccagtactgtaaatggtagaatgattgcagcaccatcaaaagcaatagatgcattagggtcagatagtagtacgtttgtgtcaattgtatattttttcataaaacatccttgagttatgagtacatccttgtactcgactaatgttattgactcggattattacatatttggttcgtattcaacatagcaacgtgaacctcgaaccttttcttcccagcactcctggtaaacaagttgaccaattgaaactggttctcttgatagtccattacgtacttcaccactttgggttttatacataaatgaacatttggactcgctacattgtcctaaactaacaacttctgcggtattgtagtgaatgttggtacgcttagtgttctcgtgatactgtccgaaccaaagaactcctgcacctaacagaacagtacaaataagacttttgatgtgtgtttgaatcataatgagttaaatccattgtttaagtatgtttcaatattaattttaccaacaggattactactgtgaacaaagtactcaaacggttctttaatattattatcaaacatataatcaataagaaacttagcaaaagaatatccagtcttttcgtcttcgctcacatcacccaagtcatggtcgaatgatacaaatgctggaattccattttcaataacatattcacatgcacttttaaagtcacgacataccaccatatcttggtttggataatatagatttgcatcacgaatatcatccaaaaacattgagtaagacatgttaaactcctatagataactaattagtaagttttctttttgaaccagatactccaattcttgttttgctgtaccgatgaagttctgtgtcataagattattatatcccgcttctcgattttgtcccttagaataacgcgaaatatgacataaatttacaccagcaacttctgcacttgcatgtttagcattagtgtatccatctctaatgtgtttcaactcgtcataggttacttcatagctaaaactgtgactgtttgcacctgggtaaatttcaaaagttttgagtggtcgaagatgggaaacaaaaatattgtaatccatttcttcttgaacttcacgacgcaacgcatcttctagtgagatatcagtactttctacggttccaccacatccaccaagaagaccatcccatcgtaattgcagtaatactaaatttacttctggtatatcattcaactcatagtttttgtaagggttgcattttcttgcaaagaaataacaaaatacaaaatttgcacgtgtgccatattcaccaaagggaacttctttaacactcatttcatacgttccttaattatagtctctagatgcggtattgctttggttgctggcttgataactttttcattaaacaaaaaatcattatcatttttacgaatgttaacattaacactataacatggtaatgctgctgctaatctcgaccataccagtactgtatcgctactaccaattacaataactgtatcattttcattaagagatttcaacacattatttcgttcttcgtaaattggtaagcgaataccatcaacataacgatgatattctccaatcattactacatttggtttagcaaaaacatcatgttttggtatgtatggttcgtatccgcagttaataacattataatcatcggaattgatactataattttcaataacttcgcacaagtttccatgaagtttaagctcatgaccaccaatacgagtataaagatcgtccatgttagaagtcatatgaaggaagcaatcaccatattgatcttctaacgattttataaaataatgcattgcattgggttcgcattgtcccaattttacacgtaatgtattatagaaggaatgaacaacgtgatatttcgtagttaaactagcaatgttacatacatcattaattttaaatgtatcccacaaaccatcatcaaatcgaaaaggttccataccactttcaacagaaagtcctgcacctgatataatcagtaatcgctttttaccttcattgcttataaatttttctgatatcatattcaatccttataaaaaaacaattaaatatattgataataacagaatgattccaatatgataggcatacataaaattattatctttgtgataaccattggatttcaagtccctatataagcatttagcattgttataaattacaacaatagaaaaaactataaaaaaactcaaaacccattcataaattgtgtatgccatcatctattctctcttataatattagtacttttaatattttaaaacatcaaactcttcgcttacgcttgttacattatcactaacaattttaaaaattgatttgatacgttcgtgtagtggttttttagattcgttctcaacttcaatatatgcttgcattgctgcaattgcatgatatgtcccactacctactgcggtaattcttgttttaggttgtagtactgaaaagtcttcttgaacttcatagattgtatgattgtggagaatgataaattgtccaccacctacatcttgtgatgcatctcgtgcaccccattcttctttaaacatttgacgaataattggaataactttaagaaccaaatattgtgaaaatgtttgactagcatcttgttcaggtaaattaaggttataatttaacaactgacccatacgaaacgatgtagtataacccaatgccattacttctttagttctagttagtccatcatcatgtaacttgataaattctttctcgaatacctttggctcagtttgaacagtttttgtaaatccattgcttcctaacttatccccagcaataaaagaacttactccgtcagtgtgtgcaataatacaggtcataaaatagctccaattgcaaataatgttgtgtataagatataaattagtgctcctaacaacattaggcacaccaagtatgaagttgatagtacataataaattattgcttcgaattttgaattgaacttcattgtagttggatcaataaagccattacgataatctttgtaaatgaaaactgttagaaaaataactgtagcatacattactacagtagcataaaaaataatagatgtcaagttttggatgtttgtcatagttatataatctcaatataattaataacaaaggaagtacatcataatcatcctgttattttaattatttttattgtttgactgaaccgtaaaaaaccagttctggttttgttaatattacaacatcttcaccacgagaacgactaactctaaatagaacttctggtgggattccatttgctgcatatagtgaaaaaaggaaacctacctttgttgccatttcttcggtaaaagttgatagctgtcttacagacacaaatgaattatcaccatcagtaacattacttttaatcgaaatgttatgaagacccagtactgagcgatttgtcatatatcgcttttcgggagatacactaaagaataccacagtacatgctgaattgcaatacctagaaacaattaaatttatcccattgtctctaacaaagtttgccattcgaatacctgcatcaaaatcaccaccaggagatgtaattgtgatggtatcatagtgttctttatcatacaactctatcattctcttgagtgacccatctgtaatatctgatatgaaatatacatttcgggtttcaggattatactttatcacatttttactttcaataccagcactggctggaaaatttattaacaatagaaacatcgctgcttgtatcacttcaagccatagtcttttcatataacaagtcctcaattttgtttaggaagatataaataatatagtacttaaacacttaagtcaaactttttctgtacttaactcaaatttttaaaaataaaacttaaggtgtacagtttataacagatcatatcataccactgatgttttgtcaactagttcatggtgcatctgatgtaaaaaacaaatatatttcatacttatatttaaaaaaggaaataaaatatgaaagctatcgcagcacaaggtaaactaccattcaatatcggcgggttttgtgtaaccgcagctaatataaacggtgaattgaaatataacttgaacatctttaatcaacgttctagttgtgtttacgatctcattgatactgattttaatgtttatcgttttgtaactatcactagttatgataaagataaaattagattagatgcatctaaaacagcattggaaattgcaccaactctagccaaaaacactttttgtattaagattgacgatagtgcatttgccgaatcattccagtttcataaaattaaattgagtactggtgcgatgaaatatcacccttgggatttgtattattgtaacctccctggttaacaaaaaaggagccatacggctcctttttttattctacagtattaagcttctgacaaatcatatcagcttctactcggtctttataataaatggtaaatccaaatctacttgttacccttttctcactacggtgtatacagtttacaatatagtacttattattttgtgcagaaaaacgaacttcataatttcgaaaagaagtattaggttcatccatagcaactatatataacataaaaatgaaaaacactgttattagaaaagcaataataattattactgtcatttatcaagacccttatcataaatgcaattaacaataattccagcatcttccagtactttaatagcttctggtggtgtacgaggataatttttgagataaattacacgtgaaatcccactacctgcgatcaacttagaacaagtataacatggttgtagtgttgtgtaaagagtagcaccttgacgttcagtaggagaactatagagtaaagcgttcatttcagcatggatttcatgaatattactccactcatgatgttcatgctttgcttcatcactaacccagtcttgaaaacacccatcattgactaagtgttgattcacgtcacaacaatttggttgttttgatggagtaccattgtaaccagtactcaatactcggttatttttaacaataacacaaccaactttttgtgaaatacatttactttcctcagcaactacttctgctatcttcaaccaagtcgtatgtttcattataagctccaatacttaacaatgcgtttttacacaaatcatgaattttcataactcgaatatagtttaacacatctgtttcattaatttcaaatggtttatctgcatatgtggaccacgtttgatttaattcaataacaaatgtaattttatctgtatccataatattatcacaaaatctacgaaaatcttgctcttcatcggaaagtctgaaatttaaatcattttttaaaccattaactgtgaagcaaataccagtactgtaaccgatgcaaatatcttcaatatcatataatccataaattaatttagagataaacgtgctatatttgtttctatgataatagtttaatatttcttgtttaattttaatttcaatatcagtagttttttgtaatgtaagtttaattaattctaatgtcttgattatgttatctaaccagatattagtatcatctatacttaggtgtgtgtatttcattatgtccctctagattccaatcatcaacgagtttagaacaaacttccatatgattatagtacttttcatccaatacatacggtttattatgatattgtcgtacatcagtgaatatatcataatttctatatatgaatgacatatttttatgcattaattctatagttttccaaattttctcaatatcatatagaattgtttctaatgacaaacctgttaacttggaaattctttcaactttaaaccctgataacatcatagtactgttgtgtttagttaagtaactatatccaatagaactatgtattaactcaatactatcagtgtgtgtgattgtttttagaaatgattttatatttctattaaaccaataccactttttgtttttattataacaactataccatttcttcaatatatcaattgcttcagaattaatttttaaagcaaattcatcaattaaaaacatatgatggtaaaaaatatcactttgttcttcagttaaattatattgctgcatattcacctaccctagtaacaatgattccttgggtatttagctcatatagatcaaaatatgatcaatggaaaattgatatacagcaataaaaataggaatcccatgataggattccttttcacaatattatttttgatatggggtgtactgatatttttcacaatcagaaacagttagaacaccttcatcataaccatattgaagtacaaggtcaaatgctttatcaaccatagcaacaacatctttataacgaacaatcttatgagattgattctcaactgctttcataatccccattagcaaccagcgaccttcatcggtgtgtaatttagcaaagcgtggacgctttgtcgctgccataatatcagtccattcagctttaaaaatgtgtggacgttttggaatatcatatagtgtagtagggaaagttacattatttttcttcattgcttctgcttgtgctgcacgatagccctgacgatataatggatgctgcatttttagctgttcagcacttagaactacttttgctttgtatgcgtcataaccatctttatattgtgcattggacatattattcttttacctcatcagtttgaatgtattttttgtcagagaatgtaccgtgttctttacgcacagcttctgcatgttgaaccgcatcaactggattaatgttctttttaattagtacttctttcattaattcaagtacaattgcaaaaccattcagcacacgctcagattcatctacattttttaattcaagtgctactgcactaatttgatcgaacgcaacattaataaaatcggaatcttctaatacatttgctacttccgtattattacgtactagtactttcatataatctccacaaagatgatgccccatattgaggcatcacaatctatcttacacccactcttctacaccgccgcgacgcttaactaagtacttgccttcttcgttacgtggtccaagaataataccatcaatgaaaccatgttcaccatattcaagtgcttcttctgcatttaaccacaaatcgcggtcagcatcttttagtaattgttcatgtgatacacctacagcttctgcaatttctttggtcaacaatgtattcagtgcatcagaatgttgtagggaaatcttctggtctgtaattagaccttgtgtaccagaacttacttggtgacacatgaagtatgagcgtttaccacctaaacggaaacctttagtcccaataacagattgtgtatagcaacccattgatgctgcataacccataactacagtgcgaattggggaaatacaagacttagcaacatctgcaatacccaaacctgcgtgtactgaaccacccggtgaactaatgtagaatgtaataggggaatcaccttgtgagtctaaccataccaattgttgtttgatgatatgtgccatttgatcattgaaatcagtatcaaggaaaatgatacggtcttgcatcatacgagatgctagatcatatgtacgttctgaaccattaactttctcaactacgtaaggaatagaaatgttacgtacttcgccattagcataaccaccaaacatgaattgttcaaccattattaatttcctctattatttcgttgttgtgagtattatatcactaagatttaaaatgtccaaactattttactggaatatttgaaaagaaatcagtcatccaatacgccgtctctttgttgaataatactggatcaaacttaagtaactcaacatgacttgtatcatacacgcttgtatcggtaatgtcaaacaaagttttagtactgaatagtggattactcactagaaagtagtaatcagcagtagtgctaatgtcatcataaaacacaccgtcataccatccatcatcatatacataaacagaatcgtcatgaagatagtaaacttctatatgtaaactcaagttcttcatggtttcaatcatttttgccgtatgaggatttaacttattgacattttcaaaaacataagagtgttttttattcatatcaacaaatgaaaatattcgtactgaacgtatattcatattactccaaataaacaagtgaattaatgaaatcatatttcaatttatcatcaacataattcaaatcaactttaatcatcggagcatgggaacgtatagacagtgtttccataaagtactgattaagtttgtatgtatggaaaagatgaatatctcgtttcaacaccaccattacttccccgaacagatcacagagttcaacttcagtgttagttgggtcaaacccataacgattctttaatgtacgtggttctttatttcgataataatgcacagctttattactattcactaacaagtgatgatatgcattactataaactgagcaaataactcggcttggataattggtatattctggtagttcaaaataaattaatgacacaatatcctctcattaaatttcaaatacaaatttaggattgtaatcaaaattctcacaagctccactgtatgattcatagcctcgtggattacaaatgatacgtgtcttaccaatgtggtagtcaaaactactatgaacatgaccatgaatccaaacatcagcacccaaatcttcaatgtactgatccatatcggaacagtaacaaccattcagtgaatcatttttatattttggtgaaacactttgataacttggtgcgtgatgggtaaccacgatgaccttgaaatcattatcatgcataaagcgaactgtgtcaatagaatttttgataaattgtttatctttgtgatgcataaactcagtatcatctggtgtcagtttcttacgccaaggctctgatgttgttccatgacggatatgtttgtaatcgttcatcttcagacgagcatcaaacttcgtcaaagaattacctttatcgaagtctgtccacagagtactaccaacaagcagtactccatccagccatacaaatttgttttgcaaaaagatgaaattaggaatctcatcttgcatatcggacagtactttatgcgttttgtggatattggaaccataatattcatgattgccaggaaccagtactacattcttaaactgcttacatagtgattctataccagtacggtaacgactgcgtttaacttcatcgaagtccccagcaataatcagtactgtatcactgtaatcaccactatggaggtaatcagtcccaccgtgtacatcagatgttacaacaaatttcataattacctccaataaatggttaacctaatgcgtcaataatactgtttgagaacacttcaacagcactctcacgaatttctaagatacgagtataatcatcacaagtgtttttgtcaaatctaaattcaataaacactggtaagaacagtgatggctcaccagtacgcttgtcgaatacaatgtcattacactcaactgtaaccactttaccaataagttcttgcattctttcccaaatggttttaaatgtccattcagcatctttctctttgataccagtacccacattaactttcaatgtgccacatgcactttccagttgtaaagaaccaaggctacctttacgcttcccttcaccttcattgaaaccaacaatacgcaaatccaattgcatcttaagtttcattttcaactgcttaggagaagtgtgagatttccagataccatcttcgcatttcagtactgaaccctcttcaccttcgttcattagttcactattgtactcaaatgcttctttgatgtttagaactttacggaatccaaccatacgaacaaaatcactattgagttcgttaattgcatctactaagatctcgcgacgttctttacgttttacatcccatacaccttcacaaaatgcatcatatggaacaacatcccatagaacgaatacagtacgcattgcttcattctgactgatgctatctttaccagctttctgaattataccgttgccagtagtgcgtgggagaatggtttctccatcattgtccagtactacaccttcccccataaagaccacaccactactaaaacgttcatctttactttggatgatgtgagcaagacctgccatctcaccatcacgacaacccaggaagtcgtatagtttaccattacgggatgtagaagttaatgaaccattaatgacaacgtggttcaagtactgaccatccattttcacttctgatatagcgtaaccataatctttgaagttgatgttctttgcagtctttttgtcaatcaaagaacaacgcatatatggttcgtctttgatgaatcctttaccaaatacatcattgcagttcttttcttgaataccacaatcaaggttcttcgtgagcattttacgaagaacttcttggtcatcttctgatacagaacccagtactgaagcaatgaaatcacgccccgcatttcctgtcacatcacgcttgtaaatgcattctagcttatcaattgcttcatctaacgtcatatgttgatatacgtcatcagcgtcagggagcttcttatagccacttacgatagaagggtctagtgtatatttcagtactttttgtaaagttacattatctttattttgttcaagaatagcctttttgcccagagtactgctagtatttttaatgctttcaagaattgctaaaatgctcattgtatattcctttatagataatactttccaatgtaaagtggattactaattgataattgaacgtggcatggtttgtcttggtagtaacgagtgcttgatgttttgcgttcatttggtgggaagaatggggaacgatagccattccatgtactaaatgatgagtgttcattaatatcaacatccattaccataatcccattatcatcaatttgaactggatatgcactaaagcgttcaaatttatcattataatggatattataatctccactacgcccataataactacgcgttgtattattacttacaccaaaaaatacgcgatatgtttgttcattatctttagtcataaatggtacgttctcgttgaaacgtccattattcataagatcatcaacatttatttcttcgtatttaattttaaggtcttttgctttaaatgatttattgtgtaccagtactggaatgttagattcacctaatgggttatgtctgtttgttctatagctttgccaaaaatcattagcaagtttaatttcttcatctgccgtagtcttcttattcaagagtgcacgaggttcaagattgtaattatccaaacgttgattcaatgcataagttccacgagtactgttaaaaagtaaatgataaactgaacttttgtctggatatgcaaattctttagttttctttatacaaattgcatgtactttaccgcagtaatagtaatcttctttaagataagtgaaaccatcaccaactttaagacctgctactgtttctttttgttgttcttttttattttctttttcaactaacttagcaaacgtttttgttttaccattaattaattctaagttattgttgaaaaacattgggtctacaaaaacacctttgattatatcgttattgataattaaatcattcatgtttttggcactaatcataaattcaaatccttctgggtgacggatcgtgaaatatgtttctcgtgcatgagttgttaatttatcaactacacaaaatcccgtagttggaacgttgtcaatatataacgatggaagattgttcttctttgcccagtactctgctctctctttctttgtttcaaacgcttttgtatgtgattttgttgcatcgataataaaaccatcaacttggttgtggtttacataggaacgtgcaacaaataacttctctggaaaatccatcaaatagtcctcattgtgctgattgcttttaatgtgtcaaacaatgcaccatattttacttgcattagttgatcaccagcaggaagattcatacgcataacagccatgtcttcaatcatttcagacgtacacagtactgccacacaggtaatagcatcattcaatccagcttcattgaatttggcaaacggaacttttccctgtttgctaaggttgttataataagaatttaacttatcatgtccaccagcatttagtactacaatagtttcgtgttcatagtaccattcatcaataatagtactgaaagcagtaccttcatattctttaattagtttaacaccagcatggaatgcttgaataccagcttggacaccttggcagtacatattagttaagcaatacaatttcatttccatacctcttgtttttctacgtagcctttcccatcacagtgtggacaagcataaaagctgcggtaatcttctgacggtacttgttgtgttccattacatgtaggacatactttacgtgcacccgaaataatacgttcatggtgttcagcttgtttagctgaatcaaaaatacgaccatcttcagtttggtatttttctaccataacttgaattactttcatttctatttccttataaaaatgttaaatcttcagtacttaattgtgataatttaccatcatattcaatttcaacatatacattttggtcataaacagcaactacacgtttaataactccaatcttcacgacattctttttgtagttgaactcaactgaacaaccaataagtttatttgatagaatctcacgtatttgattagcatggtcttttaggatagaattaatagattttttcataatatatctatcattcaaatattttttaactacatcatgcataattattaccttttgaaacgattgaatgagtactcatctttttctttacgtaagtatctcattccaccactttgtggagtagcgagagttaagtcacccgtcaagaactgactatcaatccaaatgcgattaccgtaaatgagtgggtctgtaactgctgtatgtccactaaagacacaatgcactccatctaacttaggtgcataatatgtattattagttctacaataatcgaatgtttttctatcccacaagcacttatcaattatatcagcactaagtgattttgtcccattaacaaatcgttcccatgttgtatattccaacggaactccagcatgaactaacccaatcttcaatcctcggtgattgatttggataatcatagggagatcctttaagtactgacgaaagaattgaatgcctgttcctccaacttcatcaaggaatttatcaccaccattacttatccaacaatgataccaatctcgaagtgtttccgaatcaacgcacatcatctcatgattacccgcaatcatgtaacgattttctccgaacaaaaattcaaaaaggagctttgaattttgttctccacggtcgataatatcacctacactgaaaacataatcattgtgtgtaataccaaattctttcactgtagcatcccatagtttaccattaccatgcaaatcacctacaatgtataaatctttatcatcaggtacagttacttctaagaagtgtttcattattactccaaccatataatattagtgtgtttagtaacttgtgttccagcaaaagaaccatctttaagataagtattaattttaaaacgccattcaccaccactaatatacatatcagtaataatatactttccataccctctggagtttattaatcgtacttcttgaccaatatattttggcttcagatcatttataaaatcatcagccaaagacataagatatcgcaaatgtgataagtcagtgttgaacattatttctttctcttatatttgttaataatatcttgggtaagtgaaataaaaatatatactaatgttacaggccaaataatagccatcagtgctgctgtttggagattcatgataatcatgatttcatctttaaaacaaccccaattaagtactagaaagttggttataaatgtaacaaatgctacaaaaccatatattgcaaaaaatgttatcataattattcctcatcatccactaaaacaagataatccaaacttaactcggtatctatgtaacaatcacaattcaagtactcaatttcagcacctatagttctcccattcttaaatatctcaatgattttcattctagtattgggattaatgtgttcaatgtcgtattcgtattcagggtcaatatactcacttgtcatacgtttgatgtattgttccgaatatcgtacagttttacctataagatcattactcaacgtctgataaaaatcatcttgaattttgaataatgacctataaaaaatattatgttgaattagtggtttcattgacattaatcacaacttccagacgatgaacttgaatcagaactagagctatcataggaacaagaatcagaggaagaactgctgtgacggctataatcactgtaatcatcattgttgtagattggtgatgttacgattgctgctgcggtcgctgccgttgcaatttgtgcagtatggtcatgaacacctagttgtggttcatccttagatttacctttgttcttacctttagtgtaacgagctttctttgcagttttagtatttttctgtactttaggagcttttggtttcacatcttcaacgactggaactacattcactacaactttaggatcagtttcttcaagtgtattatacactttaacttgcatttgaacttcaacttctttaacttcttctttaacttctggaataactgtttctggtgctggagtgattttatcaagttctttagtaataaagaagcttgtatttttctcacctagcataacaagaagaccaatggcaatcactggacttagtactgtaccaagtactacataacctagaacacttcggttatagttatatgcaagcataccagaaataataataccgattacatatgcactgctaagaataattggggttaacatattctactcctttgtatataaatttactaacttcttcgatgtataaagacaaccctgaacgttcatttagaactaaccaagcaccaaaaccacatcgaatctcggatatatgaaactcttctacactataaattgaatacgcgttaaatggacatatttcatcagatatacttaccacatagttattattaattgaatctaacacctgggtattgtataaattattagtactgaaaatctgcattaacgagctagaaagcatctcggttgtcttttctaatattgttaaaaacgaaccattcacttcaacttctccctattggtgatgtaatcaaattatatcaccgaattctgatacgtctcatgatattcgcatttcatctatatataatgaacatgattcagaattatcgtctaaacttaaacctaaatcgaccatcaaaccgcaatgcgttccccagaatttctttatgtatagttttttgctattattacctaaatcataaacatattcatttttaaatatactttttaattcttcacatatacattttattatcttcattacttgattatgatattcgtatggtattccatcaagttcgttaattattaatgcaaaaccatcatcatagtacttaagtttattgaatgtttgtatatccatttaatatataatctcactagcttctattgtgtagacaccatcatcagtcattaatctaactgcaactttaatattattagacattcgtgcaactatcaatccaataattataccatcctttaaagtaccgttatggtatcttacttgtactttagttttgttatcaattaagtatcttcgaatataatgaatttcagttctaaacagttctaaataaacttcactatattccttatctgaaccgtctgaacaccagtacaataaatttacttgttcaaataatttttttatattcataaaaatctcacagatttaatattactggttacatgattgaaccaagtgttatcgaacttgtaaacaattgtattaagtgatttatgaaaattaacctcagacaccacagccttggaaccattgattacacagacggttgacggtaaattatttgataatatctctttttcatctaaagatagtgaactaatacaatcataatagagaggttcaagaactttttcagtactgagaaattcaaaagaaagatcatctattagttttatgtaatcgaataaattatgataatattcattcattgcagatccttttaaatttagcattattagaatatgtatatgaatgaccgaaatcatttacaccatgtacatttagtacaccgtcactgaaataaattcgatcaatagtgagttcacgtttataatcccaatcatcataccagcacagaacacgaatacctttgtactttgtagttaaatcattttctaatatagtcaagtaatcaatatgacttttgaatatctctaagtcctgctcaaacatcattgttcctcgtataattctatatcatcaacaccaacttggcgaattgcagtacttctgttgaatgtatttttttcaaacaaacatactgttaaacgtatttcacacttcaatgcactgtaataaatcatatcaataacaccatatgtttcatacatttctacgtatacatttcgacctaaatacttttcttctaaatcagtaattagactattgataagattacctatctgtgttatatctgtatgaaatttagccattataataaacctctcacataaaacattgatgaaaatagataatcattagtacttgtgtttagttgtttagaaaagttatattttttatctttattttcgtataaagacaatctatagaacatttctatattttctaagtattctttttgtaacaacatctgtgtttttacattcattataatataccttaaaagaaaaagggaccaacatatgatcccttttgtattagaaatttccttctgcaacttgaaaaactttcaagccaagtagcttacgccacatgaatacgacttgtgctcggtcatcatatacctttttaacatcgtaatgatcaaccacatttttcatgtacaggtcgaattttacaacatcatcaggacgtttatcatcgatatctcgcataaacaatgcatcgtaaggaacaccccaattcttaagccactgttcggtatcagcacgacacccttcagtacgcccactcatgacgataatcttgcgtttatgaaaaactgcttcagcgataatagacaaaataacttcttcatcaggtgtatcctgaagaacagtactttcatcgtaaggattacgaccccatttatgagcaagagtaccgtcaatatcaacgataacagcagcttctcgtgaattaccatagtaaccaatgtgcaatgccttactataatagtacgtatctgccattgtgtcaatgatattatcttgtactgaacgctcacgctgaaggttatatttcttacaaagttttacgaactctttaatcttaaagaattcatgaacatctgcaccacggtcttcattaggtacaaaatcatcatagaagttcttttctttgtaatcataaccattatctttagcccatactttccagagattacggaaatgttgtttaaggtttgtatcggatatgatgatgttccaaccattctctgctgctgaatttgctgcactgaactgtaaattagttacgtactgctcattagcatcgttgaatttgtaagcatcatgtgacccagccatagattcacgaatatcatcacggttgatgttgatagtcttggatttggcatttttaatttcttgaactgcccatgtggttttaccacaaccaggcaacccaactgttagtgtaatagttggcattattactccttgttactcaatgaattctacatcttcgagtttgtgccatcctcttgaaaggtttcttgttccgttattgtattcagtgtatacaaagcattcaccatttactaaattaccaatagcagtacgcgatactttaacatcaagaattatagtactgaaccattctctgattgtatgatcccagcatttaactttacatccaatcaatgttttcttaaaatcgaaaacgtaatcttcgaccattgattcgacagattctattagttccttttcaatgtactttaacttttcgatcctctcaaatgcaagttctttattcatatgtcctcaattatctagaacatccactatcaaacaagcttcaataacgaaacaatcatctaattcaaagagtaattgatagtcatcagaaaacttcactttagtaatgtaagcactttcaattccaccactatgataagaactatataaaatacatttacctgtatattccttacggatacgactaaattcttcatataaatgagtaataaacgtatccgcagttttgttgtagtattttaggtcacttactgtgctcattaacttttcctactccaaatcgtttggagattttcacaagtacagattcatcacaacgaatactagctgtatcattggatgaactgtactttaatggggtccactgtaattgagattcttctaggaacttgatacatctgaagtaatctttcagagaaagaaatttaactactgacatatcctgaacaatactatgctgaacttcaactttcatatgaactccttatagtggatcaaatttattttcacgtttcgatgtatagcgagttacatcatgtattctcggcttaacaccttttggtttccttttcttcttgtattcagtactactacatccgaaggtattctcgattcgtttcttacttatcttcacacctttcattgagcgtttgtgctgtaattcatcgatttcttcttgtattttcctgaactcagtcggagaaagggaaccgtcatttttatacttaggtttagccatcacttctccttgtgcttaggctagatagtactaaaaatcctttagtacaattttcatgtattttataagagtctctttgtaatcaactttcttattgttatacattgcaaaggccaagccctgacgattcagttcattagttaaacactcctgaaccttcattgcgaattcctttcgctccaagtgcttgtgttccttgacgaagctttctacttcatcttgtaatgcattatagcacgaaaataccaattgttccattcttaatatcttttgcatagcatattcatcagtactgaacaattgttttaaatcatcacttgaaccatttaatactgcttcatataaatgagaatcaataataatactatcttttgtaagatgtaatgaactgtaccagtcagtctttattttacacattgtcccattatttaggatgcacacaaaaccctcaatatcaagcattttatgaacttcctccacgctttcacggaaggtatttcgtaccggaaaagtgtgatgaatatcttttccagtcatattagtactgtactgtgcaagacatggaaacttatcacgtagtgctttaccacatagcaactcaccactcacacgatgacgaacgttcagtacaaacagttgttctacctgatatggtaatacaattcggtactctgggcttgtatactccatattaactgtgtaacctaaacgttccgcttcgtcgatgtactgatacaaattctggttctcgttaataagtcgagtactgttaatcgcatggtcagaatacaatgcagtatgtgatttacaacgaatctcaccatcattatcacggtaagtactgataatcgaaccatccaacttaggcatcactaccgcaatgtcatcgcatgtggtgttagcagggaacattgtagcaggattctcgtaagcattgaagaactttttcattgtacgtgctgcacaacgtatcatttcaccttcttcatcaatttcccacatagagccacgggtttccaacgcatttggttgcatgaaatcagtgtatgatgctagacgataactgaatacacgatacgtgccaccagcaggacttttatgatccacataaaagaatgcatcgtttgtattacataagtgcattaaatcttcatatatttgtaaaagggtcattttattacctctatatctacatcagttccataatatgatattaatccatcatccgattcacactgaatagacaactcagattcatagtatgttactttattcactgttagtacttgttcttcaattactccagaaaaataattcatctcacgtacacgaactttagttcctttaggtagttcatctgagatttttcgaacaagatcataagcagcctgttcaagtgtgtacagtaattgtaatctatcttgaatattcatattatttccaccaactggtatcacgtccattagacaaagattcattgtactgatgcctaaaattagtttttggattattgttcatagtactaataaaatcaaatttaacattctcttgaatatattttttaacactatctttaaatttaatagtactgaagtctaaatctagatgttcatacaataccggatgacaaaactcatgtgtacgcaacgctggcatggtatccttaatgtattgcacagtgttaatcattgcattgtattccggcatagcacgcatcatcattagctgaaagtgttcttcctctgacattgactcatccaaatcaataacgacttcatcatttttagagtcataaactttaatggtactcttggttggatcaagcatagcccactctggatacaggcatgttttccaaaaaggattattgcactgaaacatactaatgagattttgatctttatcaaaaatagcaaatccaagatccgaacttggttgtacttcacatacacaaatatcgtaagacgagtcttcagtactgagtgaaccaactacatttgatatatgtgaatatggagtttctcttgactccaactgaaatgtactttcaattcgattgatttgtggatgtaatgtaattacaccccttagtacatataaaattctatctaaatctttaatcaaaattctatccccgtatcagttaatttcgttccgtccatgtacttaacagttatttcaatgcgtcgatcagtactcaatttttgaagatcattgtagtacaatttaaattcttcaaagaactcaagtggtggaatatcgtataaagtactaatctggaagtgctcaggtaatccaaattccaatatatcaatcttaggcataagtccatcggctgctgcaccttctggagtactgctatctgctacataaaacatagaattaccatgacgctggataacgaatatgcaatcatcttcacttacataaatcatatttccaaggtatggatcgttatcacaccaattatcatggacgagttgttcaacttgaagtaaatcttttataattccctgaccactatcgtcaactagaatatgtaaaccagaacaatctttgctcaaccagcggtatcttgcatcacatcctgattccataaatggatattttgaaaaatccatatcagtaccattataaaaccaatcgtaccactcattacgcatactaatcagcttagtacttaattctaatacattcattttagttttatcctcttaatttaatagtactggctggatattctacaaaagtattatctggtaatcctatacagtaataaggtaaataccccatctttatattaataccaattaaaattcctgttttatatgaagtattaattccatagtaatcgtctatatcaacagcaagtccatataatgatatgttacaatccttgatgtatcggtcaaacattttatacattgatggatataaagttccattggattgtctcaccaaatcagccaacattttgatagtactgttaattaaatctatactgaacatctttgtacctgcgaaaaaagaccagcaaacgctggcctaagaatttaaattatttcataaagacaatatacaccatcaacgccagcatcaggaaaatcaacatagaaattcacactaacagtgtcgtaatctatatcagtgattcgtccggttttacctacactttttacaaatatatcagacccaagatacacaaactcgaactcgtcagcatactcttttatgatatctgcgaacctacaaccacacctaggttctgtgttaataatttcaagatataatgtaatatattgttcgtatgtccatgtgtgtagataaaaatccatagaagtttccttagaaatatatcatacccatcaattcagaatcggcggggcgagtataaccttgcttcttaactttaaaatagaatgattcatgctcttctaaattataacgttttttcaagcaacgagtgtatgtctgacaatttgggtgaacccattcataaatgtgaatgccattttcgtcataaccatttatactacaacgatttccttcatgcttcatgaagtttttacttttttcagtaaattctttcactgtagttgtatatggagatttgtattcaaaaggaacttcagtcatacgaaaataatagtattcttcgtcttcatcatatcccaagagcactgtgttcgtttcacgtacattgtaatgattcttactttttaattcattttcgtatatatctttcagtacttctgcaaaaacttcctcgcttgatgcattaggattagatacacctgatactcggcgttcaataataaaatcagtgaatttacggtcttcggcaatatcttcgttcatataaagactaacaaacttatccttatatgtctttacactatattgcttactttgcacttcactataaacatctgctaacatattctcctgaccacactgcacaccacttacagaataagcacatgcatgttcagccattactgatgttaacatttggaaatttgccatgtttaattcattcgccatctctgtagcgaaacggatacggtcaagcatttcacacactccttgtgttaattattgttccttacccattattatatcatgaattaaactattgtccctgtttatagcaataaagattctctaatttaaagtccactaggtcacattcagaacgtactcgattcttgttccagaataaaatacgaatcctttcataatcacgataaacactaataatgcttcggtgcttggatttgtagtactcctgtactatccccagatacacagtcctcaataaagacttagttggatagggcatattctgtgctgacgtgatattgtaaatcatcttcattgtttcagcaataagtacttcatttgttctcattgtaatccttacatacactatgcaaagtaaaccctaaaccaacaccgacaaatggaaatagtaaattgatataccaagtattaattgatgaaaggaaacaaatcccacatactgtcagtactgccaatgaaaaaagactccagataaaaaatactgttctcataaaaatgttacctcatcaaatgaaaagtttaagtacgttgttgaatcttggtctaaactatgaatagtaatatgaccattgaaataaaaagaaacatcaactatttgaagttttgggtattttctagtactgaaatatctacccactaacacagcatatatataatccctgtactcttgagtaatgaattcatacatattatgatttgcactgcacttttcatcataagtattagtatattctttcatcagtagagtatatgttttttgtattaatatgatattcataaatcacctaatacctcaaaaattactgatattgggtataatgggttaccagttgaagtaatacatacaattagtacgttttttcctggtcccacatccgttatagtgaaattaatattattaatattcagtgatttaccaatataatgctctttcaataattcaacaaaataatccagtactggattatctgcactatatgataactcagtacttgatatcattttatatgtatgaactattagttcagctttagtcatgaacacgctcacaattaaggcaataaatgcactcaatgtcaggtcgccatgatttatcaaaatctttgtgctgttcttcggtgtattccgcatcatcattaatagggaagaaatcaccagcaccagtcgcccagtctgaatctaaacggaaacgagctaattgagtactgttacaatatggacatttattcaaaatttattccttctaactgatatacgtttaatgaaaatgacccactattattatcgcatctgaaacacagtgttaaagaaccattaaaactaactacatccgtacaggtacatttttcaccattggatatgatagattttcctatatataaatctcttactatagtacggtaatgttgccataaaaaataatacacactttcatagtactcatcttttacatatgataagtataagaatttataaaatacttgtatttcctttaagttgtttttcattctccaactccagtaaatttacaccaatccaatcaacatcactatcagtacttaattccaatcgtagcttaccgctatgactaacaatatcgcggaatttgtatattttattatcacgaactatacacaaatcatggtaatattcatgtaattcatccaaaaactttatccatagcgaacgatagatttcatcgtagagatattcaccagcatcaaccgtagcgtattggatatacaaaaatttgtatgtgaattgtatatcatttaataacatatgtaacctcttataaattcaccaacttcacaactttaatctcgataaatcccctatcagttatttcaagaaattcaacatggataatcccattgtatgatttaactccagagaactcgaatatatcatttccatcgataaaagtactgtaattcttttttatatattcacctactgaatctaagtactcaatatataaatcaataaatggttgttctttgtatgggttatgtgaacctattttgttactaacaaggtatacatcatacaaatcatataggatcttataagtgaattgtatatcatttaaatttaatcccaagggaatatctccaacggaatactggtaaatccaaaatcagtgtagtactgaacctcaactttaccatcacgtctaatgattatatcagaaaattctgcatggtcatcaccaataataacagtactgaatttttttttaatcttaccacgaatcgtatgaatcatttcagtgcatgtgtcttctagactagggctatcattgtcgtgtgctaaatctcgaataatcttgtatgttagtaggaaatctttataattcatatgtccaccaaatctatactatatctttcattagtattactatctataaatgatagtactaatttaccaccaaaactattaacttgttctatcttctgttttttaccacgaatgattatctcactattaacaaaatattcacgtatcattattaagtgattaatccagatagtatgagtgaatgtgttttctcgtattgtattgagatatcttccattgtgatgtaaatcaaacaaaacactgtatgtatattgtagaactttataattcatatatccccttacaaaaatagcccgaacttatgtcgggctatgtacattattcatcgtcgtcatcgtcatctagatcgatatagatactatcatcaccatcatcaaagtactccacaataactcctggaatattaagagcagtaaacattgcatcatatttctcatcagatggaatcaaaacaaattcatcaatgttttggacttctggcattttatcttcggggatacccatatcaacaagtgactgaataatcttttctttgaattctaaaaacttctcttcagattcaaaatccataataagctgtgcaacatatccttcatcgttaccgaatgaaattgacatttgtgcatcagtaccgacatagcaccaaacacgtttgcctgtgtgttgctcaataaagttttgaatctgtaacacaatgtcatggcgagaactgttagcaatgttgttaagattttctacaccagcattaattccagtactgtcatttgtttcttcaaattcaccataatcacccaatacatactgtacaccttcatgatgtaatgcatatgcatagtcaaggtcagcgagtgaatcgcactttccacggatcggacgtagggaaagacctaagcgaagataacggaagtatgtattagtatttgtatttgtcaacgtaatgctccttaacaatataaaagtagttgctgttattgtcaaaaaagataaccatccctttatagacatttacaccaattttgatttcacatatgttatttgatttactggcttcagtcaataacattttgtgctctttactgaaagtgtggaacagtggtttgacatgccacatttcgataccatccagtactgaaaatttatcactaaatttaatcattgattcttgtaaaaaatatcctgtaagatttatttcatcacacatgcaagtttccaagaaaattaatcacatctgcatgtgataatgtatcattaccttctagtacattaatgataaacggcacttgacgatatagttcagccaggaattgaacctcatcagatgtgtaagaatatcccataggaacaacctgtgcagtccagtttcctagagttttgttagcaataattgcaactacagtattacctttgtattcaacatggatggaacgaaatcctgattgctcattttgatcccaaagtactggattggttttgaacagtactgacatagttatttcctcatgtattttataacatcttcaaataattgaacttttaagtcttcgtcattgccaggcaaaaattctcgaaaactatcaaaatcttcattcttcgcgaagttacgcatttgtgtagagctatattggcttatatttcggtcaacacctgcttgaactgcttttatattacaaaaattatacaacttaccattgtacatgtcaagtgttttttgaaaagattcaatacgatcagaaccacatataaaaattacatctaaatacttaccatctaactcacgcattatgtcgaataagttatcttcagtgtaaatattttcttgtacactagggtaaaacccttctgtgtaatacatcttgagttcaggtggtagtgggtttttaatattatcagtactggtgcttagatatatttttaaatcagcattgtactgttctttcaattccaatgcactgttgaatacaagcccatgtccattatgtattgggttacatctcatgaatgatagtatacatgtttctttcatagattcttcatcaccaatccgagagatttaagataattaattttagcagtagtgaggtacttatcaaggactataagacacgaaggaaatggtgctgaatctgttttcttatcaggttcttctggaataccaaaacgtaatctacctttgataaaacaaatacaatcacatattttggctgcatattcctgaaatgctattgtatcagtcctggatggtactagaatcagtactgtagcacctttattatacgcatctactgccttggctaaccaagtttttaaatcactatatgggggatttaaccaaacaatattttttccccagtcttgttcaagagaattatcatcaggtgtaaaatagttatcacacaatgcagtctcatcaacacaagcagcatcaagtgtaaatccccataactcatccaaatcttcaaagaaatctttgggagttgtccagttgtcctttccagtactgaaatgtactgaatgttttttcgaagcatccttcttcgacattatataattccttttgttagagacagttgtgtactatcttatcaaaagtactactgtcaatgttatattcatataaaaatttaaaatgtgaaccgtaacgcatcatcagattaaactcttcttcagtattgaacttgtaatcatgaatagtctcaggggtacattttaaacccaagaattctataatttcagatgttacatcatatcctgaattgaagtatttaacccaaacacattttccttgtgggttgtattttctatattctccttctagttctcctttaataatatgagccttaacacttattgaattattactatatctttcttcaaaataattaccatactgggcttttgatattgttggtttttgagtaggaagtaatttaactgaagtcacttcaattccattttgtaattcctttatataagaaatgcatcctttttctttaataaccacatatccagtaaagatatcttcgtcttgtgattgattaatgcaatcatcaaaattcaaagttttataagtaacagttttttcttttctaataaatgccatcattattcctatggaaacatcaatgaatatacgtgacgttgattgcatcaacatcagtagaattatcatgctacgcatgtctaattctacaagtactattttcttttaattaatattgacggggtttgcttgagcatatttcatcccccccgcaggggaaagaacaaaaaaatttgacgctggtggccttcacatagttcatatcacgaattctcttacgagacgaaagcgggttgctctgtttctctctatcgcggttcttgtagcaacggtcgtcggtcttaaacatcccgacacataatacaaataccatatgaccagtacttgtatttgatttcacaaaatttggacgcaactatattgtataattccgaccgcatatttcttatgaaatctcccttagataattggtaaggtgcgatccttatatgtctatcgaggaactctctttatcctattggagttctttatacagccgcattgccgtgagtggttcaaactatgccatcatctaacgggtttcatctgctgttcgtactgaaaggactactcatctaccctctacattttcgagtggattaggcttttaatcatttccttatgggaacctttcaggattaaaaaaggtgactaacatattatgttgtcaccttatattatatcattaacttatcatttgtctcagttatattcggttttttctgtgaaatttgttagtatatcaacactaaaacttcgaataacctcaatcttgcttggcatgaaacggtgtttatttttaatatacaactcatcatcttcaataaaagatgtaaaaatgaatgccatatcttcacgtggaatttgtaaaatatcacacatttcatttgccgatgctactggtgaatcattatagtactgagagtatgcactagattggcgaccgattataatagaatttctgattagaaaattactacagtactgaaaatctttgtagtacttttcaataatgtacggcataagtgcttctttcacgtcttcataaccattagtactatcaattgctatacagtaatcttcacgttcttttttctcatgatggtaatcataaacatactcaaagaatgaatttttatttaatgaatcatttaaaccaactgacccactatagtatgattttctatcattcattcgatcatctgggcatgatgcatacatagaagtgtcatgtgatgatgtaccaatataaattttcttagtaatatgattatacgctatgtaatcataatcttgaactccagtcagcattaactggaacattaaatcatcaggaacatcaattaacgggtactcaaacttcgaatatctactgcggcagaagttcttttcaaatgctcggtatgcgataaaatcttttagatttttacaagattcatgttcatgagcactactgctacgtacattgacattagtcgatgtgcaatatccatccgaatcttcggtgaagttaccagcataatccttattgtagtcaacgattagataaagtttcatacatctccagacaaaaaaaggacgagataacaaatcccgtcctttggtttattagtgacttgcccagcagtaaacaggacgtagattttccattggatttacttcaggcttcagtactgttacacgtacttcatatggagttccatctgcatgatggaatgtttcataatgaatactttcaataaatgtttcgtattcttcttgtgaacgtgaacgtactgctgatgaatatttcttcttagaatctgctttaagtgtaacactgactagttctgattcctcaccttcttcaagtttgttgaaatcgaactctggtacaccttcaaacatatcaaatttcattccattgtcttccatttttaaattccttttatataatgttaattagatatttttaataagcagattagattgtgtcatactgtagtgttccgtgacggaatttttcaagtcgtgcaagaacttcttttcgttcaacaatttctggaacatcttcttgtagttgatcacaaacttcaacaatgaagtcccaatcactctcacaactttgtcgtaccgcctcaattgttttccaatcagtactgatatcaccatcagcattttgatatacaggccaaacttttccataatcagcaatggatttgtcatttagaatacgaatggcattgaaaatctgaccagtactgaagtgttttgtattcttcatatcttctaaacagcatagctttggctcaccttttacttcaatgagtaaaacaccaccaattgcttttaggactgaacttgtattcatctatatctccgttatcaaaaaaagatgtgaacattatatcacaagaatctaatatgttcacattattttcattagattttaataatattgtaccagttatcaaaatcctcaattgctagaatgaacatattttcatcattgaaatctaaaatatgttcattgtataggtaactaatgtacttgtttttgcatagtctagcattcattagcaacatttctactgcacgttcataagaacaaggaacaaggtataacttagtaccatcttggtgaataatttcctcagcaccatgtggtataaaacgttctgctgtatgtggaatatacggcttagttttaaaaataattttgaatttagtatccataccaaatcctccagatttataatgtttcttttatgttatgtaacatagtattaactatgcacatcttaccacctaacttgtagtaatattctaacttattaataatattactttttaatatatcaaatatttgatattcatttggatcgaaactaagttcgaattggaatgtatataaattgttaaagaggtgaactaatgatgcatctggtgattccattgtaactgtatatttttcacgataaccagtactaatcactacttcggatatatcacctttcatgtatatgtcaatattgtacatcattggtctgcctgtggcaatatctttcatgcgaaagaatgcagtgctacgatatacaatgccttctgaaacctgttcttgtatagtgatatttgaaacttcactctcttggaatttggactcgaatgaatgagtgtaatttgttttttcattatccgtgtgcatagtacatgtgtattttccaaaatcatctctagatgtatatgatttatcactgctagttttatagaacgaaacaccattaatatgttgttctttatacatcatcgtgtcatgggatttgtagtatgaacaattaggtgttgaaagagattcaaacttgttcacgtcatgacagtaagaaatagaagaatcgctatacattactacatcacgaattgcaacttcttttgtaaaaccttttttgacggaaatttgaaagtcattgtatgggaagattgtatatccatcgtatgcatctgatgtactgataccaaatggtgtagtagaattcagaaattcgttgatatgttcaagtactgaatactttttaaaattaagaaaatctgaaatatctaacatatacaatcctcataaatttagacaaaaaattagtcgagaataaatctcgacttgtgttttactttaccatttttcatttcttttttacgatccacatgtgtctgaggcttgttaaactcattcatgtgtttctgtacgaaattgtttactttcttagccatacttactccaaactgggatctttaactgttagactttctatgtcactcgcataaagaactacattggattgattttcagacactttaaagtcgtgataactgtctttgacgataaaattatctaatataaaccctttactacagcacatcataattttatcatctttgattgtgtaggtgtttttctttttacgtacttcagattgtggcgtaatactatcgttattacgaataacacaatcaatatattgttcatttgtactcataggcatacccatgataaacgagttttcagtactgattgttagtataaaaacgttagtatttgggttgtgaaaaaaatcatgcattgtcttgctacacaaaaatagacattgaataatgtccttcacattaaacattatatcatgaactttgaatgcgtccaactctaaaatgtcatcaattttcccattttcaacagttttaatctccatgatctatccttgatcttctaatgcactccatgtgcgtttttattaagtcactgcattatacttctctatagcattagtaatatttaatatagcttcaggaaccatttctttattgtattcacgttttaaattttccattttcttaataatttccaagaaaaatggcaaaatacatgaagtatctgtaaaattacatgagtacaaagtactcatttgaaataattcacctgaatcaatattaagagatttgtattccttaacaatgttttcgtttgtattgaaaatatgaaatactgttcccatgtgatgaagatatacaccattctcattttgaatatggcatggtgtgattacaatagcagtgttgtcaatattatttactattgataatcgtagactatgtaaacctaaaataacagtacaatcacttgaactgctttgaatttggtcagcagtttgtgtaacacttgtaatattttccccatcaagacaactcttgattttatcaaatgaatttttcattgatttagttagatacatttatgaacaccttcgaaatatttgattaatgattttatcatatcgctactaatgccatgtaagtcaacacctaaacactcgtattgaaaaaaatcaatatcctccagtgtgtttagatcaatttccaccttatcatgacccaacgaattcataataacgtttttatcattaattgtcaagaaagtttttttatctgaacctaaaaagatttttacatgtttttttggcattacatcataagataaagattgtgaaccataaatgtatatgccttccattgaaccaatatctataaaatatagacgaatccctttgtggtattttgactccttagtgatcgcctctattagttcatctgtggttgttaaccttgtttctttcttctctaaattgctcaaatgcataaaataataccttgatcatttgtaatgtttctgacattacatcagcagaaaattgaacatcagtgtattttaccatagtactttgagtaaagaaagtagcttcaatatcttcaaggtcaaatggctcatcaaataaattagtactgaacatatcagtttttttcttataagtcaacataaacttagcactgtatctcaatacaatttcatctttacttactaaaattcgtgcaatgttctgtctacccagtgttgtaatgttaacattaaacgtattctttcgtgcctcaacaatatcaacgaaataaccatcaccttggtaaacgttatgacgaacttctaatccttgctgaactgtattgaacagtgcgtcctggataaaataatttgcagtatcgatgtttcctaaaatatctaacataacttctcctttatagctgtcatatttagaagaaattcagtaagcaattcctccgtaacatgctctgtataccagaatatcacaatatcttttgaaagtcgtgtattcataaaaatatctactaactctttgtagaactctagtgtttcgagatttgtgagaattaacgagtactgaaagagtaattcttccgttagattaaattctggataaagtaaatcattgaactcatgtgatgcagtttgaactttaatttctttgaagttattggttatacaaccggaataaatatttctgtgcaactctctgtacaacgcagcataatctatgaattttgctttagggttaaaatcaagaacactttcacctttatatgacaatcggtggaacgccgagaacatagtcacttcccacggttgcttaatatctagctcagtgatatcaatattattggacagaagaaccgtaaaaatctcaccaatctttaatagtaattttgtacgtgccagtgctaccatcggttcagacattatacaccttcatattcatcaagaaaatcttcgataatcatttcagcttcatccatatgcatagcatcaacttcaatgatgcgaactttagatgcatcccaaatcataaagctaggaacattgtctggctcgtaatcatttttgtactgaacagcatcataaccttgagcagtgcaattctcaataagtgaacgccactcatcatcactgcctaaatcttcacacagaagcacgttatcaacatcaacttctaaggtatgcaagtatactgtacatgcgtctactacgttcagtgggcttctcagcttgcgtaatgcagcttccaaagcactgtgtttacctcccatatgaagaccaccatacgggatataaaagttatcaatttttacagtactcgcatgatacagtttcatatttcattcctatttcagtactttagtcaatgctttcacagcggtttcgagttgagcatagtcgttaattgtaaggtaatgaataccatgtgcattcatttcagcatctattttactatataaatcaaacatgtcaaggatatgattgtatgcatatgaagtatttgaaacacacaattcttggaacaaacgttcttccaagtcattcacaacttctccatgaatgtcaagtactacaccatctttgtaagtgtagtattcttcactccactcttcagaaagtcggaacagtaacggattcccgccgaacacttccatgtcataggaatttatctcactaagtagtgtttcacctggttctggtgtgaagtcgaaatatgcgagtgttgaaccatcatagtccttgagtgatataccagcatgatttaagcttacttcaccataattattattcttgaacttgattttgatattaatctcaatgtattttattgtctcatcatcactgaaattgtaatcaattttatacttttcccaaagaagtttgatatctttgaagtactttaatttactttcaatttctttaaagtccatctggaaccaccatttcttgaatgtgcttacattttatatttgccatattagtatgcaatataagggtgtgattacgcaatgattttactttatagcactcattgagtactgaaataattccccataactcttctacactaatagtgataggttcacttgtactcagttgcatcagtgctgcttcaacatcatctttgttattaatagtgaactgaattcctcttttgagaattttagtttttggattgtattcagctaatacatcaccttctggataaccctcatgaagtaataatgttgtttcaaaatcaccgcagttgaagttaatttcatcataatcaggtacacaaatgtttccttccccgtactcattaggttcagattctagtgttaaaatacgctgagtctcattgctcaggatgatagaatcattccagtactgggtagtgaatgctctacgtttcttttgaaagcacatactcgacattgacccatacttcttgtatatggacttcttgaactcaatagcagcaggagccaccttgataacttcacgaattaagtcaatagcttcttgataactttttctcatttatcgtatccatataaaatatgatctagtgtactttggacttcttcatgaaagaatgaagggtaaacttgtattaatttatctttaagttcaagggaatggcatagttctaatgttttgtaacaatcctcgtactgtgccagaacatgcaatgtacttaactgaaaatgttgttcttcggagtacaataaatcataaaccatattatcggataaaagattagatttgattgaaggatcaagtactgtctgatggtgaccaacccaaaagatagctttggagttaatgttattacaaccccatcctttccccatcttttggtgaatagcaaatacacaggaatcatacaaattaatgttcagacgttcttcgtctgcatggatagttacaccatcaatagatagtgtatatttgaaatccatagccccctcacttcgtgcacgggaactaaagacgagatatcgatgaattatggtattgattttatctgcccatccttcaacacatttggatgcacataatgtaaaaagatcatgattgtagttcataaaattctccttgagaacaatgtatcatacaaaaaaaccagagtcaacccctggtacaaatttaatccatcataagtgggatgattgcccatatctttttcataatcatatcttcagtaaaaacaaatgttttaggagcagtatatgatattgacacaccaaatggaagtttgattgcatcatcaattatattatgaatatcaaaccatgttttaacataatcatatggtggaagttcatgaattgtacttaactgaaagtaatgttcttcaccaaaatcattatattcaatttcacaaattttagtgaattgttgattccatttagatataatactatttttattattgtacatagtagttctatgcataaaaccatttttgctagtatgatttgatattatgttttcttcaatgtcagtatctattttaaaattcatatcaaagttgtagtacggactcgaagattctttgaattttaaatgtaaattgcgattgttattaatttcaatttcaatacaaaacacatctgaatcaaaacgattaaacttgtaatcgttatcttccggtagattctgtatttttttcataatactaagcatagggtgtactacacttttaataaaatcatttgttattttcatagtattcctttagaactttatatgattcaacaatactatcttgtgtataatttgaactatatacaacagcacttgttttagttgaccatagatatgacataaaggttataacactactacatggacttaatgtattgttttgaaattcaatttcttcaatgttatcagtactggtatatatgaattggaaagtatccattgatttattggacagcgatactatagtagaatccgtaccgggactatacatgaatgtctcattactaattgaactatcattagtatatgatggtttgggaatataaatcaaacgcatgatatcgcgttcaagacctgacttattactttccaccaaagaaatcatatctatatttgatatatgttcaacactgacatggaactttttgtcgagaatcacatctccatgagaatttttatatgaagacaaaatctcatacatctcaaccaattcgcgtgcatttaataaactcatgttttgtctcttaatgaaagaatatccttagtataaactgaaacagaaatatgattatatttcatcattaatttatacacataagaagctagtactaaatcgtaaattaatttagtattatatagtacttggtattgtaacgcaagtgaatcaatatcatctttactttcaatatccagaaatgtaccaaaaattgtagtaccgtagagatgaaaagtggaattaatgcaatcaatgcattcattgtccaacagagtagatgatgatgccctcggtgaatcccaaatagtcactgcgtgtatgccctcaacgaacaaatctatccatattttgtgtcgttgtcttttttttgttttataattttctggatttgaaagtgtagtttcaattatatcccatatgtacaaacaatcatctcttgtcattatagcaccttatccattgctgcatttaatgcttttaaacgatctacattcaaattattgaagatgtatgttcctaacatgtggaaatcgaactggtactttttgtattcatgataaattaaactacaaaaaataacagtactaagaacctcttcaggtataacagtgctcatctggaacagttcttcttcaactgtacttgaatctggattgatagcttttaacacatactcttcatcaccgaatagtactttaatattatataaaacaccaatagtactaatatggaatgggtggtgtgaaaaacttccatcatccttaatttgtatatcggttataatctcacactcttcattacttttatttttattttttacaatacaaatatttctagccccagaaatagtaagaataccgtgatcgtaatattcattggaccaacatttagatgaaattgctacatcacggatgaggtattgtttttcaatttcttttgcactactaacaattgataacatttttgtactgatatcatataataactgatggcgttctgtcatataactataagcgttcatatttttccttaaccgattctatattttgaagtagtgtattcagaacatcagtcttgtaattgataaaatcattgtacataactagttcaccacaatcaagaacttttgcagtatcgtaacaaagcattaagtactcgaattctttgtaattgtccaacaatgatttctggaaaatgaatgcatctcgaatatcttcactttggtctaattctggtggaacatccaacccaataaaaccatcatcttcactgaaatcagattctacaattttattcattttttcatgtaatgcattcgcaaataccatattagaagaaatagaaccaatacgttcacgatttctggatgtgcgaatgtacatagtaatcgtatcccatgaacttttaatttttttagaaaattcataagttttatatacatccaactgaactgatccaaaacgatgtttggatttgttttcaattttcagtcgataatcatcaaattcaacaatttctgtaatgtcatgaatctctgaaagttctgcaatgtcatgcatgagtctcaaaattttagttctgatatggttcattgtgcatcctcgaatttaacaggtacatgttcattaatgaaattcttaagagcctgtactaaatcctctaattcttttgtactgtattttaaaatagttttaaagtgaatcaaatcttttctttccattatctttggaattttatatgctaactctaaacagcgtacagtactggcatcatacaaaaggtttgcgttgaacattagcacattgtattcatcagatgaaattttataattatatgtatcaatcacttcatgtgtgtataaattcttatacacaattttattctcactgaagtttgagcaaacacacagataatcgttgcaaaatgaagaacggtaatcttgtttacgttgtacatctgctatgatttgtaatactgtatatttttcttcagaatccaactcaatgttagcataactgctcgcagtttcagatacaaggatattgatgttatatttctcattaactttaatgtactggcgtgaaccagtatcaggaatgaacttaaaacaatgcttcagaagtaaggtaacttctttaattaattcagtactcatatcttctcctgtactctattaaaagcgattataacacatctgaatgctactgtaaagacgtaaacacaaaaagacccaataagggtctttattttggtaaaacactgtcaatgtacgctagagcttcatctctgaggtatgttccatctatcgttaggtaatagttcatgggaatatcactcccaaccgtctcataaattttcatacatgatatcacatcttcatcacaaatggtactcaattgaaaaagtacttcatcggttaacggtacgatatcaagtttagatataggattggtattttcattcaacacaatattaatcaagttaggagtattctttgacgaaatgtaacgatgcttactacgaattaccattctcgatagtgaaatactggaactccatcttggatcaacatcttcatatgataacgatattaacatctcgtgaaaatcttgaattttcattgacgcataatatgttttgtcctcaccgtacataccaaatgatttgaattcaatatcccctactttgtatgtatcgacatcattatttgagaactttattaaactcttaattagtctaattagaatatcatctttatccattcttaaataactccaagtgcatgtcgtataaatctctgaagtcttcatagaaatctttttcttccagaatatcctttaaactaggaaactcttccataatttcttctatatccgattctatgaaaaaccctgatggattatcgtagttttgtaacagataactgaaagtaataatgtaaagaagttcattaggattgtgaattaaacttagctggaacatagctgattctaaatcggattcagtactaagatcaacccaacgtgaatttctataatcaattcgtacttgacttgtatttggattccatgtgaagcaatgtgtaccaatatgacctatacaaccaacccttgtactgtctccggtatcaacactgatatcaacaaatagttcaacactgatatcggatgatgttacacgaccttttttcagaaataaatcattatccttacgaaattgtttggatgaaagagtgtcaatgatgcacatcaatgtttttgcaaatgcaacacaatgacgaaattcaagcctatgaaattggtaatcattgatattcataattcaaccctcaatattttatcagcaattgatataaccttatcattgaatacattaccaatctcaatccttatatacatagcaggtggaatctttccttgtagtgaataatatgtttgtatacctaagtactcattatctgataatgaaaatttgattctctccatatcaatgtctgttactggtaaatcaatcatttcataatggtagtcaacgttttcagtgtatattttatcgaagtaatttgaataatcactactaatatagatgctatcatcacgaataatcactttataatcagaaggttcaaatttatctttagaagaaaagaatgcatcatctatcttctcttctcttataccgaataacattttaccatcatattttacatcaagaatactacctagaatattaatggtacaatgctcatcaatattataatgtaatgaactttttttatattttgggttaataaaaattttcattaattttatacaaatgtctgtaatgtattttacattctcattttctatgtacatcaaaagccctctttaattcttttacatttttaatgaatacttttattgcagaaatctcaaaagataatgatttgaatttgcagtactttttaaagtacgacataatgaatagcatcttgagttctttttctgtataaattaaactattttgaaagtaactttcttctgataaatcattaataaatggatatatattgccattggattttaagtacataacaccttcactccatgatctaaatgaaatgtaatctgtcttaccagattcatataaggagtttatcataccatcactcattaaggataactcaatactgtatcctaatctttcacacttgtatctcttatcttctttctttgtaattacgaagtgatgacccagtgagtctttgttatcgaaaatgaaatcaactgtctctaaacactccttagcgaacttcatagtttctctgtactttcggttcattagtctctccaaactttaccagggaagtgtttctcgtagtactcatcatcacttaacatataatcaggagtttctacttctatggttttgaagattgtttctggaatgtgtgtgactttattgggttgtactttatgttcgcgtaaaaccttctgtatagctcctagacgttgtaaatcaatacaggtaggcagaactaagctgtactgaaatagctcgtcaggggtcattatagacacatccttagcttgtttgattttattgttggcatcaatgaatatatcaaatccttgtacagcattatagcttacataggttgttttatttttgtcaataggagcacttaaacgatatccatatatcccgtgttggtctacaatacatcgttgcataattttaatcatttcgaacataatttacctcgtatgtgttataattccacgctttaacactatccatttgtatatcctgaacttcatggaaatatttaagtaccttctggtattccattatttcatacacatcttcagtactgatagtgctctgctgaaacaattcctcttctgataaagtactataatccgggatttttatttcagaatatatctcattcatatatgaatcattttggtaaatctgtagataaaactgattatattcagggatataggttacgaaatggttcttgttgaattcatatcttgaagcaaagcattcattgccatccgtcatgtactgaattgttttcttattttgcattcaaataatccacgcatttatagtagactgctaaatctaaaaagaatcgttgattgtatttgtaatgattaagtagtgcaccataaaataacatagcattaagtacttttacatcatgaatacaagaaccctgaaagtacatttcctctgacatgaagactaaatcattatacggaacaaatactgcttctctaaatgtatcaatattaatcttcaaatcagacccagggcaatatgaaatgtattcggctttgtaatgaaagtcattatcatcaaagtactccgcgtagatttgattacctctaccattagtaaatgctagtcttcctttagatgaactgaactcatcgtattgaaacataccaccaaaaggcattccaccaaaaggcttaggacttctgaactcctttgcaatgcgatagatattttctgtaaattctaaaacaccatagtaatcatattctgtagtaatcataaaccatttttctccaggtactcaataatacaatcgacattgttcaggtccaagtagaaatgatcactatcggaatttagttcatttttaagggctgttaaaatcactgaactgaaaacaatcctctctggatacacagtactgtactggaagaactcttcttcagtgttaattacaatcgtattaaatgcttcatttataagaagatgattgtagtatttgaaattatctgaacttggaaaatggtatgaaataaaatcaccacttggtacttcatcaagtactctaatgctacaagttgattcatctgaactatagagtaacccatccataaatgaaaggtatccatttcgtttaataactttatgttcccccacggaaaaatcttcagtaacattcgcaaggaatttataaaccctgataatgtcttttgctattttttgtgcattgctaaatgataggtctttggacattgtgttataaccctttacaattaatataaagggattatatcacaaagaatcggtgggtgtcaagagggattgcgaagttctaccatttctttccaaactaattggtaatcttctaagtccagatagaagtcttcattccagtgctcataaaagtacttatacatgaatagaactcctaaatcgtatgcaggaaacaataatgatagttgaaagtagtattcctgatttaaaactatatcaatgaactctaatgtacgtatgccacctttcgatgaacgtatctcaatgtgtgaggtatcctttatactgtaacacatgaaaccgcctctgaattctggatcatattcacattcgaactgctcactgttgttatagaaatctctcccactttctttatctttcggtctacgtactgatacatgaatattgttatcacggtacattgaacgatttagtattttcaaacatttgaacttattttctttaatgaacttgataatatcaattatatcttgtgcagtactgatagctgattcgaatgtatctaacttaagatgattatattgtgttccattgttcattttttcatctaacatataaacctcataattcatacatttttgatttgaactgcatatgaccacctatttcacatggataacaattcataattttgttcaataaaatctggtattttttaataacttctatatcaatttttatattactattaaaaactaatgattcttgaaataattcaccctcgtcaagtgaagtaaaatcatttatcttcaacggtatattgttgcatcgcaaggagaatgtattttcatcacgaattaaagtatagaaatcattatgttttttattataatcaaatttcacaagtagtagtttaatatgagtagcgtacattactttcactaattcagtcttcataacggaataaaattctcctgtactgctccggtccagtactcaatctcttcactggataattatcaaagattcttttcatttctttctggattaaacataagaaatcaaagttacaatcgtacttattatcccatactaaactttcttggaataactcatcctcttgcattagtgtagtgtcaattacatcttcacgaacatagctatatacttcatagctcttgaagccatcttctgataattctaattcatatgcagccatatcaaacatatcatcatgatttgtcttcaatgatattaaacaagtaactaattttttagttgtatagtatgtaatacttaatgtgttcattggttttatacctcagtgtatagcttacaatagctttcatcaaaatcacaaacacttttcaagtactgacacaggtcattgaaaatatttacatttgatatatatacattatcaaattctgttcgttgaaagaatgtatgcatagaatttgtaatatatcgcattgcatcttcacgtcccatagttatatcatttgtgaacattgcatcttcatcagtactgatgtgttctattttaaatgatttcataaatggaatactctttcctagggcataaccatcaccatatgatgcttctactgcacctttagcataaaggaattgatataagtccgaatcacgattataaaaagtacgacatacggaggaacataatttattatctatatgaaataaaaatcttttagcatttttgtctaatactattcgcaatgcatcactctctagaaatatatcaccatcaagcataaatgagaactgtactaatgctttttctaaatccgctcgtttgtgataaatcatttcctgcatatatataatatcatttgctaatttcttaaaaaacaaatgcacatctgcactacaacatttatttgcatttattgacataatagttccttatacatatgatgtactttacaaatctcattatagtatttcatatcaatgtcatttgtattaaaaacggaaacagacaatactgctaacttatcaattaagtaattattatcggcgtactcttttaacttattgaacatatagatgcattttatacttaattcatcatgcaacacactgttctgaaaaatattctcttcagtattaggagataagtaatcttcaattatatacgataaactactatcgcaatctttatagattgaaattgatggatgtaatgtgtcatacattacactaaacagatcaccgtcatatgtggatattaaactattattggaaacagtaggatgataatatttcagtactgaaaactttgaacaatcagtgcagtaaaaatgatccatccctcgacgactttcgtatgagaatagtttacttgtatattcaatccctttggtgcgacggattgtttcatgcatttctgcacattgcattaaaattaccatacgttcaaacgcaagatctaaatcatcgtacataacggatatccttcttcagcgaattaatatattccaaaataacttgttcctgatattgggttcccaagtacatcaggactttcaactctttgaattcagtactatatgagtctgtttgcatcattctagtagaatatatattgaatagtttagcaatgtcattttggtctattattttcatatattctcttctggattagttcctgtaagtgctgaatataacccttcattgcaacatcctgtttgttagagccaacgaagaacaagagcttaaagtcatggtaatccatttttggtttagtagtgaaccatatgtcccacactgcactcacagttctcatgtattcaattcgattaaatgtttttgaatacttcatcaatgttaatcgccaataagttaatatacaaattactgttaaatgctatctgcaattccatatagaactgaatgatagcatagtcagggtcagtacacgatagttgaaagcactgttcttcaaatgaattgtaattgtacttagggatgtgaatttcacgcttcaaatcaggttgaccccacttcatcgcatacacaccaatgttattgttctttttccttttcttaaatgttaattgttgaatatttccagcgttgtctaggaaaatagtattattcgacacaggtgcaccaatagaaaacaatgatgtatcaattacgtgtgtctcacgcacctcacacttctggaatgccccagtaccctgtaatacataatgaaaattgtacttctcattaacaacagtactaggatcgattaatccagtactgcatttcttcagtactggtacgatagtgcgaatcttttttgataaatcttgtaatgcatcataatcattaatgttaatttttctcaaacggatgcctcttctatagtaacgaaatcaactaacctatcaagtttttcagtgtctagataaaatatatccagtactgacttctgatatagtacactaaatgtacatagattgtctagtgttccttcattataaacagtacttccctggaagtacccttcttctgtactcagagataaaatatcagaaattttaaaagattcttcattctcatgacgctctatcgtaacttcatcatattttctgttcaatgaaatataatcgtatgctaattcaatagtactacagttgttgttgctagtgtcaaataaagaatcaattgtaatcttcgtgccattagaaacttctcttcgttcatcatctacgtattcaggattttctttgaagaacttaacaacttttagaatatcatttgctttcttgattgcactttcgtaactcattttttctggactccatatatatcacctgatttagttcatatacataatttaaatcaatgaatatagaattattaaagttctctttcagaaatgcattaaaaactactaaagctcttaatgcactatttgggtatatagtactgtactggaagtaagcatcttctgaatttaagaatagtacgtcttcttcggtgaattcaaaatatttcccactttcatcgattgaatagaaagttccaggattccattcgaagtacttgaattccaaatcataatcatgggactcgtacttatattcattacctaatcctagaatatctgtaccaacacttatagtactaatatatgcccctttgtcgtctaagtactttacattattttgaaagaactttactatattaactaattcctcagcgtgcttaagatcactttcgtacattatatttcaatctctatatattcttgggtaattaagtaatcccagtagtacttcacttgtttttgtatctcaagtaaagcataaaaattaattctcttatcccatacaagtgattcctgaaaaagaaatgtttcatgatcatctctgtaatcacattcaaggaagtcaggaatataatcacaatcgtgaagatattcaatcattaaagattcattacatcttctaacggcaaggtgctggaaattatcatgatcgaagaaatacattaaactaattgtaccaggaatgtactgaatactgtataagaatttcatcgtttgcccttatatgcttcacgtacatattcataatccaaataaaatcttgtactatcaatacttttaaagtaccacataataactaaagtatctagtacttcatcatcatacaaagtactattctgaaagtaatactcttcactatcccacggacctttcagtacttcaaagttcaattttaaaggtctgctgcgattataaaaacggatttcaccaccataagcataactgataaattctgcatctggattgtattgtgaaaaatctgcgggacttttggaattcagcccaagaataactgtagttgtggtaaaatcactatccttgtagtagttaccattctcggctttgtatacttcttcgaacttcccagccttgatatcttcaatatatacctgtagttcttttgctttatccagtgcactttgtaatgacattatcttcccctacagtattctctacgtattcataatcgaaatagaaactatcagaaccaatacttttaaagtaccacataatcacaataacatccagttcttcttcattgtacaacgtactattctggaagtaatattcttcactatcccacggtccttccagtactgaataaggaatgatagtgtcatcagcatcactatctgtgttgtagatggtaatatcttcattacggcaataactaatgtactgattgtacatatgatattcacagttatcactgtcaccagtatcagtgtgcagtactaatgtttctgcacatatctcggactcgtcataatcgtcacggtcttttacaaaaaattcagtatcagatgttttatatacacctggtactgaaccttcctgtaccataatcatgtactcatgaatcttctttgcttctttcaatgcactttgtaatgacattacaaatcccctgtacttaaatattcacatgctccccagtcaagaaagaatggttcaaaattcaattccttaaagtaccacaacacaaccaaggaatcaagaatttcttggttaaaaatgagactctgttggaagtaatactcttcagtaccccacgggccatcaagtaccccgaagtcaacaggtgtatttgttgtgtcaaaagtaatcttagtacctggaatatatacaaaaaaattagtatattgactacatgaagagtactgtatagtattgtctttatcctgtcccataagtaaaatatcatcagagtatgtctttatacctgatagataatactcatcaccaaatgcacttactttatcaccatagaacccactttttatgttatcgtggaagtgatgtattctgtgtgctagttcaagtgcacttgctaaactcatatatcctctttaataactcgtagtagatccaagtccaaatagaagctaggacaatctgtattattaaagtaccacagaatgacaagcttgtcaagtacatcttcctcgtagatagtattctgctggaagtagtactcttcacttccccagtcattatccagtactgaatacggaagatgtttctctgctgcaccagatataatgtcagaatcttgtattaaaatatcagcatcacgacagaagtacatgtaattatcttccaaattaacatcacacccattgagtgttgtttcagaagaatctaagttttcttcatacatgtgaatgtactcactactgtcatcgtatctcattcgacaatatgatttaccttccttgaatagatatccattaagacaatttgctacaatttctttgctgcataaatcaattaacttcgcaatctctaatgctctttctaaactcattttaacccctgttaataccgttatctacagttttctttacgtatttgtaatcgaaatagaagttcccagaaccaatacttttaaagtaccacataattataataacatcaagtacttcattatcatatacagtactttgttggaagtaatactcttcactatcccacggaccttccagtacttcactcggaattataatgtcattggaatcgctgtcagtactgtagatggtatctgtatcattaatatagaccatgtactcattatgcatattaatgtagcattcataatcattagggtcggtatccagtacacacgtttctgtatccagtacgcacgtttctgtatctgagtagtcattattaaggaggttatccggtacataatattgagtacttgtgtctttgaaaacaccgtaaactaaaccttcttttgccatattcatgtactcatgaatcttctttgctttttccaatgaactctgtaatgtcattttataatctcatatattgaaataataattattcgttcttgatggggatggattaaatacgttttctttttcaaatctcttcatttcattttgcaaagaaaccatttcttcaaatgtacaggagtacttattcttatcaaacactaatgcagcctgaaatagttcgccatcgtccagtactgtataatctataagactctcagattcatagtcatagtcgtcatgtgatacatgaataaatttaaaacaagaatctttgtaatgcatatataaactcaactcatgttccgagtcgcccttaataagattacagcacaagtcccatcctttaggtaacttataatagtacatagaataatcatatgtcattcttgaattcctaaattgaatttgtattcttgattaatacttgcattgggtttatgcaaagcagcatactctttcatttcattttgtattgcaataacttcttcaaatgtacacaagtacttcttatcaaatactaatgattcttggaatagttctgcggtatccattaatgtatagtccggcatatcttggtgtggatactgtaatgaactgtaatcaatgaatgtaaatttaccctgagtgtaatgaatatactcatttgcactgtgcattaaatcacctttgtttaaattacaaaagtactgataactgtgcttgaaagtatgtactgatattaaaaaatcaaattccatcactcttctcctagattaaaaaatttccagaaatcggcctcaccagtactgcaccagatatctatacattccctgtgaatacatttaattctacgctgtaattcaatcatctcttctaatgtacagatgtacttcttatcaaatactaatgcctcctgaaacagtgcagcatcatcaagtactgtatagtccaacatctcggttgctttacccctaaacccagtactaaaatccatcaaataaaagtcagcattccagtactttaaaatcttgtccctagcgtagtttaaatcacccttgtataagttagagtgcgtaactaactcaccagtgtacatccatgtccttgcacaaaattcattatattttatttccatcttaatctctactataattaataaggtaaactccaatataaggagcacgttgcgggggcggggtattttttgtttcaggaaacatgaactgtactctgaaaaacacaatataaaactttatattaaacatataccttagcatgtttttcagcggaaatttttttgacccccctgcggcctgtcaaaacgaaacgtctctatttattcagcctagaaagcttgatttcttcaatccttttcatcgcacaaagccttcgactcgtcatctcgtataaattcaatactcggtgtaccgtattatctacactctgaaccaaatatgtatccttcaaaatcaaatccatcatgtattcaaaacccttaatactatgcgaacttaacacttccggctcttcaaacgtaatcataattccaatcccctatcccatctaaccttctaagatatcttgcgtaaattatttcgaaatatctgtgcaacgaaattacggattgctcataatcatcattcctgtacattgtgcatgtaagaaaatcatttaaaccgtaatctaaactgcacttgaacttctccttagcaacatctctaaaattattcataatatgtcctctgtacagcgtaggtgtactgtgaactcagcaccactaataggtaatctatattgtaagcacgatttcctcgttgactagcacggctggaataaagaatattatccacatatgtattgaactgatcttcaaataactctttcatcagcattatcccatcccataataatacatcatacattaacaactttatcgatgtaatcttctaacatatcaatatatctggtattggttctaactaaaaggtatgcaaatccagaaaactcctgtgtataatgctttacagcgtacatacaacgaagcttatcattgtcatacattgtactgtactgaaacaaactctcgtctgatagatctaataacgcttgggcttcacttctcgtgaacttcatagggtcatgtactgcatcacaaaaacaaacctgtgtctcgctattgaaaccctgtgatagatatataccttcacactctgaacgcaccgatactgcattataactatgtgttgcccccatcatatctgaactcaaaactaaaatcaacccatttttatttttaatcaacaaatctgacttaagggatttgatctccgtatgggaaatatcaccaaatcttcctgggacttcaaacttatcaacgttgtatacaatcttttgtacttgctcttttaaacgcttaattgcacttctgtctttttctaatgtatctaataaactcattgaactcattgtactttccttacatatttgtaccgaacaaaacggaactttgaatgccattaatcgacacttcatgtacatatatattttgtctgaacaaaggaactaattgaactaaactctgttgcataataatatgcatatgtacattgtcatatgccgtttcgtattggaatcgtgcagcttcatcttctatgaaattcggaacttggactggattctcaaaatttgtccttgtactgaactgtacatcattgtcctgtaccttaataccatatgaattatcattgttatcaactacatcaaattcaattaaactaccatctttactgacgtttactatataaaccgaaaatcgactcataaacctatttcctctaaatctttgacaaatgtatcataatccgataatgacaaaaatatgtctgtactgatgttttgacgtaatgtattaaacaaattatgtacctgtaataaatcaggtgcataaatcagggattgctggaaatacgattcttctgtatctaatatatccctgcactcaatttcacgaactcgttggtatattgaatttaataatacattttcatctttgagcattggaaggtatctgatgtacatgtgctccatcaactcatcctggattgaacccctgaactgcaacacgtattcaaaacacatcactacatcttgtaggtaattggcactgtaattattgctgtaaacaatcttatgacttctgaactcatcatcatcatcatttctgaaccaattgttaccctcttttctgtacttatgactaagcttcccatcctccaacgctcgaatgaacttcataatgttaattgcaaaatcatatgaatgatgcttgtgttgatgcattttttacctcaattctgtccgaaaaaataaccaaaatgtttaaagcaagaaagcattactatgttcatcactctatcatcaaattcatcttgtgtttctgcacataatgtttcacagatattcaaatgtaataattcaagctggaaactgtcggtgaaccaatcaaacttacggtatttttgtttaacatcaactgtaagcatactatatatccaacccttttacaacatctacgaaatgttcaaacacttcttttgaaaaataaccaccttcacaaaaaagcatactaaacggtggcagcatgtccgataactctttagctaaattgatttctgctcttaactcttgaacatcaatgatatcatgtactaaagataattgaaacatgaatgcatctacatcttcattcatttctgaattgtaatataactcttcagggaatttgtcggtttcgtaataataaaaaactttattgttgaacacaccactaataggaacatcattttcatctttctttgaaatgtttgtttcccatgactctatattattaggaacaaaaaaatcataggctgattttgaaccctgtactgaatccaactttattccataatattccgtatccatgtatttctgctgtaatgtaataccacgtgtactgacattcacttggaatatatcatctttatctggaacactaaatggaatacataacactgaattctcagggtatttggcaatgaatgcatccagcactttattaagcactggaatggcaattttactgtactgcatcaaatcatacattttaattctggtcatatcattcacctgtgtatgttttcacccttagcgattcaaaatcccatacatcactgattgtaccattgtgcctgtaatcataatattctactaatacattatacaataacttcaacgatacaaattcatgattccacggagctttattctcatgaacacatttggtgatataaggtataatatataaactaaacaacactaatggtgaatgtatacattgcatttgaaaatattcttcttcttgcatacaatgctcaggaataattagatcataatgtgtctcaaataaatgtaaacctattgtggtttttttcgtatcacatgcgtaccatattgtactatccgaaataaatggaatgataccattattgtttgcaatgtacatcatatggtaagagcgatttgtcttgttaaatatctcgatactttcgatattactacaaatcatgtattcaatgcaatcaatgatcttatctttaaatgcaccaatttcattgaatgtcattgatttctgcacttcactgctcatatgttctccttaaaaaaatccaaatactcttcattgaaagcatatgtatcatcttttttgttatgcaccacataatcataaagagctatgaatgcagggattatgatcttacatgatttattattgtatttgtactgctccaaatcaacggtattcaatttagcaataagcatagcagcaaagatatcttcatggcggtgtactgtgctgtactgaaaatactcatcctctccaatatcgggatgatataacggtataaccaaattattacgaattgacatcttgtatttttgtaatgcagctaaatgtatgaaccacaatctatcttcattgaaatatggaaaaataattttgtctgtgctaataaaaatttcttcatttcgattatttgtcacaagaggtgcatacattttaatttttgcagatttaataattaaattaaaaatataatgaatcttatgaactgcacttgatgcatcttcgtatgtacttgggattatgaaactcactatatgttctcctttaaaatgaatacacatgataacagctttggtcttctatgtcaataccaaaacgaaaaaagcccatatcttacgatacaggcgttctgggcatgttgatttgaatttcattgtacaaatcatcaatatatagacatgaaaaaaatacactatcttgtactatattgttgtgataaagcattttaaatactacataaaaaaataaatcaatatcatcgtggactaaattctgctggaaccaccactcgtctgttaaatcttgtgcattaaaatcatcaggaacttcaatgaacgacatatcacaatcttctttgtactcaaaccacatgtcgtcattcggataacgttcatgcttctctgggtaacaattgctgggattaaatgttaaaatattaaaccccgtagagcaacgttctttatttaaaaatgtattattccatacctgatatttttcaccaacatcaagctcttctgatactgattttattgcacataatgtactgtatattgtttctatcttgtgaacatatttaaatgcagcatctaagctgaactctaaatcatacatgtactgcataaaattacctcaactaaagcaaggactgtattgaattccactatacttgtaattccttgaaggtacatgtactttgctactacatatttctgtactaaattataattattaaattcctcaaaattgtaatttagaacaaaatctgtactcaaaaataacttatgcatctctaatgcactttgataatacgcgtacaactcactgatatcaatactggttaaattatattgttcatatctatgatacgggatggcttcaatttcaatactataaaaccattctcttaacttattaatatcaaatgtattattcagcttcataactcaatacctccattaaacactcatacacaccatcaatcgcataagcacaaaaattgaaattaattttgtgattcttgtgtaatggactattgtgtactgtactaataaggacattataaaacaacaaacgcactggtacaagcaatgaaccttggaaaaattcttcctctgatttatatgtattgtactctattgttttgttcgtttctgtatcatattttaccattactaacggggcatttttattataccatgcgtactctaaatcattctttccaataacagcaccaggggcgaaatccaaaagaccaataacactacgggaatttggggtatcaggtgtattgaatcgtttatcaaaatgactcgtgcacgcaatatatgtattgtacttcgatggaataataccaatacatttgtggaaatgacgcttgtgatatttctgggcattatataaggctgcaacaatacaagctaacttttgtcccataaggatggcattagcgtaggtgtactgaatttcattgctggtatggtacttcgaggtcataatatttcctttgccatatcatgggcttaaaatcaataacagctttttgtatcttttttaataataagacatcataaccacccgtgtcaatcactaattgctgttggaacaattcttcatcggataatgtattgaaatcaacaaaataatctgtaactatcgaatcatttaaatgtgccatgtaccaacctgaacttcttgaataaatcaaattccacccatcgtcatcatcttctaattcaacataaatcatatctggggtatacatcattttatacttcataactatatccttgcatcaaaatatcataaacgtttgaaaggtacggaattttgatataaaatttaaaacccttaattaaaggattcgcgtacaatgaactgaataactttagataatgtatttgacgaggactgtataataacgatttctgaaataattcagaactacaatctgtacgaatatcaattaaatcaattcgtgcttctacttcatcattttgtttcaaatcataaaagaaataatcgtttgtgttgacccacaaatacccttcactattttcgtatataacaggagatgcttgttctggattgccttgggcaaatgctgcaaaacaaacttttgcattactttcatctttaaacaaaaacgataatttatcatatctatcttctatgcgtaaatcacctatataaatgtacttatgcatagaatgattattcttgagcataagcattactgtactaatcttgtgtgctaataattctatctcattcatatattattacctattgatggatgcatcatcttctaattcaacataaatcatatcttggggtatacatcattttatacttcataactatatccttgcattaataaatcataaactacatggactaaatttaattgaatataaaattttaaacctttaattaatgaattcaaatgcattgtactgaataacattagatacatcatctcatgcggttttgtgattaatgattgttggaatacgccagcttcatcataagggtctatgaactgaaatttgtcttcatcataatttgtattggaatgctgatatataaaataatcatcattggtattgtaccacaaatacccttcgaatcctgtactaacatctttggtcaatggggatgctgatactggatttgaactgattaatgcacctacatcaacaatccccgttgtatcatattcgatttcaacatcaatatcaatgtatttccttgcgatatctgcgtttatggacaaatataaactaccacctgtcctctgactcaggattccatctatatgcgatataggatggttgttattgaggataagcattattgtacttatcttgtgtgctaataactctatctcattcataatttacctatcgatggatacctaggatttgtaggatgtaaaatcctgtcctgtactgaaaggtgctcaaatgtaattaaactcaaataataatcgtaattatcaataccacccttcaaatgtatattgtaatacatcttaatactatctaataatgaatcctgtaatgcatttaatgttatcgtattaatcttttgcattaatgttcttctcttaaaaatcgtttgatagcataatctaaataaaattcataacacatgctatctctgttctttatccatattttgtaatcggattttatattacgcaacaaataatttgtattaattgtgtaataatctaatcgccctaatctttccatttaataggatactcctttccttgtactatatatgacaaaatccatccgtaatgaataggatgatttttgtctgaatcaggaataaaatataaagctgtacttggattatgactgaataaatctttattgtcaaatgtaaaatgtgataatataattttccttgcacttggacgaataacattcttaacactgaactctgttcctttgtatttctccgataattcaaataatgcatctgtaattaaatcactgatctcttggattacaaaattctgataaaatgcattaatctcttttaactctgtatacaattcacttctggtattcaaaagaaatattacttttttaagatcctgaactatttctggattcatattcatttatctcattctgtaacttaagcatcaaaatttgcatattaattttttgtaaaaggtgcttgataaatttctgtactgtatcttcttgatcttttgtaccaagataaaataacatattaaattcagataatctcagagagaaatcttcctctccccctcgtaaacaaaaatccctgtactttgaagcgtacaataaagaatctacctttttatatatttgggtctgcattgtatctccattttcaaggaccatatgagcttatcaacgcattgatcctgtgctattgtccctagataaaataatacatcaaactctgatattttgatattaaaaggatcggtgtgtacatttttaataaactccctgtacttcatttcatatgcattaggtatattcttatatgtcaatttcaatgatcctccctgacataccttgtattagcttatcatacatatcgagcatcactttttgaatactaattagtactggcatcgtgcaaatatcaatgtcgtatactaagctgtactggaataattcctcttcctgcatttgtactaaattaggtaaaagataattgtctgcctcttcatcctggtacttgaaatgcataacaccatcctttttgtacaaaagaatgtcaatatcacctaactcttctgcataaccaaaaatacatatactcgatgtttttgctatattaaatttcatctccacctctctccgtcagcacaagagtactggtacgttgtcgttagggtagggaccatgtttgtaatgggcatgttgttaacaataaccgtaacaggcataagaatcgtctcttctctactctgtcctgtccttgtacaattcatcttctgcatttcatctgaatccatgaaatacaatacaaatggtgcaatcccaagaacaatacacaaaacgataaggaaatttaaaaaatttaacataatttttaccctatgattaacgttagtgtactatatcagtaatgaaaagtactgtcaagctagtattgcactgttctaatgaaagtacctttactcatggatttaagcttatgaacctcttcctgtatacccttgattaaccctaaaggtataggtacatcacatattaagctgtactgaaagtattcttcttcagataaagtactaacatctgggactccaattttagttagataatcttgatgtgttgaccaataaattatatcttcagtactattgtactccccatatactgaacaatattgatgaatatctttcctgtacccttgagcaataaagaacttatctactgcattaccagcattaatagaattcacttcgattgtcacagtacttgagcttgtataactcttaatattatcagtacttttaatactcaactgtgtgttcttcataatcaccattaggctcctgtttagattctttcattagtactatcatcttatgtactaatggcataggaaactctaaatcccatactaatgattcctgaaagtattcctctggtgataaagtacttaaatctttaatatcaacgtgcttgtatattttattttcgtaattaacaaatgatatatataaatcactaacataagaatcataggtaattgtgaatggcttacccttgtaatccattacatctctacatagactacttttgatatatgtatgttcaaatgatttatataccttgagttgtatattagttttcatatttctctttattagcttgtttggttttatagtgaattaaatctattaatgtaatcaagtacaacgtcaaatagtactcttgttgatctgtacctaatgatacaaagaacttgtgctcatagattaaaacctgtttctcttcaaatggacatttaatcctctgtataggcttaagtaaatgatagtacttattaaatctatgatacatttctagttctgtcagtactttcatattaaacacatactccattagcagtagcatcacgtaaagctgtcaaatacttctgtacggcttgctcttgcttatttgtacctaaaagtatatacatccataattcactgtaatgtacatcttgtgtataagggttgttgtaactttttgataatatagcatcaaattcagatgcatgaacccttgtgaacttaagaatatcttgttgtgttatgattctcatatcttttcctgtactatctgcataagaatccctatgtgtgaattaacagttctctcttgatgctgtgttcctaagagtgtcagtactatcatatctgaacgcaaaagatttttttcaagttcacttatatcagttcttgaatcaagtgccatatatttgtgattattcttcctgaatagtgccaagtactcttgatttgatattaccttcatagtttactttgaatttccattaaaagtgctctaatatgctcattgacaaatcgctcttgggaatctgtgtctagggtgagaagcattcttaaatcggaacctctgatggtatattctaaatcattctttgattctcgcctaagtttctgaaaggatgagaagtgtaatgccattagttcaatgtattctgctgttcctaggggtttgtgtgtgtgttgtctgtgcattttaattttattacccttttgagtgtattaatgtaattatacacattggcttcttgatagttagttcctagagtagcttgaacatagatttcatttaacttaataattttatcagtatctggtagttttgatgtgttaatggcaaataacttcaaaaacagtccatttaagattgttaggtattcttcgtcggtaatgattcgcatttgcattggataaacctttttagttctttgatgtaatcattaatattgcattcttggtagttagtccctagtgtagcttgaacatagatttcacttactagaatacttatttcatcatctggtaatttcatgctttttgttataaacaactttagaattaaactacttaatagttggttgtattctgtgggtgaaatgattttcattttcatttgcattttctcaatacggattctttaagttcattgatgtagcactctacatattcttcttgtaggtttgttccgatatgtaacagtactcttaaatctgctctcagtacttctttgtcatcttcatctatatcagacagtgttatgtttaagaatttacttgaactctctataagtaatattactgaatcacctttgcttaaaattttcataatctctttttgctttcctcgccaaaaggtacatatacgattcttcgtattgtgcttggaagtttgtgtttaagagtcgaaacaacttctgttctgctagaacgagttgcttatcttcataacaacggtagcgtatcaactttttgtattcgatgttgattacatccattactataagcccatgttcatcatctgtcaagtgtttcatgcattttttctttttcttatatgtttagttaaaaggtatattagttttctgatgtattcttcttgatagttagtccctaggagtgcaagaagttttgcttcaactaaagctaattgacgttcttcaaatgtgtgttccagtatgtactttgggtttgattttttagaaattgcactattagttttcattacaatcgtatgatattcattaactgttaggatttttaaattcttgagcatgtatcttttcctttatagagaatttaagatatcgaagcatactttcaatgtaatactcttgtctgtcagttccaagaaagtacatgagttgaatgtataaaacttctgcactcctttcggcatgtgacttgtttgtgtcgtttggaagttgatttgtaagttttctggatttaattagtcgttcttttaactcatcgtctgttaagtatttcatttgcatttactttttccttaatagtaattttgagatatttaattatacgttcaatgtgatactcttgcctatcagttccaagaaggtatggtaatctttggaataaaacttctgcactcctttctgctggggtttgatttgtgttgtgaggaagtttatttgtaagtcttttggatttatctagtctttctgttaactcatcatgtgttaagtatatcatttcattttgcatttaatgtttcttacgtaaattgtctggattaaacaatcaatccaagtttgaatatattggttttgatactgtgtgcctaagagactctgcattttaaactctgcttcaagttcatatctcttttctatagaaaagctcaaatgaccatattctttatcgtatcttctcagtgcttccccaattctatcaaatctttctgctaatctgatgttattcacaatattcatcgcattcatcgatcagtacacctcagtggttgggtcatttgatgaaagtacagcttacctctgatttccagtagtaactccgcgattaagcgatttacttctgtatcttgatagtttgttcctaagaatacacccatctttaactcacgcatcataatcattttcttactgtgttgaatttctgggttgtgatagattgtattacgtttgtgcgtaatttttgtcatacgctcggtatattcatctttacttaaattgatcatttgcatgttaattacccttacatttattttcaatactattctttagtttgtagatatagttttcttccaatgtatctcttaagtgcgattatgtattcatctacataatactcctgatagtttgttcctatgaatgcacccacctttaactcaagtttcataatcatcttatttccgtgtttaatgacttctccgtgatggatttcattaagtccaggtgcaattttcaccaggcgttctttatattttgcatgagataatttaatcattttcatgttaattacccttacatttattttcaatactattcatgagttctataagatagttttctaccttaccttcctgatagttagtccctaggaagttacacaacacggcttctatgattttgattcttctggtatcaggtttcaattttttgttattgaatatttgaatccttatatctctggatgcatttaaacgtttttgatattcatggtaagttaaattaatcattttcatttacgtttaacctctcgctggagggcatcaattaacatcagtacagcattctcttgatagtttgttcctaagactgaaagcatctttatctcatttactaaaatcaacttctttgagggttcaataatgtgactatcataaacggccttacgtgctggataagttttcgccagtataacataaaattcgtctttacttaaattaatcatttgcatttacttttaacctctttctgtagagcgtcaatccatagatctacatacatttgttgatagtttgtgcctaagagtgcacctacatagagttcagttactagtgcgtgcttaaggttagcttggatgctcttatcgcttgataagattttccttctgctggtgcatgttttcaggagtctgatgtattcaaagccttgtaaatttctcatattttggataccaccttgttacgtaaggcacttaacaatacgtcagtgtagatgttttgatagtttgtccctacgaaagcacccaacttcatttcagctattataacacatttgtcctcttgtgcaatagatttgtttaacacaatactatacacttttgatttgatagtttgtaacctccaatgatactgatactcattaagaattatcattctctttcctccagatttcggttctcatgtgttggcagtgtgcatcaatatattgctctatcgatctggcgattgctgttttatcagtgcctgtcatcagtacaagcatctcggcctcacagtgaagtaaacgcatgatatcatagggtaatattccagataccgtgtcatagtgtttctgtgccagtgtctgcaatagtttacaatacattttgtgatttagtctttgtcgcattgtttattccattcttttttggccttgatggttttatattggatttggtttcttaatgcggataagtatcgttgaatgaacagatcttgatagtttgttccaatgaatttcataagataaagttcaccgttgataacatccacttcaggtgcaccatataaggcattgttttttctaagggtatggattaaagagaatagggcagtttgatactcaactcctgataaagtcttcatgttttgtgagcaaataatcatctagtttatcctgtataacattcgttaattgttcgatatattctgtgcaaaacttatcttgatattgagtccccataaagtacagcaaccatagctcattaactttagctcgcatttggttccatgtaaggctggggtcaccgtagactatccttgtgatgggggttagtttacgaattatagtttcaaattcatcatcagttaagtgtttcatttacatttgtcccttattagatcagtgagggcaactatgtgtgcaacaacatactcttcctgaaagttcgtccccagtacagccatcatgcgtatatcggtggtgtttatcctgtgttcccttacacataaaccttctgtgtgaggaagtgtaaaatatttgtttattgcagcaacgataattttattcttctcggagttacttaaatgtttcatagtttactcctgatataattctgaagtgcaattaagtattcccctacataatacacctgaaagtctgtatcaaggaatgcacccataagtaaatctttttctaatacccttgataagttaaggtctgcatttgaaaggtatataagtaagatttcaccctgtgcggaattgaaacgtttcttatattcttctggtgttaaaaaaatcataatttgctcctgatatatttctcaagagatgacaaatacttttcctcataatacttctgatagtctgttcctaagaatgcacccaatagtatatcattttccaatacctcggctaagtttaaatcagaagtctcttcgtatattatgaggatttcaagttgtctggcagcgatgcgttcagtatattgatatgagttttctataataatcatagtttactcttaatatcttctattaaaaatcgaatccaatcgtcaacatactcttcctgatggtttgtgttcagtacagccaacatgcggatctctgctcttgcaacttcaatttcagttttaggaaggtctttgctgatatccaccattaagtccatgtatttcaagataagaccgtatgattgggttcgtgttatagttttcattgtttcctcgtggacaatattttatttttcaatgtatccatatattgaatcacccatctttcctgatagttagttcccaaagtaatcaaaaggtataactccattcgttctacgtgtgtgtctgtattataaatctttgtgaagtttttacgtaacagtgattgatattcttctttatttaaaatacgcattttcatagtttactcgttatatcttcaattaaataccaaatccaatcgttgacatacctttcctgaaagttagttccaatgaatagtgccataattaattcacgcttataggcaataccacggtcatgggacttatacattatcatagccatgttattgataagtctttcgtggtgctgttctttagttaaaatacgcatagggactccattaaaaataatatcaatcctataatatacgattcgtataaaaaatcaataacattttattcgtaatacccctttatcgaagtcgctaaggttacccgccctttagccccctacgcattttgccatagtccaatcccttttatttcaaaaaagtcaagggattacctatgcatttttttaacgcataattttaaaaacgccttgacttttttctgaatcagtactaaatccctttacgcattaatccttcgttacgcttacgattatctgtgtatccccatagtcctgccatacttccacgccagccgtcgccctggttagtcgtgctgtcatctgcttaatggtcttaggctttagtggaacctgttgcagtactgtacgcatagcaccatcgacgttatcatgtacgcctgcaatagtgcctagaacgctgtatactgtatagaacatatgtatgtactcctgatatagttaaggccgctagagagcggcctatgatgtttggtgatgtgtattgcttacagccctaagatagtacgtgcttcgttacgttccgtacacagctgcatgatgtgagcaagtaagtccttgctaatgtatccggtgttcatagcttcacgaatagatacatcataagcaccgaacccagtgcgaacgatacgcacatcattcaggttagtattatagataccgccgaggtctacggcttcgaatactacatcaacagaatattcattgttgccatcgtggaagttttccagtgcaatagtattggataccgcccaacgtttgcagtttccaatgatgcggcactgttccggttggatagtgccattacttacagcgtactccagtgcatctttaccaaaagtccgagccagtactaaaacgtcagcgaaggaagtgattgagaaggtcatgataaaactccttaatttaggagggagaaccatttccccctctctatgtaaaacattatacatgaatctaagtactatgcaagtactttttacattttgatacctggattcaggtagcggtgagatccatattctggatcggtttcggtccagtactgtaaatcaatagtgcctttagcgttaatcttgtctaccagcttattcatcttagcgtatactacatcggcatcgatgcgtttaaagccagtagctttagtgaagtagtagtgatttgcttcactatcattgaggatataccgagcaccgtttgcagtctgtgcgataatgattgagtattctacttcacgatccagtccgtcgatgaatacagatgaaacattggtacggatgaaagctttaacgatagcgattgaagtactcattttgaatctcctaactttgtgggccgtcgcaccattgccgccctacgagatacattattgcagtactgatatactttgtcaatacttttttattaatagttttcactccaccagcagatagttactcaccgttattaactatatattttggatacacctatgcaccctgtgggctagtttttgtctatgcgtatataatagcaaagggactgaccggagtcaatcccttttttattcttttttgttagatgattctccaatcatcaacgatcatggtaagataccgaaccagtgattcgagtgattcatgttctcgatagtctgccgctccaccagcggtacaagtacagccgattacgccgttttgtagttcctggatctttacgtcgatctggttggctttagcttctttcagtacttcaaccagggcgatagcgatagacataatgttttactccaaactattggcgggagaactattcccccgctctatgtaaaacattatacattactggttagtactgtcaaatagtttttatgaaatatcttcgatgtagtcggcccatttcattttttcagtactgtcaatggctaccggattatttggatcaaaccattcaccattcccgcaatacataccaacggctacggttttatagccatcctgggcggtattccatgacattgcacgatagatatggcctttaattggtgttagtactggtaatgttttatggtcttctacgtaggccatagcttgaggatttacccgatattgtgtgaactgttccattatgtttccccttgtagttagtaaagttattacatcagtactatcaagctatgtcaatagtactgaaataaaacttttagattagattattgaggccgtcaatggtagactctctttcttctttctcccattgtcggtagtacttccatgcttcatgataggtggcgattagttcatctttttgatcctggttacatgccagtactgaatcacggtgagcggtgctatagatagaatcgaatgatttcttctcttctgccaggttagctacttcccgcatcagttcatcaaagttagccattttattactccttttagtgggggaggatatctccccctatgcaaaacattatactttgttttagttattatgcaagtacttttttcatataaacattaaattctacaccgccgtaaccttccacgatgatatgttttgcgttatcacgtttgcacatagtgaaaccgttgttgatgtgttctgaattttccagggatacatcaccgatagcggcacatacagcactaataacagtattccgcaaagtactggtatcattagcggtcatagtagtttgcagtactacgttgtcgtatacgtgtgcattgatagtgatttcgatagtgttcatggtgtatctcctggacttgaggggaaaccatttccccctctcgatataaaacattatacgttaatctaactacaatgcaagtactttttaaattttatttccgatatagtccggcatgttcttttcagtcatacgctttgctaatgtctgcatatggcttatagcgttcaaggtgtcttcctccagggatgaatcaagataatcaggatcattcttcaccttgcaatgattatgatatcgtagtactgccagtacttttttaacttcttctactgtcataataagtaccccacttcgttagctttcaggttagtatcaatcatcagtggatttttgtagttcacaaaacgagtagttttctcgatagcgaaacccatataatccagcttactaacagtacattcattcttaaaaacttctttcgctgcatcgatggctgattgcatggataaccgcccatctaagttaatatttccaaatgatccaccagcagaagtaggattaccgttcatatctttaatgatcatagtagcggagtagctggacataattttgtttccttttagtattggggagaactattctccccttgatgtaaactattatacagtactgatatactttgtcaatacttaattacggttaaaatgatatgtgcctttatcatcctgtacgccccatactgatttaccatcaacaccagtgaagccggattgtaattcaatatggaaaccattattatcaactacaaaaacttttttattttcatcccgataacattgatattctgaatcaacattaaaggccgcatcattcagtagattggaagcgtaaatgcaagtcattgtagtcatgattttattccttattgccagggagaaccgttccccctctcgatataaaacattatacttgattctaagtacaatgcaagtactttttaaaaaatagttttcagtactgaatacttatataatagatacacttccgcaccctatgggtcagtgagttatctctcaatgaatatataatagcaaagggactgaccggagtcaatcccttttttaatctttttttatcgtgttaccttacttgctgccacatcacgctttttatagtactgattccagatattgctggttaaaccgtaatcaagtactttaataagtccattacgatcctggccgatattctgttttctgatatctcttatcgttagtgttgataatgtatcatcaacgtgttgtagtgcatcagcaaagcggtgctggcgttcgattgcattacgtttaatattgtactttaattcattgcacgcgtttacgtgcttcacactgcctttgcttgcagtactcaaccgatccataacgataaacatattatcaggatcgcataaatgcatatgcacctttgcaaagtactgtttcaactgagggcggtcatagtctaaaaaattccataccttacattctgtttcattttgttctacacccgcatcacaattcgcgaccttaatcactaaccgatcatttaaagcgaaaactatacgggaagaaccagcaccgatgatctccaggccagctaaccgacaagctgaaaggatctctttgttggtttccatttctgacagggtacggatgaatttagtataattacgcattgcatgttctccttgagttaatgaaactatattacagtactttactatcaatggcaactacttttttaacattaacggcgtggatcacttccttcgtgtttttagtactgaatacttttgccgtgccttgttctactgcaatacgataacgaccgttaacatcaaccatattaataaagtccggtgtactaaaccgagtagtacggcatttcagtactgttaacaattccaccagcgatgtagtttctttgatacgtttttctaaagtaatcattttgttttcccccgtgttggtatgtacatatagtactaaaacatttgagtactgtcaattagataatattatatttcttaaaataaaatgcgtcctgtgttggttgatactcgataccgttcccgttattgacttcaactaataaacctttgtcaattagttttttaatagtacgatacccctgttgaaaattggtaaaatgtgaatcattacgaaaggtataaccgtgcttaactgcttcatcaatagttttcttttcgattttagataatttcattttgtttctcccgtgttggtatgtgtacataatactaaaacaattgagtactgtcaacgtgatattagttttattttcttattatattgttggtgttcatataggtttatctttcctgtgttctctattactattctattgttagtgtctacatcgattacacgcaattttccgttgcttaacttccttggtaataggttaccattaataaactcattagcaagctgtacggcctttgtgatgattctttgaggtgctttatagtgtacccgcaagatattatctttagatagttgtaccttaatcattttagtttatcctataaaaaaggcgggaactgatcccgccgtgttgttagtactgcaagttattagataacctggcggcgtttactgtatactgttacacgattacccttacgatcatgtcggatctctttctggttgcgaatcagttcacttggacgcttaaggtttgccaggtgatccgcgtgagtccatgcggtatggtttgtctgtactttgatatcagaatcagcgataaactcatcttgtgcatcaagtattgacgccagtaaatccgctcgttttagttctgctgctgttagtactggctccggtgaattcacaatatcagagatctctttgaactgtacggcccagcgttgacctttcggtgcatctttgcccatgtctttaaatgtttcgccttcctcgcgtgcaacaatacgggcagcttcacgggtagcgtagaatttagtaatcatggtatacatcctattagttaagttagtactacaagttagagtctattataaagtactatctgggcaatgtcaaatagtactttaaatggattctattacatgtctttcttacgttttacatcgtggtagcgaactgttatttctttgttgatctcttcctcgatgcggtgaataactttttctttcgggttgaaacctataacggtttctttaatgatctccaagcccgtgtattcgccttgtgtaccgtaaccgtatgtaaaggtttcgtgtcccaggtcttcccagcggtcgccaattaacgcagacacgtagcaagagtggtaagtattgccgtgtgaatcagtccaccgattaacgttaatgtcaaaggaggttacaattttcaattctactttctgggcaaggatcatagccatttttatttctctcttttagttaggaggggaaccattcccctcacttgatgtaaactattatacagtactaagatactttgtcaatacttaattattgtaaatgtcgtgaatagtgataaagtttttacgaccgtaaacctgcaaatcagtatcaatgtagtgcttatctagtacatcctcgacgcttaacgcggtgtcgtgaatatcttcgtagaattgaggatctacaatcttgcttaagtcatccggcgttaacttatcgttaagccattgaaccgcctggatatctgcttcacgtttccagtcttccaggttagtagtcagtacttgttcgatttcgttagctgtcagtagaatccgcatttttatgtttccttatcagtggttgatgtaagtattatactcgtttactttctattgtcaaactattttatcaggggagtttttcgtatgtcttactcctggactacttaacggggttacttgtttcgttccccgtcctgatgtaaaacattatacttgattctaagtacaatgcaagtacttttttaaaaatagttttcagtactagccaccagcaaacaatagatacatttatgcacccggtgggctgatttgtttctatgcgtatataatagcaaagggactgaccggagtcaatccctttttcaattatttttaaacttctttcgggttgcgatatgtgatagcgttcgggtacatttgtttaatgttattccatgcctggttaacattgtaaccacttgagcgaatcagttggttactaccgacaccttgaaacactacttcgaataagaattctttcatgctttcacctcgctatctgctttacctttacgccaggacattactaattgttcgcgttgccataagtcgagtgatacaaaaagttttgcggtatcacttttaggatactctccagtagtacctaaccgataaaacagatctttcagtactgataattctacttgaatcattttattactcctgattgcgttaatacttctactattgcatgaatgatcataagtacagctaaaacaataatcatcggattcatttgcataagctgtactccttatattaatctttcagccaatgatcttgaatgaatttttcacagaatccctgtttcatggattctaacaggcgttcgcggtgagcggcggcatattgctcagtactatgcgttacacctggttgatatctggattcaccatttggggcgatgtattgtacatcccacggtttttcgttagtatcagaccatttacgaacgattagttgaccttgcatttttctttcctcttagtggggagaatcatttctccccttcatgtaacttattatacagtactggattgcattgtcaatagtttttattcaccttgtttgaatatagttttctccattgattccatgattgcaaccaatacagcatggatctcacttaacgcggaatcactaaaagcattaatgaatagtcgatcattctcgcgaatatttttaatgtacttttcagcagtagttgcgaattcattcaacggtagatcaaatgctttatcccatgatggatggcgtaattgtaacagtactggattatcacgatcaccaggggaaaacgtaccagtgatgaaacatacgcccggaatactttcgaactggcaacggacttcctttgtgatagtagtatgaatgtacatttattgttatcctctattaaattaatattacagtttatgaattaattctttatctaagcgatagcgtacattattaatggtaacagcattatttttaatgctacgctgtactggcccaccagcaataacaaacgttgctttattgccccgaacaataatagcacttccaggattaccgaaatcatcttgtactaaaatacttgataagttttccattttttatttcctcttagtaggggaagatgtttccccttgatgcaagtactataacagtactgaaaactaaatgcaagtactatgataaaatcatgataggatattcactatcgatcagtacctcgaatccgaatccttcgtaccattctttaagattaaaggcgttatcttctcccgtatcgcattctaagatgatacaatctgaatcatcggcggcatcgataaaggcattcattaattcgttaccttcaccattgccccgactatcaggatcaacataaagagaatcaataaacgctacacggtcataatcaagatccggtgcaatgattccacgtttaacaaaccagtactgcaattgtgctactttgccctgtacttgatagccagtgatctcgccattgtcagtagtacgcgtgatatgttgtattcccatgattactatcctcagttaagatataaaacattatacactatctttcagtactgtcaatactttttatctcatagatctatgccaacaattacgcggatctcttttaaaagtactatcatgatcctcctggcaagtaatacaatacatgcaccctataacggcctggcgtcgattctcagggattttatcgccgcagtcgaggcaatgtaccagtgattctctttgtgcgttaatttgctttctagcgtggttaacggcggcctgaatcactgcgtgaatctcgtcttgttcggccccgtctttcgcgtatcctactgccattattttaacctcattataaaaatactatagtactgtaatgctacaataatactactagtgtttatcttattcaaaccatatgatactacatatccaccagcattaccacggatagtaacgcctttgtactgtctatataaattcaactgcgtatattgcctttgatcaagaattgatcagaattatacgccttatgctaaattgatccagtacttttttgatcatttattgatcgatattatatagttacatttgtgcaccctatgggttagtgacgttctcgtcttgatgtaagtattatgccagtactggaggatattgtcaatagattattttaatttttttctgtcattgattaatgctttcagtactatactaataacttgcaatgattcatcaatgacaatgaaattattctctttcattagatgatagttaccattgattgtatattctaacgagtactgtttacgtttaatttttgataatgtttctatttgtttttgtactgatttcatgctaatcattgtcaaacgtcctgtaacgcattctaacgagataaacggttgagtactgacattgtatagggtaaatgattaaagcccaccagcgttaaccagtgggctataatattacatcttgcggataatcttaacagtatctttcaccgatttaccgttttgctgacattgctcgatcatcgcgtattgttctgcggtcagatcctcgccagtttttgccagtactgcgtcgatgaatgaatccagtgcgatcattttatttctctcttaggttaagttaactactgtttataaaacttattatacagtactatcaaacgttgtcaatagatttaatagtactggtaatatattttagcggtagtcgtcgtatgctttattcacctggcgaatgtaactttcaaaggcttcgtctaccgtttcatactcccgaacataatcaccatatgaaactacatacatacctttttgatcttcaaacgtcatgatgatagaatccagaccaacgatttcagtttttgcgatgatagccattttttaattccttagtagtgtagttgataaaagttattatgtcagtactatcaaactatgtcaatagtactgtgataatatttttagttaatgatcgtcagtgtaaaattgtaatcccctgcctggtatagtactttgtcgccgaacgttccaacacgtttcatattgcaatagatacccataacactttttacatctttgatattccgaacgccagtaatatccttgtttaaatgatcgtgatcagaaaataaaacttgttttgcatttttcagtacagtgcagatattagccattttgttttctctctctgttagtggggagaagtttttctccccttgatgtaaactattatacagtactataatctattgtcaaactattttttttatattattcgaaatcttctggaccggactgataatcatcttcaccgtatgcactttctaaccgctcgccagtgtgatcatcagttagtgagtcatcctcatagttcacgtctacgccagtgatgtaaaactggctatcgtctggatcattgaaattaattttttggatgtttacaataactgtattgatgcccaggacaccgccatcagccgttacaaagtactgatagttttcacaaccgcctgaattgaaaccgtaattaatttcggcccgaccatcatttaaacgcagtgcctgggcgatgatttcattttcaaagttagattgagcaattgagatagtcatgattcgtttccttattactaggggaaaccgtttccccttgcgatgtagaacattatacgcttattgagatagtttgcaagtactttttatcaaatactttaaaatagttttcagtactcaaacattatacaatagatacactcctgcaccctgtgggctagtgagctatctctcaatgaatatataatagcaaaatggctgaccgaagtcaaccacttttttcatttatttttagcttttagaatcgccgcctttcgtgtcattccttgtttgatgtactcctttactttcgcttttttagcgtttaccttgtctgctttcgttttaggagtactgtaaattataccgttaggattcatttaaatcaccataaagaatagataggttactaacaacgccgcgatcaatgcaccgaccagggccgaactgtaataagctaatgatctcattttttagcctgaaaataatgtttaatttgagcggcggtcaatgcacaattacgcaggaagttttctgtataactgcggcgagtactgaaagagaattgacctttgccgttaccgatagtaacatcaaaccgagcgttgtattgtttcattttgtttctcctgttattggggagaatcatttctccccttcatgtaaaacattatacagtactaaaaactaattgcaagtactattttttagatttacgcaaactttctaccatctcaggagtaaggccaggcgggtaggaaaccacttcatcaacgaaacgtaaagggaataccccatctaaggttgaacgtgctttcttgttagtactcttttttgatgctttcatttcatattccttaaaagtgaggcgggaactattcccgctctcgatgtaaaacattatacgcgtttaaaaactaattgcaagtactatttgaaagtaaatgctcatacgctgcattaactacgttttcaataaccgactgtacagaaagatcccccacgtcctggctatagtagaaatcgcttacagtggtgtcatcgtatgcaaatactttaccaggtactgcatcaatcacatacatattaacctttaagatgtcgatcttatcctgtacagtaagcatattaattaaccttttaagtactggcttaagtagtcttgttgatcttcggtgattgcagccatcttccctagtactggattgatgatataatcccctgtaacgtcctgtaacgcattctcaggcggtttaacggctggggtagccatagccattgcctggacttgttcgacgctgtaacgctcataaaggcggcattcttccggtgttaacatagcatcagtacgcttcatcggtttaatgatgctttcgatctcattcagtacttgattaacgttcatggtataatccccaatataagcgacctaaatcgaccgctaacgatgttttgattaataggtgtatggttgacgctcaaacaatgattgcacgttgtacgccccgctaatgggctttgctggcaaatcgattttatattgttcacgcttaaagataataaaacggcaattgtttttaacatcaaaattgattgaacgttccaggagtttaccatcgtgcacaaatacaagataaccgcttgctacttgttttgtagtactggttgcaaccatagaccgccgaacatgtgtacctgcatcgattaaagtactgatatttttcattatacgatcctcttaagttaatttaatttctttccccctatgcagacactatatcaaagtatctgcataaagtaaagctaattaaagatcttttttgcgtttaacattctgtacagtacaatgcaacgggatattaagatcattgcacaaacgagtaagggaggtttcatcagtattaagcccgtctactgattcctttaatagatctaacgccgtttgttgatatgcatcttcatagccataagtaaatgattcaaccgccagaacattcaaaccgttatccagttcgacgcttacatgacaagaatgataagtattgccatatgaatcagtccaacgtttaccgtcaacattgattgcacggattgcagccagggaaacggtgttaatgatagttttagccattttagtattccttaaattaatatgttgtcttgataaaatctattatgccagtactatcaaactatgtcaatagtactgtgataatatttttacttactttttgctttcttaattgcttccacctggtcggcccattctttaccccatacttgtaaattataatggtactggcaaagagcaacgccccgctttaaaccagtaatagattttttaccacattgacaagttttcatattagtttccttgtagtggggagaatcatttctccccttgatgtaatgtattatactttattcgatttactttgcaagtacttttttaatttaattcatccaagcaaaggatacgttccacaccaagatccgttaaactaatggtcggcacttgataggtttcaatgtatgctacacttgcccactgaccgaactcattaacggcccaggtattcattgcattttgcaattccgcacctgccttgttagtaatgactgcaacagtagaagaattgccagtagtaccagatacgcgagtaatgataatagccattgttttgattcctttgatttggaaggagaaccgtttcccctttcgatgtaaaacattatacgctaatctcttaatcatgcaagtactttttattactttttgcaaaatactttaaacactctcaatcgctttctaacgaccttaacgccaccagctagggcgatgtatcagataatcagtttaatgcgttagaatcgattctaggcggtgctagtggactggaatactatagacacaaaaaagcccactgtttaaggtgggctattgattcagtactttaattgttatgcttcaactttgcgatgagcttcgatccattcctcgcgagtcataccgctttctttgatagcgtccagtactaccgcaatgcagttaccgcgtacaggaatcaaatgttcttcaccgttatcaagtactacagtaacacgttcttgaatccattttttaggtttagattccggcttatcttcaccgtacttaaccgccagggctttatgtgccatttctacaaccacttccagatccaatccagacactgccgcctgaatactttcaattgttgcttgtagttctgcttcacgggcttttttctgttcttccagttctgctacctttttggcttgcagttctttagcttcactgtacgcaatgttaaaattgttgcgtaccgctttcattgtatcgttatccagttcagccagcaattcagcagcaataacagtatcgtttgaaatcagtgctttcaggaatgattttacattagccattttataaatcctcaattaaagtttagtttacgtttattagtgtatcaaagttttatcgacgtgtccagtttttcgttcgacttactggcggtctacttagtgctccccgtcttgatgtaatacattctacgcctttttgtggtaatgtcaactacttttttaaaactatttttaaagtatgcagtactacaaaacaaaaaagcccactgtttaaggtgggctagtgattcagtactagattataaacagttaattactcctgtgtgcgttactttctctgtatccataaccgtgaccgatccacgcttagtacttgcatcataataaatggttgtgctaccgttttcgtcttcttcatggaacggcccgtttttaaatgcttgtggctggatctctaaatcctttaaaacaatctcgcccgtactttcattggtcatcgcaacagtgcactgaatgaatttttcactactcacatctaacgacgcattaacagcgaaagaggaaacagataaagccagggcgatgattgcaattttcatttgattatccttagttaccagggggaaccgctcccccgtgctatgtaaaatattatacagtactaaaaactattatcaagtactttatgattttttataaaacatttcagccgtgatatttttacccgttggctgtactttatccagaattttttgatgccctggccgtccaaatgaatatgatccgtaaaccgtaaaccagtagttaccctcagtgtttacatgtacagcacaatagggaacgccccgcgattcatcaccaataaagtgtgataccgttcccgttacattagcagacgttgatttgatttgttcaagcattttcttattccttagttaccaggggaaccgctcccctatgcaaaacattatacgcgtttaaaaactattagcaagtattttaataaaaagtatttgaaaaatagttgttgacaagtgcatccagtactggcataattactacatcaagacgaaacagtcactaacccaccgggtgccgagatccgtctattaaatgattcagtactgaaaaagtaacggggagttattatctccccgcgttgttattttgtaaggtataaacagaagtcacctttatttgctacgccgccagtgtaacgcgaggaatagttagaaacgtcctggacttctgctattaccagggtatcatcattcaattcgtcgcagaagcaaacggctggatcttgtacgccgattttgtcggcatgttcccgcatagatttaaccagtgcttccagttgggaaagagtagtgatatttgccattttattttcctcattaccagggagaaccatttctcccctctatgtaaactattatacagtactaaaaactaattgcaagtactttctattatttttttagatcttccagtacttctgcgatagcatcacaaaaattattaattacatcagggtgaatgtcaacattgtcaaataaaccgctttcagttgcatcccgcaaagcatcagacaatacatccagggcgttcaattgagcgaaggtaaaagtattcatttgtagtattcctcattagtagcgggaactattcccgctctcgatataaagtattatacgcttttaaacttagtttgcaagtactttttaaattaatattcgattgattccactacgccatcaataacattgaattgatactcgttaccctcaatcagtgccgtaatgttttcagtagtgaattgatcctcatatgcattctctaaatcacggtacaacttgcgggataattcacgaatagtttcagtgagtagttcctcaagctcattaactaacgtttcttgttttgcggttaaatcagtgtaagccgattcaatgtacccgcttacagtattctcatgcgagtagtgggagtgcgaacgctttacactcatcgccaaatcatcttcattcagcaagtgacggattgagcgatacttagttaatgctcttaccttgcgtaaaaacttcactgcgtcaacgtggtcagtactgattgatgcaccgtcaccctgggaccaaaagccactgaattgtatttcagcgtcattaatgccatattccggtagtactgtttctttatagtattcaatttcactttcagaaaaataattgtcgtttgagtttttttcacgttcccgaaccagttcgatagctgacgttttttgttctgcgttcaattcagaaaaatccataacgaaagtagtagtagtgatagttttcattttgtaaccctcattcagtagttgatgtaagtattatacgcttttaaaaacatttgtcaaactattttatcaggggagtttttcgtgtgccttactcctgggctacttaacgggaagttacttatttcgttccccgtcctgatgtaaaacattatacgcctttaaacatagtttgcaagtactttttaaaaatagttttcagtactgaatagtaaaaaaagtattgacagcattatcaagtactggcataatataccccatgacaacagctaacccaccgggtgcacaattgtaactgtaataaactactttttctatagatacactcccgcaccctatgggctacggcttatctgccaatgaatacattatgccagtactgacaaaataagtcaataccggcaattgtaaagatttgtaaactgcttatactgcaatcgcgtccaggctgtaataataataagtgccgtattggtgtactttattaccttttatttcagtactgaatgaatccgaacgatttgcatatgatgttaatttaaagtactttgatttgctgatacgttgccatacaccacagatccgctgtaagtaagtagttttattcgtggtagtatcttttacggttttaacttcagtcatatacatattagtcatttttattactccaggttataggcgggaagtgttcccgctctcgatgtaaaacattatacgccattaaacatagtttgcaagtacttttttatagtactgcaatctttttagtacggtacacggtcacgcggttgccctttcggtcgagctttatttctaccactcgacgcgatacactatcgggactttttaaggccgctaaccagtactgtaatgatctggctgtactacgctttacaatggcccaacgttcaccacttgccgatcccgctcccatatctttaaacgttgccccgtcctggcgagcggcgatccgagcttgttcacgcgtcgcaaaatacttaatattcatgctgttgcccttatcgttggtgtatgaataaaacactattataaagtactatcgcaaaaaatgatagtactttaaataaattctattacattccaaccatcgccgcacggatcgcagtagtgctatatttgaatccgtccggtgttttatcttgtccagtctgttctaaaaataacatcatatgacgggccgcatcattgcgattagtgctatcgttaataaaatccagggccaaccgatacaatccctcatcgttattaatccacaggcttacattccaatgagttttgtttttgtgacctaagaacatttttgatttagccattttttttaatcctcttatatagtggggaactattccccacctgatgtaaaacattatacgccattaaacatagtttgcaagtactttattaaacttatttgtaaattttaccactgtcagcccataccaggaaacgaggcatattatcccatgcatcttgttttaagtttaagccgtgcaattcctcagttgttgccatccctggtactggcttactacacaccgcgaaattttcgcccatatactgataaaccatcgtcaaatcatttgagatcattatatggatcattgaatccagcatcaaagtagcggcgtattgttcacgcttaagcggcaacattgcaataagttcccgataagctgcaatgtgaatttttacagtttcagccggaagacctttcatctcatcgcggaagtttaccaggttaagcatgattttattgatttgagtcgccatcgttttaatctctcttaatgtgtagcgggaagtgttcccgctctcgatgtaaaacattatacgcttttatcagtacggtgcaagtactttctacaaatacttttaaaatagttttctttctatataggagtactattattcagtactgaatcaatccaggggaactatctttctatataggagtactattattcagtactgaatcaaccaaatcactactacaccccataaaacggcctcagacgcattctaacgcattaatacacataagctatacatttgcaccattccaatcattccagggctttacaggccgtttaaacgcgttaaattattttcaattattttgtttttaggtattgacttgatcctgaaaaagcgtataattactacatagacgcgagaaagcggaaaccccagagggtgcggaattacgcccaaaattcaagatataaaaaaaggatacactcccgcaccctagcaggtaaacgcactttctcagtactgaaatatagtaccatagtccggcccaggatagcaagcaaattaattaaaacttttttgcttccagggtattgctttattttttcagtactgtataatagttccatcaagtcgagaaagactcaagcccaccgggtgcatagttacgcccaaaattcagtactgaaaaaatttttaaaaatatccggccaggtcgttgacattgcccccagtttataagataatgattccagattcagaaaaatctaactacagatactgcggggaaactatccccacgcggtaggggaactattggaaaaacaaaataaaattttgatttagccgtctatacttccagacgtgtaaccatctagccgtttagccgtctagatggatagccatctttacttccagacttctggagggctagacatatctacgtccaaaatccatccagggtaactacacccaaaatccgtcagtactataccatagatctatcttttgaaagggagtattcagtactgccatcatagccctcactatgttaccctaggaggatgaagactatcatgtagtactgaatactgttagagggaatccaccagcacaagctggtggcataatgcattaaattaaaatcagtactgacaccattctgttaatatcagtactgttcatattacgaaaaaagaggttctaaaagatgtaccacccataggaggaactatctttctgtactgtctcacgacaggaggtagagtgaatgaattgtttgcggcaactcatctctctatgtaaaacattatacagtactgaatcataaagtcaatagctttctttcatcattcagtactgaaatcgtataatctgtatcgctacaaacaacattatatcccacaaatcataaacgtcccaacgtaaatttcaactttcgaagatccaacttttatttcataggtactccaaattttttacgatccagatttaggatggagtactaaccaactttttgctggagcctcaaggggtaattgaattttaccccgaagggtaaaggggtaattgaaattaaggtgaaagtaataattcagtactaatcattgcgtgattacttttgattacatttgatgtaatttgcaaaatggaaaaggagcttggaaactacaaagtacggcagacttcctctgcctacttagtggcatatcagtactgaatcattcacacacatttccgtgcattcttgagcaatcttgtctatactaatcagtactgaatcatatataatcattctgtgattctacggtgctcatataaatgtttatatatgattacttatgactacctatgattacggggtttagcctggggagaatcctagtgatcgcatttgtccaggctgaattttaacaattcgcctgtacataaaggttgttcactaggagcttcccctgtctctatgtgtttaattactttctatatataagcattaagatatagtagtactgattatactgtacattctctttaatattataagggtctatagcaatctcggtacatctgttaaatgcatatctattaaatgccagtggaattatagatctaatccatacttgttcattttcttttagtttacttatatagaagtttttatacatagtattctctattaattaatatgatagtactagtgttagtactgagcacaattgttctttatagttcttatggtatatagaatcttttatgcactcattgaagtgccataggtataatcttgggtcgcattctttatatattcttacggggacgaatgttagttttcgtatatagaattctttatgttctttattcatattagtacctgaatataagtaggattatgttatagtactggttagtactgcaatgattctctatacatcgattaacagttatggaatagctatatctggcgtaagcattatccagggggattttacattgagcacttagagaaagtacagtaggtagtgtattcaaatagaagtctttgtaattattcatacaggaatagtatacctatgatacctgagtacaggttagtactgttaccatcttcgtttgcgtttaaagtcatttgaatacaattattgtagcatactctgccgaaaaatgtattagtacttaaaggtggagtagtccttagaaacatttgttctgaggggcttatgtatttggagtagaattctttatgttctttattcatattagttagtgtctgtatataagtaatagtaagaatacgtactgcacatcttcatctttagtattgagtactgtacgtattgcgtcattaaacaagaatatagtacttgggtcatgagaatttaaaggggttctgggtacggcatgtttgtagttccctttaacaaattgtgtgtagtattctctatgcatattagtacctatatattagggcgataatgtagtacaattcatatggaatgtaatttggggtgatcgcacactgtgtatggtaaatgaattgttcggtatttttcttatccttgatatctattgggattagtggtataagcatttgggagtttagatcgagatggcttaagtagaattctttatgcatattgttcttttagaatacgaaagctaggtacagggtatgatacagtactcgatgatagctgtcaaaatctagtatacatgctttagtgcacatagtaaagtacactttatcgttttgtgcattgataccgcgaggtttatctaatagattagtactgaggtacattgggaaatattttgtgtagtattctttatgcatattagtacctatatattagtaaaaggatgtgatacagtactcgattatagtcttcaatatatatcgaggatttagtgcactgaatgaagtagtctttttcgtagtttttttctatacccaatggtactgttggtacaaggtgttggagatacattgggagtttctctatgtagtattctatgtagtattctttgtggttattcatattatgtgttatttcgtgaaaacaagggttagtactgcatagtacaagtcatacgtatctttagggttaatagcacctttaatacattctttcattaattcattatagataattttagtactgaatgtattggatgttactatatcggaattaaggtacgagaggtagaattctttataagtattcatattagtacctgaatgttagcattactacgtagtacagcatatatggattatcatcgtatatgagcgtgtacttagtacattgttggaacattatctttgcgtgatctttgatacccaatgcaacgtttggtatatggtgttgtagatgcattgggattttatctttgtagtattctttatacatagtttgaaatatacgtaatgaggtgatgaaatttcttatcagtactgataagttcctgtacatgttttgttagattgtacgcgtttttatagagttctggattatcgattacagtactgtacatgaattcttcttctggtgttaattctttgttttgtagttcttttaggaattgcagtactgtatcagtttcgttagtacgttgcttttggaagaagtgcatgttatcgtgtattttttctgaacccatgcagtacatatcgccgatttggaattgtgcagtactgatatcatgggtgctattacaattcccgaagaagtatacattcccgaaagatagaattatagtgcacgggatattatccatgtgtatatagatagatgcattctttagtgcttttgtgctggtattagtactcaatacttttaaatcagtattatagatattaataaaagcaagagctatattatttttcttcaagtacgatttgaggttcttagatacgagaacatttctggattttttctttttatttcgtttctttagtacatttgggtgatacgtatatgctggtgtaaaagattctgcttgaatactgttgaggtatttaaagtgcttaaggtattgtttgctgtgtggattaagtttcatttggtttcctttatatagatgccagggcaatgatttccctgtagggattatcttgtgttagtacagcataaatgcagctattgagattaatatttttagtactttttgttcctagtttgtagtacttcacgaaggtgtcgtacatgaaacggtctttaatgcttatgtgttctctatagaattgttgcatagtattccttacatagagatgagtttcagtacatcaatatacatataacgttcagatgactgtacacgggtagtgataatctcaatcgatatgtttttaattagaggtgaagatgattgatggttctgaataaatgtgtggtgcatactttgttctatgtggtttagtttattgaagtagtactcaaaagtgttcatgtctaccttagattgagattagtttaagtacttctctgtacgtgtacttttcgttttgtgcttctactgtacacgagagtagataacgttttttatctcttttgttcccgactgtgtagtacctttggaatttattatagttgtatctatctttgtgctggaggttatagatatagaattcttgcatagagtaccttatattgctatcagtttgagtacttcaatatatgtgcggtactctgctttaattaaatttgtacacactgtaagggaatttctttgtataagtttattgccgcttttatacgcatttctccacacatagagatgagatctttcaggcatagatagtttattggtatagtactcaaatgtattcatatattacctcaaatagagattagtttaagtacttctctgtatgtgtacttttcgttttgtgcatctcttgtgcttgtatataggtatcctcgacgatatttgttgctcccgttcttgtagtggaattcgaacttattgtagatgaatctatcgccaggctgtaatttacttaagtacaattcaatgctcatagtattctctttacatatcaataagtttcagtactgctcggtacgtgtacttagttgtcagtgcttctttaatagaaatacagaagtaatgttgtttgtctcttatactgccgcgtttgtagtaccacacatgggagttgtgactgtacttgtctctgtcggatagttgttggtagtagtagcttatatgattcattataatgtaattagccttactatattaaagtactcggtccctggtgtaccttttagaacttaaagatgaggttcaggatagagcggtacttagtttcagggaactgatgttctattgcataacgtgtcaccatcctgaaatcgtaattataatacagattatcctttctcataggtggtgctaaagagaatgatagctgttcttgtttgggtagtttactacaatagaaatctttatgattattcatagaaatatattagtcctattaaacctgagtacataatatttttgttattgcattcgattgcttctagagtactacgtatacaattattaaagcaatctctaccgaattgagtattggtacttacaggtgatacactccttagaaacaattgttcttcgttgctaaggtatttggtgtagaattctttatgttcagtattcatattagtactcgattaatagggtaaggatgtaatagtattgcatacattttaccccttgtaaagcatttcttatgttattattcctgtacgagttcaggagtttagggctacgtttgaggtgtttgaaattagtttgtgtatgcagtaggctttcacgtagaccttttgttggtagtgcatcgatgtagtactgttcgatattcatatagatagcagtactaagatttttgataattgtttattgctatccccgcagatgttgctgtgtaaaatactcacaatgagggtatcaattgcattgttcatcataagggtgcatcctggactattataattttttagctcaattagccacgaactatccgcgagaaattccccgtactctagttcatttagagtattgaggtagtacttaagagtatttgtcatgtgtagttctccttatattccttctatagtacaccagtactgaaagaatgtcaagggttttcgttaggaggtaaatatgatataatgaataaaggagaaaataatgttaccttttggaagaatgttaaagtatgggaatgtagcacctgtacccaaaaaaataaagaaagttattgcaggatatgataatttatatgtactatatggtgatggatcgctatatggttgtggaatcaataactatcaacagttaaatattactggaactactacacaaaataaatgggtactgattacaaatggcgttaataatgcatgggctggtggatataatattttatattttaaagaagataaatttataatgcacggaactaatgtctcattaggtttaggaaataatacaattccactaggtggagtagatgtaacttcttcatttccagatatatctgatattaaaatgatatccattggttttgattcaatgcactatgttagtgctgatggtaaaattgtatatggaagaggtatgaacacaaatggttctgttggttcaggtagtacttactcacagagtacttttacttcagtactgaataatggcactaatcaggttattgatatatttggtaacgttaataatacagtgcttctaacgtcaaatggcgagcttcgtgcgtgtggtacaagtgcttatggttccataggaaatgaaactggtaagtggacatcgtttggtttaaaattatctggcactaaaataatgggtggtaatgcgtatagtacgcttgcatatacaaatgcgggaatgtaccacacagggtggcagttaaatggggaactgggaaatggtttagatactaacgtacaggtatatccatttcaatttaactctaaaacaatagatagcaagatagataaaattgctaaatcatcatctgggtcatatgttaatatgtactcaacaacagaaggaaagatatatactacaggtgcatatggtaaaaacggctcaactactgcattgaatttgttcaccaatacactaacacttgaaaattacaatccagatgccgcagcgttgtatacgtgcacaaacttcagtgttgtatatgatggtaatgaaactattgctgtaagtggtagtcctacatatgtaccaggtgacgttgccgcaaatagatggaccacaattccattacccaagtaatacgatgccagtacttgatactggctttcttatttgtattaaatatagtataatgataaaggaggaactatgttaccttttggaagaatgttgaattatggaaatgaagcaccgggcgtaccaacaccaaaagatttctttttggatgtatcatccggcaaacctactatgttgatgcttttggataacggcgaagtatggggttgtagtaatgatggacaactattaggtttaaacactaccgcgtcagcatacggtaagccatactttgttatggaaaatgttaagttaatgttcgcgtcagtgtgggggacattacttatcactaacgataataaagtgaagtacactggtagacaaaccatgtttaatggttcatctaattattggagtacttttcaagattttacaacgaagtacacgactgttggtattgacataagtactatagaaaaagttggattcaatactggtacattattcctacgcacaactaatggtgatttatggggtcatggaaataacgctaatggttatttcggaaaaggaaataccgtggcgaattacacaccaaccaagatcaagactaatacattagatttttggttaactaatgggaatgcaattgtacaaactggccctaaagaattctatgctactggtgataattattattatcaaatgggtgttacgactactggtaatataacaacatggacacagatttttaaggacgctactgatgatcctgagtttgaatataatgcaatgcgaacaagtcaagcaacattaatactttacggtaaaggaactacattctacgcaagtgggagaaactatatgagttcatggggtgtagctggtgcaccagtgaatgttaataccacaatatataaaggaacgttaccatttgtacccggtgatttaacatatttttatgctggtcgagaacaagcatattggactaacttaatcattgatactaatggagttctgtacatagctggaacaaaagatgggggtggtagttcaaatgcacctacatttgaagtattaccgaccccaagtagtgcagttgggttcaaatgtggcacagcaacacgttcttatgctataatggattgtactggcaatcaatttatgtacgcacgtggtacagctttgtcagaccctgctggctttacaccaatgagtaccccattaaatcatacatggacacacataacagattttaaatttaaccgataatattatgccagtacttgatactggcatttctttttgtattaaatatagtataatgaataaaggagggaaatatgttaccttttggaagaatggttaagtacgcaaatattgcaccaggtccagaacctgtagagttctcagatgttttacaacaacattatacaaactgtatgtatctccataacccaactaatactttatatggttatggtagtaataacttttatcaatttggtcttgggaattcagcagcagtttcgtcatttacagtacttgcaaggaactgtgcagccttttggcttggtgttcaaggttcattgatgattgatttggataataaaatatactacactgggtctgtgggtgcattttctgattatggagatgcaacacctgttaatggttatttgacaacatggactgatgttactgttgcatttaataaaataggtgttatggctaatatgatcaagagtgtatatataggtgaaagtactagaatattattaaccgatggtagagtaattgcgtgtggaagaaatactaatggtgaatgtggctctgggaataaaaattccatccctacactcacagttatgactaatatgggtgaagttacacatatggcatgttcattacaaggaacgcactatatcaaatcaaataaagatgcatggttttgtggtaaggataactttggtgaaagtggatgtggtggtagttctgttgtatatttgaacaaattcgtgattagtaatgtagaacatattagtactacatacgatgttacttggtggtttactactggtgggtctgtatattatagcggggctaacagttctggacaagctggtaatggtacgactacatcggtaaatcagctaacaccaattaggaacacatcggtcacggttgatgtaagtaagtacagtacttttatttgtccaagtaatatgggaaatgcatcaattggtgcacctatggcacaatacgcaccatatgttagaagtagtggtgctaactcatatggtcaagaaggtaatggaactaatacattagttagaacttggaatatttttaatcttagtgcaataagtggtggttatgacaatgttcttatggcatctaaagattggagcagaaccataataattactaaagattataaattatatgcatgtggtggctggaatggaaatggtggtagattgccagatggcacttatagtattactacactaacattaatgccaacgcagttatggcaacaataggagggaatatgttaccttttggaagaatgattaggtatggaaatattgtccctggtcctaaaaaaataattaaagttggtgcttctacccaaggccaattcttattgactgattcacatgatttatattacataggtagaaatcaaggtggtgaatctggaaatggtaataccaacacggtgtcttcgtggacattagtaagtgcagatgtttctaattttttcgtgggtgatcgtacacttgttattattaaaaatgataatacgatatggacatcaggtcaaacgtactggttctcatcttctacaactacttcttacagtactgtattagttgaaagaactaattggtttaccaatgctataccagtaagtgaaattgctaatattgtatgtacaaatggtttaatatttgtacttagcactaattcagtactctatggtgcaggagataatggatatcgtggttctttgggtattggttcctcatcaatttacacattaactcaatgtgctacgaacgttcgtaaagtaatgaccaatgcgaatgatagtatgtatcttacattagataataagctatatagttctggatggaatagtagtgggcagcatggtacggggaaccaaacacaaattaacacttggggattgcgtagttctggtgtaatcgatgcagccattggtggtaatgcattaaattactataatggtacatcatatttcgtatgtggtcaaactccaaactttcttagttcaggtacgactacattccgtgcagttcctgtaagtactttgcctaatagttctccattgtttatgacgaattcacctgccttaaatactgctacacaaatggtaattactagtacatatcagaagggtgttggggcgaaccgtggtttgggattaaacaattctcaaactggtgctatatatagtgctaccaatttacaattacccgttgaagttagtgagattagggatgttctttttagtgatggtttgacatcgatattaaccaaaaatggagatgtgtatagtactggatcgtattacgccattccaggtgcaatcgaggatgttgcagtctttactaaaattgatttaccaaaataacataatgccagtacactgtactggctttcttatttgtattaaatatagtataacaaataaaggagggaatatgttaccttttgcaagaatggttaagtacgggaatatcgcacctgaactgattctacctaaaaacaggttacaatgttctgctgatgccaaattttatttacacacaaatggcaatctatattggtttggttcttcagcatatggacaaagtggtaatggttcattggactcttcaactgaatggactcttgtcaactcaaatgttacacgatattggggtggggtacaaggaacaattgctataaagaaagatggtactatttggtacactggtagacgtactgttattccaatactatcttcaaacactaacggcgtttgggttgatataacacagaactttactgatttcggtgtcagtgcagatgatattgatagtgttgtgatatcttcgtgtatgcgtgtatttttaaaaaatggaaagtggttctactgtggtgctggtactggtggtgtttttgggaatggatcaacttcaagcgtttcacgattcacctatagtacaatagaaaatgttatcagtgctggttgtgcaatatatagtactggattagtactaaatgatggttcatattggtatgcaggtagaacgtttgtatcaggaacgacgacacaaaacttgctcacatttacacaagatacttcgattagtaatgcaattaaagcagtcaatacaaatgaaacttcttatatatttcttaatgatggtaatgttaaagttgcatctattaacgactatggacaagcaggtacaggaaataggtcagtagccccaatgagtacattaattccaaatttatcattccaaggagaagtggagttggtgggtgagcttgggacaaaccttaccggaccatcctgtataattaataataataataagttattttcatgtggccttaattcaaatggtcaatgtggtattggtacaactgatatgtatataacatcattcgctgaaatggatcttactgcattagaaggtagtaatcttagtagtttttgtaagagctattcttatacgatgttagttgacgaatataataatttatacacatgtggtgtacccaatcttactggaatgtcttcaactactgtaccaacaagggttcctgattcacttctaccgtggaaataatataatgccagtacactgtactggctttcttatttgtattaaatatagtataatgaataaaggagggaaatatgttaccttttgcaagaatgatgaattatgggaatattgcccctggtaaggataggcgttttaaaatatattcaagtgattctatgtatctccatgatacttatactaataagttgtatgcatcttctgcgacgaattggggtactggaacaggtgtagcatcgagtaaatttattctttgtgcagagaatgttaaacgagttctattggaagataacagtagtagttgtcaattgtatgaagagaaaggtactggaaaagtttttatcacgggtaacacgaaggcattcactggtgtaactgatacaaaaactttgtggacggactgtactacgtggataacatcaggtggtattaatgtttctgatataaaatacatgagtagttttaatgatatgaaggtgaatttgataacaaacgatggtacgttgtattgttgtggagttaacaataactcgaacctatcatcatttggtgatggtacaaacattaattcttttaacacattcaaaagggtagatactataacttcggttaaaaaggcagttggtaacatatacctaaaagaagataatactttatggggttgtggttttaactattactatcagttaggtacaggtaatcaaacttctattactggggtgacgatgatttcttcggatgttatagattttgatgtaagttatcaaagtacattttttattaaatcggataataatttgtacgcttgtggtaaacagttcggtgcacaatacgggaacgaatttggcacaggtggtacttcttcatccaccgatatacaatacaaaactccgacattattgagttcgggagtttatactctatatacgtgtgttagtaacatggcatcacatatagctaaaggtgatgaagttctatacgcatctgggtcgaatggatttggtcaattaggtgttggtaataatattaatcagtactcatatactccttcgtatacttcgtttaatagttcgtgtaatttggtacgcactccatctggttcacttatacttacggacactgagaaattatattattgtgggtatgctatggtagtaatggggggaattgctggacaaaacattcttagttatacagaagttgatatgtcatttatacaatgatttaatgccagtacactgtactggctttcttatttgtattaaatatagtataatgaataaaggaggaatttatgttaccttttgcaagaatgatgaattatgggaatattgccccagtaccacttcaaattaagaaaataatcccaactgatttagatgttgttgttctgtatacggatggtcaactatatgcacgtggggataatagttttgggaaatttggtaggggaaacaacactgcattaaaatcatggacattaattagagaaaacgttaacgattgctgggttacacaaggaactttattagtaaaagataatgactcaaattatttttattgtggatatggtgatcatgttggtttaccaactagtactactacgtttttaagttataaccaatatattgaaaatttgtacacgcaaagttcaagtacttcaattaaacagatgtatggaggtactacgtggtttacggtattaatggataataatacaatatggagtactggttggagtggggctagacaattcgctgatggtactggtagtactcaacaaataacagatggatcatttgtaaaagctgtcacgcctaatgttgatattgcacaaatacagtcaacaaataactgtgtaatgttttttgatacacaaaataatttatatattggtggtggtacgtcaggtataagtaccagtaccacatggacaccatttaatgaatatactttatataaaccaagtacaacatacacaaaaacgttacaatacactggatgctcaagtggtgcagtcagtgctttggttgagaatccaagttctggtgcacgtcagtttctagttggtggtttagcgagtaatggtgcatggggtaacaataccacaaccagttcggcacttgctgtattagggagcaatagtacgacattaccaactggaactttgtattcaattcatacaggatacccaacacaatctagtatactagttacgagtactggtgtatatgcaactggtttaaatgccagtagttatgctggttcattgggtattggtactagtgcaactgttggtaagtttactgcatgtccattgccgtcaggaataacatattctatgtatgataaaataaaaatatatcgcggttcgtatcgtactttcctaactgctgatatgaaaaatatatattcaaccggaacatatgatgatggtggtcctactacaaatagatatgtactggatacacctagacaattgtaataatttagccagtacaaagtactggctttcttatttgtattaaatatagtataatgaataaaggagggaattatgttaccttttggaagaatgattaagtacgggaatgaaattgaatataagccacatggtgaacaattaatcacgacaataggaacaacacaatttacagttcctgctggcgttaccgaaatatcagtatgtgttatttcgccgggtggtcaacgtggtgctggtggcggcttatcgtggcgtaataatattccggttactagtggtgagtacttaagtgtttctcttacgcataccaacactactacaccagttgaaaacggtttatatcgtggaactgaaaaactatgtgttagcttcactggtgcatatacggttggtggactaggtggaaaagctgctaacgctattaatgatggtggtggtaatggtggcaatactggtgtaagtggtggtgcagtcattggtggtggtgctggtggctacactggtaaaggtggtaacggagatgcaatcactggtgaaaatggtgctggcggcggcggtggtggtggtgcattctataatacctcgttcattggtacgggtggtggtactggtattattgttcaaggtgctaatggtattggcggtagatacgatggttcatataatggtggtgctggtagtggtggtgctggtaagatgtatggtggtggtggtagtatatgggataatttttcttatacggctgctggtggtggtgctgtgcgaataatatggggacgtgggagatattatcctaacaattcagtctaaaatataggccagtacttgatactggctttcttatttttattaaatatagtataatgaataaggagggaattatgttaccttttgcaagaatggttaagtacgggaatatagcaccagttccagtagttcctacaataaaagattttaagattggcttttcacatgaagtgttattggacagtgcaggtgatgcatggggtattggatacaatacagatgggcagttaggctttttggatgcaaataccaattcactaggtgcgtggtctaagatatatactgatgttcgattaattggagttactgctagatatacagtggtagttactaataataatagaatcctttacgcaggaaataacttaatttctagcactactactcttgggtggaccgatataactgccagtatgggtccggttgcggtggatagcatcgatgcattatattgcacagatggtatgatgcatattaaaacttcagatggttctttatatgcatatggtcgtaacatgaacgcaaacagtggtgttactggtggtgttattagtgttgcaactaaggttaatttgccttctgctgtaaatgacatgcgatatacgtttagttatggttcagtactatgtcgattggatacgacttctatatacgcatggggacgtaacacaaatggtgaattaggacagggtaatacaacagctatcgttacaccaaaactattgtctggtgcttctattgcaatgggtacttcgtataatgctactgcaattgtttctggttctgcatcgttagttacgtgtggtggtcagaacagtggtcagttgggtaatggtattactactgatggtaatgtttacgtatatgctgctagaacataccctggcgatcttaatactataagaagtccagtggattgtagtacaacgtacacctctgcatttatgagtccagatggtatatattacactggtgctaaccgaagcatgtttggtggtattagtggtgctgctaccgttggtgtatatactaaatgtagtgatttaccaataacatattctaatataattcagtggggtagtggtactattggtggtgctatatgtagtagtacagagttataccaatgtggcatcggtcgatacattgctggcgatggtgcgagcacaaccaggtatggatttaggaagacaccattaccttgggatgtttattgaaattatgccagtactttgtactggctttcttatttgtattaaatatagtataatgaataaaggagggaatatgttaccttttgcaagaatggttaagtacgggaatattgcacctgctcccagtgtagtgcgaaagattagtacttccattagtcacgttggtatgttattcgatagtggcaacttatatctacgtggaagaggtgcaaactatatgctaggaaatgatagcactgcgtttgtgcaaaatgggtgggtacagtgtccatataaagtttctaatgtttggtgtttcttggcagcaacaattatacttacgactgacggagaattttacttagctggtcaaatgaattatgtcggtgtatctgtatcaccagttcccgggtggactaatattacatctatattaagtaccataccatcacttagtacggtgattgatatagctgctacagaaactacggatagtaacggtgctatattaattttgttaagcaacggtgatttatatggtataggtcgtaatggtggtggtcaattaggtgttactggtacagtatcgacaccgattaagattgattctgatgttactatagtagctagtgcttctggtgctggatcattccactattcaaaaaataaccagtactacagatgtggtaataacgctaacagaaacttggggactgctgcttctagtcttagtaaatttactgtaagtacagatatatctggaagtgttatcggtatttcatgtacttcaacgacaacttcagtactaacatcatctggtggtaatattgtagtatataatgccgggacgaatactgattattgtttaggtattggtaatagcagtactagttttattatgagtccatttagtgatactcctgcaattagtgggattgtaccagatgctgcctcgatgaataatagaagtttgaactattttataatggcaatgacacaaaatggtaaactttatacatgtggtggtggagttcctcttgggtggcctgtaacgagtgctgctgaaagatcgtattatcacgaagtacaatatgaggatatggatattgcaccagatgttaatgcattttcagtacaaggtggttccggtgtgttatacgcattagtgggggcaaatgaggtgtactggtgtggtagtggttctatgttccaggaacagagttcaggtacacaacaagttaaaatgaagaaaatgattttaccagaataggagggaaatatatgttaccttttgcaagaatggttaattacgggaatattgcacctatatatgaatctagtgtaattaaaatgcaagcaccatcggcttttaccaacaacacattgatgattctgtataagaacggttatttgtggggtattggcggtaacaatgctggtatattcggtcttggaaatacaacgacacagaccaaatgggttcgcttaatgcaaaatgtgaaaaatttttggtgcacaaggaatgcttcatatagcttagttcagaccaatgataataaattttattatgcaggttggaacctttggactggtacatctagtgcagttcaaagtactacatttgttgattgtacgtcttatttttcaggttttaatgtggataatatcaaggagatatatccaaatgttcgtaatatgtttttactaacaaatgatagtgttctttacgcaataggtgataattcaacctatgagttgggtagtagttcatctacacttacatcatttacacaggttaatattaatgttaaaaaggttagttcatttttcaatagtccaacttggataattaaaaatgataattcagcatggagatgtggtaaaactagtactggtacattgttaactggttctgctactgatactttgacgagttggacaaagtatagttttcctacaggccagtaccccgttgatataatttcatataacaatatgttgggtatagttcttaatgtagataatacttatccgctatatggtgtagggtcacaaaattcacggacaattaggaaatggtgttctatctaatactaataagatatctttaacgccacaaagtacttatttacaattaactaatgtttccgattttgaatttatacaaacatattcacaaaatcctaggggattattatatagaaatggaagtcgtatttttggaacagggtataataattatggacagcttggtaacaattcatctaataatgcttcaattttcgtccaagcacaatttccaaattctgtagtttatgatccgtcaacatcgttggttgctgcgaatgacaatgcattatttgcatatgtgaatgggaaattatactacactggtatgtctccagtagggacagttgttggtacatggactttaactgaataccaattgccacaaatttaaggagaaaattatgttaccttttggaagaatgttaaagtacggaaatattaaaccaactcttcctgaaataaagaaattggatggtagtcaattacatgtcggattactttatagtacagggaatatgtacatgcgtggttctggttcgaactataaattaggtacaggggatgctagtgatgtattaggtggttgggtacatgtaccctatgaagttgatgatttttgggcgtgtgtatccggtacattaataaagactgttgataataaattatattgtgcaggtctatacatgggtggatattttggggctagtggttcatatgttaactggactgaagtaacttcattatttgtaggtattgacgtgtcgcaaataaagaatatagaatttacgtcagcgggtacttccggtagtacactaatattgatgttagatggtcgtttatatgggttcggtatgaacagtagatctgagttaggtgttaataacaaagttgtatctcccattctcatagatactgaggtaagtgcaataggagcacataagttagggggttcatcgttccattatataaaaggcggtaagtactacagatgtggaacatcggttggtagtaatattggaagttcttctttaactacttttacggtattgagtattcctgataacgttatatctatgcaaatattatatgacaacgtacagttattatgtttaggaagttctggatatagtatctatatggctggttctaatgattatggtggaagaggtgttggtggttctactgtttacactacattcaggaaaatagatcttacaggatttggtgttgttcccagtgaaatactatttgaaaatgccggaaatggttatgttaatatatcaactgatagtactggggtatatacatgtggtggtggggctggtgttaatggtttaggtagaccaactgatgtgataccaagttcacagttgggttcggttcagttcagtactggagtggaaccatcaaatataagtcgtgtgtattcacagagttcgagttctgttatatattgtatagttaataatgaattgtactgggctggtagtaattcatattttactgatcaaaccacaaatactggtacacaattttcatttattaaaatgaaggatatgccttctgcttagattttatgccagtgccttgtactggcatttttttgtcctaaatataataacgatttacatttggaggatacaatgctaccctttggaagaattatcacatcatcaaaaaagaacatacaaccttctgtaacaaaaatagcttcatctgatacaacagtttttgcccttatgtcagatggtacgttgtacagtagaggctctcaagagtttgggcaaatgggtataggtaatattataacacaaaccaaatgggttttgtgcaatacaaacgtagaagatctatgggttcgggtatgagtcaacattaattaaaaagaaagataatacgatgtggtatgctggaaatggtgcatcattcggtttatcaactgataagtcaacaacgtgggcttctgcaaagatagtgtttgatagaataacagcacttggaaaaacaataaaacaaattgcagttagtgcaggtgcattaagcgtattatgtacagacaacacgatatggaatacgggttatggtagttatggacaactgggaaatggtagaagtaccgattcactttcatcatttgtacaaggaacagtacctactggagtaacaccatccaaaatactggcaaattttcttatgcaaggatttattggaaccgatgggagattgtattatactggtgcaatatcaggcgtaggtacaaccgacatgacgttatattcaaagtacacgttatgttctcaaataactaatacctatacggtgaaagattatacaacaaactcaagttacttcgcttttgctatagcaagtaataatagtactaataaattatttgcatatcatggtggtggacaatactttggtcagttagcaaatggttctacatcacaaacatatatttcgttaagacaaacaacacaagcaccaggtgatataataagaagcagtgtgggttattcatatttttctaatcatattataacttcattaggtgtttacgcaactggttataacacaggcgataacgcaggtcaattaggtataggtacacaaacagatgtctcagcctataccaaatgtgtactaccaatagagatgaatatgaataacgtatatgttacagcaactttatacagaacttacttaaccgatggtatacaaatttacagtactggacaatatattacagacggtggagttgccagtactgtatttgtcaaagattcaccattttaggaatattgtacaaagtgtatgcggttattttagaactctttttaaattcatcgtaaagataattcaaaattttggaacattcaatatacttttcaatatctttatggattaatgagtactgaaacattaaatcagatgatatattgtaggtactaccttttaaactgtttaaaatatcacagatttcagggtttacgggtacttcgtcaaaattatcatctaaaacatttatttcaaaatcaaagccatctttgtttttgattaatttgataatagcatcaccataaacattatattgttttaatggatttactacaatgttaaaaagattggatgtattacaatcaatatccataaagtatgtattatcattatacttaatattgaaacatccgtactcaataaaatcaccaggagttattgatgagtttcttctcgtttcaacataagaagctttaattttgtttttatttaaaagagtaataaatttcttagactgtttagcacccgctaagtaagtattataacttggtcttttaaaaattataggactagacttctcaccagagaaatatttttttataaatttacgctgtttaacgaaataatttttataaaacaaacctaattttgttttcatcataactccttattaatccagtactatcaagtactggatttttattatgacatacgcttattatgaatggaattatgaatggattttaaataattatataattttatcaatccactaccagtagctacaaacagtagtgctgttggtatcatacatccaaacatggttattaattcatgtatttccataccatcactatttggtcccacatcaaatataacaaccaaaacaacacctaaaatgcttagacaataatatcccataaagaccataaaagtgatatatccggcacttgatttaatattacataacatattatacactggattaatacagaagaagtataataaccatgccagtgttccagtactgaacataataattgaaataatggaaaatatctcacggtaactcatattatttcctcatacccaaacgttggtggatttcagagatctttatatataatagtaccacaaggtgcagtactaaacaacatataattacggctaataccaatgaacatatcataagaccgaaggttattgtattcaaagaggatgtgaacagtccaattattaatacaataaaaccaaaattgaatactgtacccaacacagtatatgctggactatatctcttttggattacatcatatatatttgataatggtcgcttatggaagtacttcccaatgcacacgaatgcattcagtgagaagataaatgtatacgccattactagtaattgaccaacgaaagataattctatcccattcatactaacctcgtttacgttttttaattgtactgtgcatcttttcgaaatagggaaccaaaacatattgaacagtttgccagataaccattagattatgcactgcaccaccaaggataccaaacactagaacaataattgccataataggatcaccgtctaccataccccatttaaagatatgtaaaatccaagcaatgactagacaaaataaactaagccaatacgtaatgaaaaatccggcttgtaattcataatcatcagcaatttcatcgtataccgtttctaaaaatgatacacaaaagaatttaccaattataaccacagtactaataaacagcatagcagttaagataataagagcaatttccattacatccctcgtttacgcttttgattgcgtctaaattctgatagtccacggctaatcggcggcatcagactacataaaaaagtaacagttgttggtagtaacatcaagtcaatcattgcagtgttatctggtggatcaaaaaccaaaaaatacacacaagaaacactaataatggttgaaccgataaaaggaatacaaaattcttttatctgtttttcaacataatcaaacatcttgagtacaaataaaaatccaacccaacacataatgaaatagaatgaatacaacgtgtaaatcaatgttactatatccattagtacctcgcatcaggaactttagcacgtaacttatgaacgactgggaacaacaacaaacttacatatgcaatagttgaaccccaatagaatactaatacaattggttcaccattagaacggaaacctctactaatcattgagtagtgaataataggcataatcatcgccataccaaaccatgcgtgtaattttaattgcagcatgttatcagcgatgaatactgaaattggtcgtttaaagaaccacatcagaaagtagaatccagcactaataatatagtacatggtactaactttcatataccacggcagtaaatcaataaagtactccatcattcctccggtatcttatttcgaagttcaatcataacacaacaaattttaatggtcaatataaaagttaaacatatcatcccaagtgtgccgtaaactgcggaaaaagctggtagtacctttcctgtgagtgttgctacaatacatgcaatcaatgttgatgcaaacaacgattgattaatggcagaatttataaaatcttcaccattacgtttatagaattgtcgtttaaaataccatcctagaaacataactacccaaaatgatacataagttgttagaataatccctgcaagtgaatgtgcaactggactactccttaaaaactcaagataagcttcaaacattagaagtctccgcgaattttatctctaccatgaataatgagatggattaagtatacaactaaccaaatgaacaacccaaagaatacaatatattgtgagattgagttcaaatgaggattagcacaataaattaagtgtgccataagaccaacaattgcaaacaaaccttgaactagtgtgtaaagaactagtgatgaattccttactggatacagtttaaaaacaattttctttttaaaataccacagtactacaaccagtgcatgataaaagaaaaaaccaaacagataaatcaaagtaatactaatcattgtatctgaattaaaaaactcaagcatatcgtatctccggtggtgaatattaagttatagtactacactatggtagtactgtcaatatggaattaaattttctcaaggaacaagttttcgcactgctcttcccaatcgtatgggttgttgttatatactgccgaaatcaacagtggcatacgcagtgaaggtgaacgaagagaatcttcgtgcttcaacatccagttcagaattgctttactaccattacggttaatacccttagattctaaaatgttagtctgattcatcacgttctcaatgtgaatcatgatatcgcttttggtctgaatctgtaagtcaacgtatacagaacgagacataagagcagcatagtgagcagacattttcgttttagctttagcatctaatgctaaatctttgttagtgatgaatacgatacgaccgttaaaatcaaagctgttagggataccgttagtggttaagtacttagagctagtcatgtaagacacagtacgtttaccgctgtccagtactgctttgagcaggttcataccgtcttctgaatcaaagatgctgtccatatcatccagtactaatacgttggtgctatgacgattcttgtacagaacttcgtacagagccagagtagtcattttaccactgatggtagctacgttccattctgctgcgtcatgagctttctggaggcgtttagacagggtgtaagtcttaccaacaccaggagcaccactgacaaccatactttttacagtactgctatcatcgagcaaacactcaagagcaaccatcatggagttgaagtttttctggatttgaatgctacgtgcttctctggtcatttcgttatcctcatcagttgatgaaataattataacaaaaagggctgaccgaagtcaacccttttgtttagttttttttcaccccaccccatttttcatagattgcaataattttatctatgttgtttggtgtagtagtttcagtataaccatctggcatttcttgtttagttaaaacgcctttaccaaatagttttttacattctttttcagcttccttacactcaaacacagatgtgaaaaaatacgtatgtaacgattcaattttaaataatgattttttattttgctgcataaccctcttacctttctgcttttcaataccatatttcaatgctacagataaatcaccatccaaaatattatgaatatatgcatattgctgagaatgaccagccgcaagtggatgaccagacccacaaaggtgacttgctggagtttgccaaaagtctccatacactggatgagttattaatactttcgttgaagaatttacataatcaactttatcataattatataagttattatgaacttcatttgctttaattttaaattcatcacatgtataaggaacaccacctttgactttcgggtgtcctttacctgccaaatgcccatttggagtttgccaaaagtctccatacactggatgagttattaatactttcgttgaagaatttacataatcaactttatcataattatataagttattatgaacttcatttgctttaattttaaattgagttagattttttattttaaagttagctgtatcatatttcaaactgttttttaaatgtgttaagtgattttgtggtgtacttttgaattctccgtaaattttatgaactatagttacaggtgtactttgatttatatagtttactctatcatagatatattctccacttgatttgaactccaagcacttttctataaatgttttagtatctatatttttacagtttccacaagtttttaaatttctgttcattataacgtccacagatatatcgtattcacacccacatgatttataacatactttaattttcttttttgtaccaacatcatcaggtattaggattggtgtaataagttgattgttaggtgaacatttgtaaaaataatataaaaaattattttttgtataatgtggtctatgtactatattattattgatcaaatatgatgctctggaaatacgatataatactccttcgtgttccgttattacaggagttttttcatttttccattcactaagagatgatattgcatatccaataatatttttaccaaccgacaatgctttttctttcattttttcggcaagaccgtaaccatgttttttcatttccaatggtgaaatccacgagaatgcaacatcatccccaaatataaaatgggaaattgtaacacaatcatcatcagtagtcatggatgtatattcattgttatcttcgatttctgatattaattcagatttacatttagaacaattacaaccgatttcatcacccagtgtagaaatagtaagcgtttttttagttccatttttacaaatatatggtatttttgttgaattatttttataaacttcaacttcaccactaactgtatcaattatgccaccataagtactaatccaagaattaattctttccctaacaattaaaatatctaaacttttagcatgaccattataccagtcttcacattcaggacaaccaaattttttagatgggtgtgtgaggtttgcgtgatccataagatatacttgtgatatgcctgatttgtgttttaatacatcattgcaaactacttggatgttttttaatttggcattttcatacttactataatcagcttcaattggaacgttatgttctaatactttattgttgaatttttcttttgcttgtttaggggttaatttagctggcattacttaaaactcctttccagtactgaacccgtccagcaccattaatcttagcctgaatcttatctttttcgacaagaccttctttgtaatcgatggaagtattatcacacttaattacatccaagtcaagtacttcttgtgtacttaatgaagtattgtctgcaatttgttgtaatgtaattatatcagtaccgaagaattctgctaaacgtataaaagatagtttcatgtattacctctcgtttcgataaaataattatagcaaaaagggctgaccgaagtcaaccctttatgttattctaactcactcattgtggcgatagttaatcccatttcttctgcaatgttgcatagcaaaccaactgcattacgaagaatatcagtgttgtccaccgagaatgatgagttttcatttacagttgaagactcaatgtagtactcaaaataacgagaagttgaacgcacaactttaacaccttcatacttctgtagttcagagttgatacgctcgattagtgaatcttccagtactcgatagtcaccattcattccacgtttccatccatcagcaggacggaaataaaaagtttttgtacgttgaattgttgagattgttagtgggttgtattctgcgatttcacttaaagatgccatgttgtattcctcattttctttgttacatgatactgaaagataaaactggtgttaatgttttttttagatcatagaacgataatactcaggtaactcaacatcagtaaatttataccacgtaggcttcatctggagcttctcaatcaaacgttcacgagacattttaatctctgactccgttggtatgtagtcattacaaaactcagcagggaagccgctaatgtcgtttacttcagtgttttgaatcttcataccacgacgcagacattcgttgacaatatcaatatgacgcttctgtaagtacagtaacttgtcgtagaaaaatgttacatgacctgaacctaacagataagtactgttaattttgaaatcacgtacacgcttacgtgcttgaacgtgtttttgtacagcaccaaatacacgtgggagttcacgatattcagccatcagatgttggtcagcaagttctttaacgtgtactaagttaatgcgtgtcatgtattcatcctctcgtttcgatgaaatgattatagcaaaaagggccgactgaagtcaaccctttttttttctttcaatcaaacatagtctaccagaatgtaccatgcgatggtgattagaacaaagaatcatacacttcttcattgtttaatccatttattcaacaatccccaacttcacaatctcatacccgtccagatagccgtaggaacactcaggtgtttcataagatgaaccatcatggatgccttggcattgacttttggaattctcaagcaatcgttgcagtactgatacgtcatcaagaacgtaatacaagttagcatataggtcagttacaatacagtactccaacatatcaaatgtatcaatcgaaatttcaaccttagcaaatcgtttcttttctttattatacagtgcgtacatattaatctccataatcaagtttaaccaacttaccacacagatacccaaagttttctggcttcgcatctgaatagaagaagtcagtacttaactctgaattcaatgctaaagcacacaactccacccaaaataaacccctatgttgtactggcttacaacgtttctgtacagttactagtccagtacatgatgaccacaaagtaggacagataccagtatcactacgcttggagtactgcatccacgaacgttcattgaggttagctatcatccctgttaagaatagcttccaacttttaaaggttggaatcttgatagcgtattccccaatgaggataacagttcgggttgcacctttcaaatctatattcatattttttaattagaagaacacaaaccaagtccagaataaattccacactacaaataaagacatagtggttttatgtacaatatcagcagtactggtccatcctccaccgtgtcctattccatttatgtatagaactaagaacaagataccatttactacaatagtacatagtaagtacacaaacacattccatgcaagttcaggggatactaacgtaaatggtaaaacaattagtagtattagaactaataaaattttcatttatcgcctcacttaattaacgtgacaattagtacgaatcagattcccagtactcgattgcttctttcagcaattctttagcacgttgttttgcaatgcgagcgggtaacagatatgtgtacattaactgacgcttcacttcattcagtgaaagctgttcatggtacagtgcatccatcagtcgattacgagtacgtagtttcatataagttatccttatttcaaagaatcatagtaagcagtgtcaaagattggagtcataataacatagtcaatacggtcaatgtaagttgaactccacatttctggtttgtcataaaattgacgttcgcgttcattcatacgagtcagtacttcttccaatttactacgtgaagccatcaatgtattacgcgatccataagtgaagtactcagtccattgatattcatattcagtactgatagattgaatagtaccatctttgaaatgagctaatgcataacctttctctacaaagttatcaggtggaagaacaccatctggattagttttcaatgctttttctaacttttctttaatttcagttaacgtgcatactgaacgaatgttcttcaggtttgatacttgaaaatcactgtactttccaaagaaaaatacacgccaatctttaggttcattatcagatacggtaacatcaggatgatgggcgagtaaacgaagaaggccagctttgtgaccgttaatgtagatttcatggatgtggttagcagttttcttaaaagtaatcatggtagttcctcgattgtagggatgagaagttcatccccttgataagcattatacagtactgaatgtgtttgtcaactcaaaataaattcatttcatgtgcgtattgtggttcaagataagataagtttttgaaactgtctttcaattccgcatcatctacgtacacagtaccaggtacattccccatagtgaagccaacccaaacagtcatgtttccagttcctaagcggggcattgatagcgtcccgtcaggtgaaacatcaaacgctacactaaagtcatccgttacaacttccgacccattttccagaataatacaaccacgttctttaagcttctgaatgtggatagcagcctctacagcacgtttaaagttataataagactctttatcctcgaacattgattgtttaaccagacgcttgtttagctcggttactttgtgcatttgacgcattacttcaactcccacagttgtagaatttcataagagcctggtggtgctggattgataatctcagggtattcagtactgttaggattaccaccagcattgaactcagcaagtaataattcgagttcattcctatcatgtacaacaaacacgcaatatccagttccttcttcaagaactgtagttgatcccgcacaatcccatacggcatcaatacataataattctttagtgtttttattacgcaacgcaaacatatatgtctcctatcgattcggcatattctttcgtagtcgcaagagaaattcaaccactgaccatgttgtaatgaaggctatataagttgcaaggaatccagtaagaataaatgcaaccagcgtactaccatttggggaatcagttttaatgccgatgacaccatcggctacagtgaaacatgtagccattaatgtgtaacctacgtacaacacaaagaaaaactcattctccattgaaggatagaaacggttaaacactttataaaatttaaagtacagtaggattataccaacaaaggcatagaatgtaaacagtgttgttataatatatgagattaggttcaaattatacatatcaacgctccggtagattatcacgtaatgttttaattcgatgatacattttcataccaatattaccaaagataccatatccaagtactaaaatgtatgcaataagcatagtaataattactatagtgccaaaactataatgtacactactgatacccattgtagtttcaacgattatttgagaaactgaaagaatcaaaagtacaactacaattggatgatttgggtacattcggttgaacaacgttttgtacttaaagaagcacagtactccaccgaataagaagtaaacaatgtaaatgcaagcaacagcataggcaaacatgttagtgtaataaatcattaccaatccttacttttcagggatattagaacgccatatatcaatgcgatgaactagtccaaagaacaaccatactggaacggcagctatcataacaacaaatgaaaacccagtcaagaccgataccagatttaattcatcagtactatacccacatatcagtacttctaatattccccacgtacatgcacaaaacatcaagaatgaaattggggcatcatagtagatacgttcatataaagtagtgtatcggaagaatgcaataatgtagcaaaacatataatacacccaaaccaaagatactacataaaatgatactttgtttattaattcaaaatattgttccatttttaccccaatatatattcagagagtaatgtattagcttcatctttgttcttaaggtaatacatgtaatatagattcggttcaccatctttagaactcaaatcgaagtactttaaactatgtactttcatagtaaaaacaaataatgacttaaaaccaatctcaccgtacttaataaacagttcatccaaatgaatgtaactttttgatttggataattctttaacgtctgcatcaatttcagataaaagatgcttacctattaagttttcaaatgaacgcatgattttatcctttaccgcaatttttatggtttattaagaatacaccagaacatcagttctgtcaataaaaaactggatcttcttcagtaactggtatttctctacgtacatcacacgaaagaggatcagtaatgaatacattgccatctttatccatcatgacattactggaatgaatgtctggtacaaaacgcccgtgaaactctttcatgatgttagcagcgaccgttgcaatagcaatctcttcagaattaccacgcatatcattcactgaagtagcgtactgaccagcatgtgcataagaatataaatctccaattttagtactaacaaagtcatcataattatttttttgtttaattataggatagtacttgtccatctcataccatccaaagtttccttgttcatttgcactgtagatcactggaagaaacttggttcctgcgttttcaatgcagtactttgcataagcacgaaaaccatcccagcgtgaagtggttactttaaatgcacgtccaggatagtttttatgttcaactactacagagtacatccccattccaagaaaagtaagtccagcagctttaacttgtggaaagattacgcgttcagcataaggaatatcaaactccatcgcacaacgagtttttgatggacgcaaaatgtcaattaaagttttgaatatgtcttgcttagtcattactttatcctctgtagttaataccaacatcataacaaaaaaggctgaccgaagtcaacccttttattatcatttacagttttctataactattgcacgttttagtattttactttcataaacatacttaagatgaccttcttcacgaatacgattgaacacatatcctagtttatcttttagtactgaagcggtatcaatgtcaagattaacttcaacccctcctgttaatttaactttatatgtaaagctaaaagcatcaccagattcaaccaatgggactacttgttcatacgtattcaacataactcgttcatcattaactaaattatatattactatatcacaagtttttaccccaatttcctctaatgtaggagcattatctactataacatcttttactgtatttgcaacctgtttagcatctgctgcatatacattaaaactaaaaagtactaaaataatacttaaaaaaatctttttcattatatatccttattttattttacatgtcatatcgggttgtgctggtttattatttttaaacggattaggttttttatctttctttttatcttttaaaggttttttgtcttcttttttatctttatctttgtcttttttatttttatcaggttcagagggagtattacattgtactgggggttgattagttggagtacagctattgtctgatgggagtattacttctttacaattgtaaaatagtaaacttttatttgtggttaaattatgaaaacgatagttacgttcattattataataaattgttttagtactttcaatgtcattacacattgctactgaatcaccggaactctttttctattcccattacatcagtcttacgctcagatagtatacctgaagtatatgaatctttgttgtcaaacgcattaaatccaatagttctgtcggtgtcgtgtattattccttttgtgtatgaggtagtatagaactccccatttctgaaatcctgccttgctacggagcaatgataatctgcaccataagcagtactggaaaataatacaattccaaatataatatattttttcattgtaatccctcttcttaattcctcttttgtatttacaaaaaaaggctgaccgaagtcaaccttttgttttatcatttaccgtatttgctcatgatgtccttttcccaaggagttacatttccattttcgtaatcacggaaagagtcatcaagtgtagtcaatgcataatcatatgcctcaccggattcaacatcaatatcaacagcaccattcactacatcagtccacgctttttgtagtttacgagcgttgttaccaactttatctttaatccaactaagatttcggtttatactcttcttatcagcaccagctttttcaccaacatctgcaacccattgcattaatttctgtagttcgttatgggatttttcagtcatttggcggtcttgtgacagttcagcttccatgtcatcaatttcttcgtctgaatgaacatcgttctgttctactgcaccttcttcatcatcacgcatcagataaccatctcgtgtaaccttctcaccatgatcagcttcatactttttcatagtattgaatgcagcatccattgcagttacaaaacgactcttttcaccttgtacataagatttaagtgcatcgttaactgcatcagatactaatttaatcttatcgtctttaccttccagacggttttctaacttagctagtacattcttaactttttgagcattagcacggtcttctttaccaatactatcaaatgttttaagtacgctttcaagacttacttcctcttgtgcaggcacatcaccttgttgcgtaccttcaagtgcacgcattatagtactgaatacttcagttggttcagtactggtatttccactcattgcatcaagcacagcttgtgctttgacttttaattcttctttaggtacagattgcaattctttcacaataccttggataagttgtggtttattagcaaaaatcttacctaacttatccgacagttctttgacagggttaaccgcctttggtgcttcttgttttggttcttctttagcaggagcagatttttctttttcttcacgttccatatcagctaggcgttgtttttgtgtagcattaagaagtcccaatgaattaacataacgtagcttttctagctcagtcatgttctcagtactcttaacttcacctgcttctgcgtttgctttaccagctagaccagttccttggttacgtgatccacgtgaaccttgacctgcttgataactatttggacggcggttgcgttcactccatttatcagagtgaccagccatgttaccaccatttttatcagtaaaattacttggcatttgatttctctccatagatttcattttttctctatgtctatatttatagtataaagaaaaggctgaccgaagtcaaccttattttgttacttagattgttcttgtgcaggtggatttactttttgatccactacatagaatacaccaccaaccagtactgcggcgatgagtgcagcaactacaaatttcaaaccttgcatgtatgatacctcagttatattgagaatttatgatacaacaaagggctgaccttagtcaacccctttttattacttcttgaacttatgtttttcactttcgattgcattcacgatttcatcatgaattttacgaagattgtgagttttctttagagattcatgtaatgcacggaatgcagagtgtacagttgctttaaagtgctctttaggagttactttaagtttctcgataatatcacgtacatagattgggtgatcctcaaacacacgattaagctcatgacctagtgattctaggctaaatgctttttcacgggatggacgatcatgtgcaagactttggtctggttttagaagacctagtgaatctagatacttgtgcttatgtgcattgtctagaccagaaatatcaacatcatgtgatggatctttcttattccatttatcaaccatttttataactcctataagagataaattttactataatatttatagttccgttgtcatttatatcgaatgacataaaacattatatcataataagaatggttgtcccaaagttaaattagtactgatcaagttcagatgtaaaaatgaatgcatccatgtcttccaacgtaagttttaagtctggtacatacttaagaataacgcactctggcttcttaatagcagcttgataagcagcaatggcaagggattccaattgctgtgctgtataatttttacgttctgcattaaaaactttgtttttgatatcaccacctgggagtttttcaaactcacgcataactgcggtaagaacatcgtcagcagtgttactatatacccattggggtaattgcattacattataaatcacaccactatcatccatcaaagagatccatttgtacccatcactagcactgaacaaacgcccttttagtactgtgttattagttaaatttacaaatgcaaaaatatcttgttcgttaagttcaatactattaacatttacccaactcattacgattccccattcataaatcacgaacaatattcattaaacacaatttaggttttatagcattcaacacccatatgcattctttgtaagtagctattatatcatctaaatgctcagttacaatgctttcttgaaaatattcttcatcattgagctttgctaatttagtaacatcacacgtaggcactataggtctggattgtacacccattccattattgatattagtgaaatgtacaaaatggtacttcacaacacctttatctagatttattatacatgacaaattttccaactcagttagttttttattacaagtaacattaatgaaaccagcattataggctctataatcatctactgatatctcaaaatcattacgttcaaatataagtgaaatgagttggtccagtggtttgacattcatatattttaatgaatttacgtatgatacttcaatcttagatgaaattatctttttactaagtgcagttaaatctttgttagatttaactgttaaaacaataggtttaaacctagaacttttgttcttttttgatactttaaaacgacctttacgattcataatttcctcaattaataatttcacatttaacgtgtggtttatatagcataattaacccatttttaagtacaatgattgttgctctgttagtaatcgaaacgtttttaattatactttttttatatgtttcaacatatttctcttcataatttatacatttaacatattctttttgtttagcacttacaacagtactgaataatatcagtacaagtactatatatttcattactataccttataaacaaaaaggaattcatttaagaattccttttttacaatcatttatctaacataccattgtgcaaacgttcatatacttcagttcgacgcaaattcacaatatcttctgcgtattttaatgtaaatgcccatgcttttggatgtacgttaagcttcatacgaattcgatttttcatcaactctccacttaaacgaataaattcgtgtacaccacgactaccgtattcagtaattaaatcattaatgtacatatcacgaagagtttcatctgcacattctttaaccatttctacgtcagcgacgatgctttcattaactgaagtactgatcatttttaatttaccttatttaaattcgactgtaattttatcaccttcaactacgaacttacagttgtagcgacgtgccatatccatgtacatatgctcagagtaccaaggaacatcaataatcggatgctctgcatattgtagaacttcacggtcgcccactgtagtaatgatgaaaggaatgttcatctctcgtaaaaacagttcagcaccaggagaacgattaataaattcagtatcattacgtaaagtaaatccattatattgtaatttaagcttcatatgttatcctctattcaataccattctttaaaaccattaagttcggctacgtgagtgattataacacatataacattcaggtcaagtataatttgatcataatttaattttatacgatcatcattatatgctctaaaaactacatcgtaatcaaagaaatttgcgttttcatcattcattgaaacgattcggtatctacgtcttccatctgtattgaatatagttaaacactgttgaaactttctcattaactgtttagataggatattataatattcaatatctttttgtgaattacgtgggtcatcaggaaaatagaatgaaacaaatttctttaattctatttgagttttatccatatattacctcatgtgtttctcttttactttgtcggaactcatcctttgcttccttaactgacatgatacgaactaatttagcactaccgcaatagtactgaacctgattacgaccaatgtctacatggtggtctggaacttcatatacagatatagcaaacccagcacgatgcaatttacccaagtccatagtgaagaatctgaacaaatctttcaaactttgacagccaaatacccagccacgtttgattgaatagattccatcttcagttggttctggttggaattgagaaggtgtagtcatgagcaaacggtcaaatccatttttagtactgtatcgtgaagagtaccgtgcgaacggccctactgtttttgctggatctaagttaggttcaatataactgaatttaagttcaaaacgatatacgtacataattataatccccagtagttgatgaaataattataacaaaaaaggttgaccgaagtcaacctttattttgaagttcttgaactaattgtcgtacttctttgatgtcacgacactgctttacagtgaagtaatcatacttacgaccataggttcttgggtcatcaccttccatatactgctgcacatcaaagatttgtaagtagggatgctgcataacacgaatattatcactttgataaatcaacataatatcaatccttatatttacacaagccaccaaaactagtttctttagcaccacgacgcatcataactaatttagcatattgtgtgccattactatcttcatatacatctacttcaataaacgctaagaagttagggtctgtgtcgttagaaaactcagtgaagctaatgtcgcctactgtatgctctttaacaaacgtatatgattgtccatcaatatatacaatatctcgattgtcactatcaccttgatagatatgtttaatattaccatctgtacaaactaaaccttccaatggttcagcatatgtcaatccacacattaacatacatacaaaaaataaaataattttcatgattattttcctccaacgttaagtgatttcttgtactgatattctttataagtactataccatatatcaccaacgtaaatcaagtaccacgtagcaggataaagagccaatccagtactgatatatacgaacttttggtcaaggacatcaaatacatacagaaggaaagttactcccataatgcaagaacaaattaaccacaagttataagcaatcgaatcgcaagcaaaaatagaatcaagcttagaaattaggacatatttgtttgttaaaatgaaatgaattactgcaactaaacaatatcctgccataaaaatagaaattaaaaaagacagaataattggaatattcaacaacaaaagtaaaatagtgtttaccattttttaagtcctatatttcacagtgtaagttcaatttatctatatctaggtcacggcgtaccgatgagtccaagtaaattactatatagatatcaccattaccagttcttgggtctacaattaatattacgtttgctaatgtaccagaatcatctctataagtcgagatttttttattaccgataatactttctactttaaaacgataaatcacaccatcaacaactatatttttaccatttctagggtcgttagtcaatacatgccacgttcccttagtactacgacaatatgtttctgctgctgcaccataactaaaacatgaaaataatgcacacacaagtgctattaattttatataactcttcataacaaacctctaacgagaaatacttctgtactatatatatgtacagaagtatttaatactatagagatattttcactgttacatcttattcgtgaacttgaatttgataatatcaatccaaattttaacatttcctgcaaatagtgctttgattagccacataattgcaacaaagttctcaactaaatccaaagttttaactactgcaccgagtgggaagataaaactcaaaatccatacaattactgaaaccacaacgactgcatagaaaatacgcacaatcggtgaatcaagcataaacaactcagagaactcttttttatcattatcatcagtaatgaagcattcgtaaaccagaagccaaatcagaattaaagacggaattgaaattagtactgatagcatattttttacctcaagtttaagtgttaagtttcagactacaggaaccattatacagtactacgaacgtttgtcaacatttgtttcttcaataagcataagataacttaacacgaagagtaataccgaaataatatcaataactgtaaagctcactggaatgataatagacaccagtactaatgccacgtttagcaagaatacagtagtgagatctaccatcgttcgcctagtggctaatgccactagtgtaggatagaacataaacaatagtgcaacaacaaaacttagtactagatacatttctttttcaccttaataaaattataacacaaaaccacatcaacatctggctcatcatacaagtactcaaaacgttctttacttcgtttagtaccgatatactcaccattcttatgccaacgccatccaccatcctttggttgttcagacttcagtactgggtgatagcacaggacaatttcttctggaccttcaattaggttcttgtacttattcataatctgttcaagcgtatctgctacaccataagatggatgcataagataagactcaggacgtggacgtccacttggtagaatatcatcagtactattaaagatagcacggaagtcttcagatgtgtatagacttccatcttcatggatcattgggtattcatccacgacatcgtaatcagtgaaatgttcaattgcatgtgcaggtcgataacctgcaaggatacctgcatgtttagtctggacaatagtcataacagatgtattgttgtttacatttggatcatgaatttcagcccaaaacggatgatttggatcaaaagttgcatttaccaatgtacactcaccaatgtagtcaaacatagtttccttgaagtttaaagaaactccacgtaatgcccagtcaggtgaagtgatgaaattaagattaactaacataagtatcctcagatgcaatttttttgatgtggttattgtatcaaagatgtatcgatttgtgcaacatttattgtaactatttcgtacatatagtcaggtgcattgaactcagcataccactcaatgatctcacaagcagcatcaacttggttgttcgcattaacacgtcttgcataggtactagacattttatatctaccatttacatacacgttatatacaccatgacaccaccacatcttagtcatttatactaggccatactttgtattgtaagttctggtattgaaatttaccaatttcatttttcttacggaatgattcatctacttgaatttccgcatcgtactgaccatcagcctgtacaacgtacttaaattcttctacgtgtgaaaaacgttgaccttcaccttctggtttatagacttgtactaaaccttcaactagatataaattcatttatcattcctcatcactttcagttagtataatgctatgtacagtttccacatagcggtgtgttttgggtgtgttatactttgtaatttcatcaaacaatttaaacagtgcatccacttcactaagagcacgaatgaatacatccatctttgtgacaactctggaataacctcgtatgttattaaattcagagacgtgttcatacacaacatagtatctattcatatattaaaaagttccatgaattcattgaataaagaagttctaatacacataacaaattcaaaatcaacatcgatggtgtcaagtagtttgaataactttggcactaatggatcattaacctcaaagttatgaatcaaactttgttgaaacacattttcttcagtactataatcaataacaaaatattcagcaataccaggtggtgtgtaaacatcatataaaatatggcggtgatgatttgttttagaactaggggaatatataagttctatttcataagatttatcagcactgcgtgcgtaacaaacaatatcagtactcgttatttctgaaccatcacttctctctgaaaaacaaacatcagcatagcgttttccagagagattcaaaaggtcatgagttgttttaccataacagaaatcagtttcaatgcgtatcacatcttgatattcaattggtcttgtatcgcggcgttcacgattaaacactaatttcaacaactcattaatatccattatttcgcctcgataaccttaaggttaacaaaatcaccttttactttcatgcatttgaattcagtgcgagtttcatccccactatcgcgaggccaatgagtggcagagtagcactggtctggtgttttatatacaccttcaccaatagtacgagtgatttcaccattggtgagaactactgcgaggtataaagtaaacatgatattcgccttagaataatttattaataataatagcacccaacgcaagaactgcaataattacagatacccacattactgcattcactgtaccagtaagttctttatcaaactccctgcacttcttgcggtaatcttcccactctttgttattcacactgccactcctaataggtcggtagctttcttgagtactacgtcaatggtttccagtactgcacctttgtgttcaattgatacaatattattataagtatcaaggtccaagtactccatatattcagttttgaatacacgaacatcagtactagtgattttaatatcacaacctttatcccaaataacctgcatcatttcattggtagtcattattcaaccttatcataaacaagtttgtgtgtgcttagtactttgttgtgatgtccagggcattcatatacatacaatcgctcctgtcgtttttcccaaccaccacagatacgacctgattgtgtacatatttcatactcgttaataaaagacttacctgtgaatgtacaatcctgacgaactaagtcttttgcactaaacctgccgtcatcattacatgctgtaagaaacattgtactgcacacaatgattccagtcaagagttttttaatcatttaacatcaccccaacggaatccattcatataattcaaattcacctcaacgagttcatttgtttttgtacaccaaattgatagagtttttgtaacatcaccaggtgaactttcatacttcacacaatacccttcaatgcgaagagttttgttagtccaatgttgccactcaatccaaatttcattaggataataaaccatatcttccttgaacctatggtattgatccatcggtaagtgaccttcaacttcaattacttcagcacttcgaacaagtttgtcaagcttgtactttatctcagcaagatattcttcatcattcagacgagttaataaatctgctgcacgtgttgtatcaaggctcattgttattctccatgaattacggaagtgttgattcgtgttttaccgctagtgtatccagtacttgtatttgcattaggacagtacacagtgtataaagtcgcaccagcaccatcttgttgcatacgataaatcttacaccctgcttcttttaattcagcaggtagaacaaaatcacttgtacgttctttggtagaagcatcacatgcagtgagtagaaatgcaacgagtactgctacaatgtatttcattaacgaacctccacttcttgagaaagagcatgagtcagtgcatttgaattcgaaccattcatttcacgctgacatacaaacataatggcatcttgtactgaacctgcgatttcatactcacgaccttctggatcagttaccagatgttcaacgatacaaccacctctcagtacagaagcaccagtacttacactaatcctgtaacctaaaaaatcaaactgcatacatgcgtcagtaggtttcatccaataaccgctgttttgattcaaatcgatgattacaaaaccttgagtgttagtttgaaacatagttaattcctcatttaatttaaaagggcgggaacgcagtgacgagtacgattatgctgtctttcctttcactgcattcccttttatataaaacataatactgctattattcagtactgtcaatcgatataagtaccttttttaacatcacagacttcttccatccaatgtggattttcgtttttatcagtgaagatttgttctgcttcttcttttgtttcagctaggacaatacgatccccttcatccaaatcacggatacgatacactttcagttcttgtttcttctcaagaatattacacagttcacgtgctttttcttcatcgcacttcccttcattagcataaaaccaaattgcttttttaataaggtcacgttcttctttagaaaaagacataatatttcctatcatttgttaaagtggatttcgtttgatataaacattatacagtactgatatcttatgtcaagtattaatcaccaaaaatcatcagatacccaaaccaacccacacagacgactaagctaacaataccaaagacaatctctaaagtcatgttacatccttaatcaatgattttatattcacgatgaccatagaagccagcttcaaggatgcgattaccatcagcatcttccaagtcccagccacgggatgtttcggcaataatagtcatgatgtgacctcttgggaaaatcccactcagagtggatacatcctcaagtaattgaactttcttaccaacattggaattcggtttaaacattttatttcccttattcgttgattacatcaagtactttatccagctttttaccaatgctttcctttggtttctcaccattctggaatacattagtactgcaatactcaggacgcgtattaggaaacttctcgttcatccaggagtgaccgtaaacacccagcatgatgccaacgataagaatgataatttgcatgataatttcctctgattaaatgttagtagtatagtacttgatttcgttttgaattgcaagttctatttgtttattgaaaagaattccaaactctttgattgattcacaatcgaattcaatagaaaaagtatactctggtacacgtacattgtcaatacccaaatactcttttatgtaaattttaatgagttcacatagtgcagtactaagacattgaatttcaaaatgttttgcacctttgtcaaaatacttgaatgcatcaatatcacctacaataaaactattctttaatgtagtgaataggttctcaggaaacacggtaataggtgacattgatttaagaatgtatgtatctttggcattcttaatgtactcaatgaagcagtagttaacgtcaggctcgattgaacgatccgcgttatgataccagtgtttaaactcactgtattcagcaaacttatgctggcgtaatgcgttacaatcttcacacagtgcagtcatgttctctttatcattaccgccctgaagacagtccagtacattatggtctaacgtcatgcgtacaaggcgtttccctttaagtacataaggtctgaatttataacgatctttagtactgtgcttgtgtaaagtgaatactacattagattcaccgcaacaatcacatttaaagccatcacgtgacattacatgaatgagttttcgagtatttggaccaaactctgatttggtaatgttacctacaatttctgatggttggtaatattttgaattccgtcgaatcagttcatctatagtgctcattttacattaatccttctatgctacaaccaataagtacttttttcacttcaataactcgtaccaaatagaatccatttgaaaagttaaaactatacatttgtactaaggcatctgcttcagatttcgcacggatacatgatagataaatttcacgtatatcaccatccaacgatacttgtttctctgcattgatgacaatagaacgaatctcaaaacgaatgccataactcattgagtttgtcctacaataagctttgtgttagtattactattgtaacaccacatttgttctttactaactgtaatccaaatatctttgtttacttgttcgtatgtactatcacgtactgctatgcattgattcatggaattcattggggttatttgtacaccggaattaacagagaaagcgactactaaaaagattactgaattcatttgatattccttaatggttaatcatccatctcttcgagatgtctgttcgcttctaatactacgtattctacgcgaatgattaataactgtcaaggacttttaatattgacgggatttgaggaagggatttttcttcccccccccacaaggagggaaatttgacgctgatggtatcagagctattgcattgaagattactcataaagagtgcgaaagcgggtcatcctgtttctctctacttcagtttcatatgacggtctacacttttaaacatagtgtatcttcattaagtatctatgcaatcaaatacttaatgtgagtactcaaattttggacgcaactttcctgtacaaaattcgataactctcccttagataattcgtaaggtgttatccttatatgtctatcaaggaaccaccagctatcctaacgtggttctttatacagccgcattgccgtgaggggttcaaactatgcccacatctaacgggtttcttttgctgttcgcactgtcggactgctcaactgccctctacgttttcgagtggatcaggtacatgaatatcatgccaacagaattgtacaagataattatatcacaaacttttacttcatcccataaaaaaaggttggcataagccaacccttgttctttagaaatcttcgtattcgtacccttttgcaagtactaacttcttaagcttttgcatagcttcactgtactttcgatgtattgatgaacgggatttaacatattttccattatcatcaacaaaaccattatcagcaatctcacgaagcgtttcaggttcatattcacctagaccatgaacacgctggataatctcacgttctttagtactcaattcgttggtcagttcattgatagcataacgcaaaggtgcacggatactatcaacattgaggttaaaatcagaagcaggtgaatgaataatgtcacctaatgtaccatctgtaacaccgtctaatggtgcatccagcgaagtgtattcgctttgaaataacaaacaattattaacatgctgaatctcaatcccagtaccctctgagattatttcaggagttgggcgaacaccatgtttacgcatatattcctgacagaatctttttactttgatcttatgaacactcatataacgtgggaagtgtaccatatagttagcgtcagaactttcgttatagactgtcatgtaaatactagaagaagcataggtaatgaacttaacattcttattaagatcaaaggtttttagtgctctcatgaacccctcaacaccatatgaaatcttatcttcaaatgggatataacaagtacatttacttgctacatcaataatcagtccataattgtaacgaactaacagttcagtgtttttctttacattgataccagcttgaatatcacgaattagatcttcattggaaacatttggtggtcgcttaagtgtaatattatatttgaaactgctttgtactttaccttcattatcatctttatcttcaacgaaatctaaggcttctagtgtgttgacttcttcattagcaaaacattcatccagaacttcttcggcaattgtatttaaatcaagctttttcacttacatctcctaatgacgaaatcaaaatcgatatacattaatattatcatctgtgaagcaatcatggttgtgcacatccatgaaagtactaaacactttatcatataaagttgtatgttcttcatgaatagcagcatctagcatgtattctccaccacttcccataaagaaagtgtagtcttcatgtagatattcaagttttttaataaactttcctttagttaaaatcatatgaataacataatctttagaaagaagcacacaatggcaacttaactttctgtcaggtataactggtactttattaattaaccaatccagtactttatcaatttcacttactaccccactagcactgaataaacggtcatgtacatataaagttttttgattaacaactccatattgatattttggtcttagtgggaaaaaaccaaataagtttcgtggtatagttgacgtaactctagaatcggtaatcaataaatttaatcgtttatcaatataaacagttgtcatattaaaccttatctaagaatttatcgtatatataaaattctttatcggtgaatacattaattctagtatcgaatctttgcatcgtgttcatatacaatgaactttttaaataaaaatacaaagcaacaaattctgatatatgcatattctttttattgttacataaattctttagcattttgatgctatcaaattcttctttatcaaatctgtactggtaaaaattatatctattgaactggcactcatagatacgaagtgccattatatcaatacatgcttgcgatttacagtacttattcaatacgtcataatcacccgtacataatgctacaaagattttatgtgcaagtgtagcttttccttcaatcgtatgataaccaaagaacttaatgattaagtactgaagaaatctaaacattttatttagaatttctccgaaattacaagtgtatcatcataatcatcagcaatatcatgaagaacttttaagttactttcaccagaaacgctttttacttcgttcaaaagatagtttagatcaactttagttactttttctgaatcaaacacacagaaagttaattcagcgtttggacagatcttcttcagattatcagcaaccacttgtttgaagttgaaagatggggaagcaactaggttaactgcaacgagaatagatttcataatgttttcctttctagctgataattaaattaggagcacattgtactccatattatttgttatgtcaaatacttttagataccaagtgcagtagataactctttacgtttgttatatgaatcagattcaatcttacttttcttgttgaaaagggattcgatatccttatagattgcttcgatagatttagttactacccattctgattcttgaagcataccttggagtcgtgcgtactcaactttgatagtactgcgaagttcttcacaaacttcttcattcttaattagtgcagcactaagttctttgaccgtatcgatgttcataagttccttactctaatttgtttttaacaaaataattatatataacatactaaattatgtcaagtatttttagtaccttcttctgccatttttgtgatataccaattaagtactgatttgtgtaccataaaaaatgtgaatgcaaatatagcaatagctgctgatgtaacactattagataatgacccaagttggatgttagtacctaaaataacaataaatggatacaacacaatcaatctactgtaaggttcgtctccagtatcacggagaaatccaagcctttcatgatccgtatccatagtgacaattggacagaacataagtgcagacataagagcaataccaatttgtgctacattggaaattgtaaaccacaaaggatttaaaccatatgaaatattattttctgtacagtagtaaccaaacgaattgaatgcacaaactaaaaatacaaaaatacaaatcttattatagcctctcatttgtttagctccgttaattttcgtttaacttctagatcatgaaactcatcggcatatgagttttgaacagttctgatgtattccaacataacaaacatagttccacatacccatagatatgtatagtaatcaaatacaaatgcatataacatgcacggtaataaaatgaaagtgtaaacaaaactatatcgtgtagttccaaatactttcagatataacaaacgtcgataatcacgggcaaatgtattgatgcacactgaaaatgtaattaatgtataccatgaaataccctgaattaaacctgaaacatttacaagtttatgttcatcggaaaaccccagtgcatttagcactggagccataacccaaccaataatactaataagaaaaagatattttgcattacttagtgtgaacatattactttagtccccatgcttttttgattgcatcaacagagttttggtccactacttcctttttttctgatgtagtttgaagtttattaattacatattcctttgcatctttttctatcataaatttaccatcaaccaacacaccaaaaactttagaatttcgggctggatatggattaatttcatcaagagtacggactttcttatcaactataatggctttgatgtaaccagtttcaagtactgttgtaatcacagtcatttcaattgcaactggtgaatcttcccaatacgcaatccatttagtaaagctacgatcaggtgaatcttttgtgcattttaatttaattgcactattaaaaatgtattgtttaaaattgtcatcgacaacttcactaatactaaaataaccttcacgctcttcaacattacgtttgaaatttgtagctaatacatccattttccatcccccttgggttacttggtgtgttaattataatactaagaatctttgttgtcaaacttttccctcaaatatttttctattaatttaatttgtgttggtggtaagataaagtaatcgtacatagatttactaccatgtatcgaacaacctacactaatactataatcatatggatataagtatattgggtcttgtatatcaggtatgaaaactattcttgatatattaccatttcctattcttacttggacgttatcattattattaagataatttcttatacagtactcaattataccatttactttagaatcataaccataatttttatattcaggaaaaatgaaatagcgttcatggtatagatatgagcatagtaacgctgggaaaaaattccaaaatccttcatgttttgcaattgtttgtgcatatttaaaatgattagcattactaaaaatattatacagcacaaaatacacaaatggacttaccaacaacactattgttaacatcagaagcctctgtatttttcatatacttcaacgcattccatgattttgtcatcgtccatcatatcatagccttgtagaaattcttctttatcaaccttccctgccatcatatctgtgtcagaaattctggagtcatagaaggaatacatatctttatagtactggtttttgtgctgctcaatctttactttagcatatccagcacaaaatgaaggagatttaacaacttcccatttatgcttcttgatgggtttatcattagcatgtttttccctgtatgtctgacgataacgttcacgcatttcaggcatgtattcgtcagcagtacgtttagggggagttttaccagtcccaatagttttaatagtttgacgttgttcttctgcgtgtactggggaaataaaacatgatgtgccaaacagtactgctacgataaccataaaattcttaaacataatcaaacctcttttacaataatatcgattgatactggaattgcaatttcactattacatgaatacacatcagcacagtactcaatatctagaactttataatatttctcaaacccacaaatggtaagattcaacgttgacccaactactgggagtacaggaaatgataagaacgcaattttagaatgaaattcttcattgatatcttgatatacagttgcagtaatcacaatggtaactcctgtagtggtttcataataccgagtactgggtgattttcaatcattggtcgccctggtacaccagtgaggacaactgggatagaactaatatcttttacatagttgaatccctcaaacgtgaactcttgttttttctcattatacaatacccatagtattacgtcagcttttttctggatattttttaactgtcgagtactaacacatggtccaaagtcagtccatgatttatacttgataccttttacttcaatacgaaggttgtttaccttaatatcacattcaccgtcacgtgcttcattttggaatgctggatcgatattaagtttaataccagtattgttttcaatttcattaaaaagtactaaagatgcgtgctcacacaccataccaacaaaatgactatgtgcatgattaaaaccatatggcgatttacttgctggagccaaaagtttatatctttctgatttttcaatcgcttttgccataaaggaatcagcttcatctttatataacttaacagtcatttttccatttttcagtactaatctattatcaataacattcataaaaacacctcattattcattcactacatgataacaccaaatcatacaccagtcaagctcattttttggatatgcataataaatacgttataataattataccaatggagggataaatgtcaaggtcaattgctgcggctggacgctataagtttggtgaatgtggttatgttgttgatggtgcaatcctcaatgatggaactagactaaaaaatattagaatctatcgccaaagaagccatagattatatgatttagttgatccaagaactaatataatatatcgtaaagtacaaataacaactaaagataataaaggttatctattaaattacaataaaactaatgaccaactattaagtgaaattaataaaaattgtttctttgttcgtggatattctgaagagccacaagaaactgatactggatttgtatataaattcatgctacataaaacaattttaggtagttcacaaaccttgtatcatatgtatacacctgaatgtggtattatagatcgtgatatagataatattctcatttcaccagtatttgttggtaatgactcaattagtggtaaattattcaacactggttcagaaattgatactaacggtatggtaataacaatcgtattaccagacgggacagaatactttactacccaatttgttaatgatgcatttacaattccagttgatgttatcacacaatcagggaaaggtactgctacactcacttctccatattataacactaaagtggtggaatttgatgttcttgaaagtggtgaggatattgattttgttacatcagttcttctatcccaatttgaacctgtttcggaaggtgtattttctgcggttgttccatttgatgttcatgatcgtggacagtacttagcacttcaagcatacagtggtgacttatatcaagttggtgtagatctttctgtagacgcagaaggtaatattactgtgtatcaaactgataatttacctgtttctttgagtataatcggaaaaacactgcatactactcctttccataaagaatatactttaagtgagtgggttctcggtgaagactctatgtactctatctcagttccagtaactgaacatggtaaagcactaccacaagttcaattatattcttcagacaatcatgtagttcatagtgaaatacaagtggatgaagatgataatgtaattcttaaagtagtagaaccgcttgactgctcagtcgtaatagttggttacaacgcataataaaaaaagccactacattgtagtggctttaattttatctaattatttgaaattgtcacgtagaacttcttcaagtgttttatctggattgctaatggctacattataaatcaattctttaaatgcagttagtgcctgctcagttgcttctggaccaaagttctcactaatgcttttaaacatactttgtgcacgttctgatttgatacaactagttacaaacttgtcaatttcattacgaagctgcttagttgtcatgtcaccaatgagcatctcactaatttcttttggttcatctgcacttgttctgacattcgtaaaaccaaacacatcatcacctgagccaaagctacgtttttcttttttagtttcttttactggttcttcttcaacttcttgttcgtattctttagtaaagagatgagatagtacatcatcaagatttttaaccataccgtcaatacgagattcagcattcttggatacatgtttgaatgcttgctctagtgctttttcttgaatctggtcacgaacattattaactacattacgaagtttttcattacagttgtctaaaatttctaatacttcaccagttttgattttttccaaaagtacatctaaatcagattttacatgttgtttttgacttacttcaccattaagaattgaattcaattctttagcaccttcaactgcttcttcatgtgttttaaattcaactggtacgtcaacaccatccagtacaatattaagcactttaccatcaacgtaggcgtaggagtaagatgcttttttgaaagaaatagttttgaagaaaatgttgctcatattgatatactccttaatgcccactagctgggaaggttttaaacatatagtgacattgtactaaatcatcgaacttcaagccgaagtctttagtacccatcagtgtgtggtaaaaataatgcgaaattgtattagtttcagcgtctttaatatagataccaaattcggtacagcaaaactgaacaacttcattataactttctaacttggaaattacaagtacttgatcataagaatttttatcaaatccaatgatgtacatttcctctgtttctgggtgtacaatcatcccaccgcgagaaataattttctcgaagttactgctcaagtactgaattgttgaacttaagttcatttacaactccttacgtattactcgtccggtaagatgttcatctgtacagaacttcattataaatgcttttagatggaagtcttctaaaattctatatgcttgctttttcataacgacttccttcttctccacatcaacaattatatcatgtttctcgtgaagttcctggatcatttgatatgaattcaaacttagtacgctcataaccaccaatgtcctccatctcccacaaaatttgaactgccacttctaattcgtggtgaatttgaaaataaccattacttgcagtatagatgtagccatttttagtaattgcataaccccactttttactttgagaatgcatctcacgtttcaacccataaggtgatggtggcttcttgactggttctggttctcggttttcgttgtaaatctcttgttcgattcgcaacgctttatgatatgagtatacatgaatcaggcgacaaagtacaatagtaatgcaacaaataattgtaaatgttatcaagctcatcaatttgccctctgcctagatacatattcattaattgcatcttccaaatcataccctgacatttttacattatcaattgaaacatgatattttttcagcactttttgtccagcagtgttctcccatatagacccatcaggctcaatatgaactttatggttcaggatgaaatcgaacatttcttcttttgataagtttgctttacgggtttcaatgtgattagtattaagtaattcacgagtatgtttaatgccatattcagtgtgctcaccaacactacgatgcaaaacttttaactgctcggcagcagtatcttcatcataaacatgaatagtttcagtactatataaaatatcctgaatattaccagtactcacttctgtccatgtgtctttgaaatgcactttgattgttttcataaaagctcttgttagttatatgcagtgaataggtcaatgtttttatcatctacactgattaatttaccagttgaactaacaaacacaatattaccaccaggggtgatttgaacacgctggtttattgaatattgatcactaaggttataattagcccattcaactacataacgctgttcaacaccgttagtatcatatagataaacgtgtgtaacgtcacgcatttttaaacggtctaacagtgtagagttgtccatgaaatccgatggtgtattgctgcgtaatgcaataccgaactcaccgataacagtactaattgtcagtccgtttgaaaaacggctacaaagagtcttctcatcagcaatatgcatccataaaacattctttacatcaatatcaacaaattcacagttttcaaaaaccaaacctactttggaaactttaccattaaattgcattagtaactcctatttttttatattttaaaattaaatcactcactgctttcattagcttatatggaatagctaactcttgaacagtactttccataaaatgttcttcttctgtatcataaaatgttgaactatagtgttcacaatcatctatactatcataaaaagaagacgtaagtttatcaacaatgacagtgatttgtttgtcagttttggcacatcctacctgaacggttaatccaatatcatcagcctctacacgaattataaacgaattattagtatagttcagccaacaatcttcaccaaagtatacaacactgtgtttcttctgaaatgaagttgcggtgttaagaacaccaataacaacatcaactgttttttcatttaaaatattagacatttttattcctgcttcgtatgtttcgtgaaatctcaaatattccattcaactgctcaacagttaaaccctgtaaatcgtaaactgttgatagctgaaagaacatctctgaatctatagtatcatgttcaattggaagactcaagaggtctttattaataaaataatcatatgttcgaattgtcaaagaatcaccaaagatatcaatgtaaaatttcggaacattatgtaacgaaacatctattaatatgttttcagcatatctacaagaaattttagaattatttttataagattggtatgaaaaattataaggttcatcgaccaatgtgtatgatgaggtatcaccttcggaaaatattacaccacattcaataagatgtgttaacgacttaggtggaatttttaacatttcacttcccatccttactcatattactacggatcaccccactaagaaaacatattttccttaatgtatcataactgatatttgtaagatcatgtacaaaattcaactgcaagtacatttcttcagttaattgattaaatgtatcatcaacatgaatgttagtatgttccgttatatctatttctatattattttcccaaatatcaatgctaacagcatagtctgatgtatgtctggattgaactgaaataaaaatattattactgttgtataatgtctctgtgtatccattcaaaaatgatccaacgacaacatcaaaaatgccatctctaattgggttttttgtttcaaacgtatcactacaaacttgacggtatacaatgtcaacatacttatcaattaaagtaaacaaataactcattgcattcacctatataagaaaaaaggccgattcatcgaatcagccttaagtataacacagtagaagttaaaaagtcaacttctaaattacagcatccaagaggaataaaaagatactgttagagggtaacgaatataatgaatttgagggtaatatcattatacgtaaaaaagtgatagcttctatacataaggaggaatcagtactgactagaagctatcgggttaaacgatttcagtactgagtgtttagtttaggatgagtatttccatcttcgatttgttttagaatcgagtcacgaatttctactgccccttgataactatatttatcttttgggatcacccatgtatattcgccatcagtggttttaaaatcaatacatggattatccctgtattcagatgcaatgattgcaataacatgtaatgaattcaatgaatgatttgtataaggataattgttattatctctgaacgtgaatgttttaagttcatcaggtgcaacaatgaattccattattcatcctcgtacttcttgaatggtggaacatctaccttgaagtctttgcacatcttagttgtacgaacttcagtattgttgtgataatttttcttaaattcataagaaacataattacgaataccaggtgtatgaataatagcaagaaccaatgtacgaccaaacaagcataataaattccagaacatatgaatctcctaattgtgggttttaaccaaacgtgagacagctagtatagcattaacctcatccaatgtcaacccaccaatgtcattaatcattgagtactgaaatagtgattcttcagtgtaatggtaatcatgagaagcaataaagattgctggtttagaggcatccaaaattatctttgtcattgtactatatatatcaaattgatataatagattttcacctgtatatgctacgtagatattatttgaataggctggatgtaccattgtaaaaccatcataacataatatttttatgttcggatcgtcaaaattgcctgtataaaggttattacaaacatcttgcattatacgtactattagactagtcatttaatggatttagtacctcttctggaatcaacttttgaactttaagtatagctttaatgtcctcaaatgttaatcctaatatgtcgttaaggaggcagtactggaagaatttttcttcagtatcaatatcgttaacattcaattcaattgattcatcatcataatcataatcttcattatcacattcataacttctgaatataactttttcaaaatacacatcaaatgaataaaaatgattattgaattcataaccaagaaaaatattaaaacatttactcaaatctgtggtttgattcaaatctggatcatagcaaaatactctaacttcaccaatatcttctatttgtacatcatgcagtgaccatgcgttgttttttaatacatagttcaccattttaacaatgttgtatttcatagtgtacctttattttgtgccgactaccggaattgaactggtgacctttcccttacaaggggattgctctacctactgagctaagtcggctaattgagaagtaagataaccaacaattctctatactctcatgatatggaggggaggtcatcttactgtattatttattattttgaattttgcttatttcgacgcatcaacttgattaagccaagagtcggcataggtgcagcactacaaagttcttcaagctgcttggtagtttttttacttactttcatttttactcttacttttatctaatgctgcgttgataaatgttgacaactgttctttcgtcattgtcggttgtagtttcttactaagattctgtttacgcttcattatacacccaaatgatgttatgtcaattaaaaaagtagtactggatactgttgcaacaatatcctacagtgaccattttagctaaaggtgaactgataatgccgaagcatctccactgtattgtaccataataagtccttcagctattcagtactgaatacttacatcctacgtctaggttttaaatgtgcactagttgtaatgtgtaggcacatacgggtctgctttataagctactgaatcgggaatcacaacctcccctggtgattcagtactgaatacgaccgtctacatttattttaagagagaatgattactggaactaatagttttccatcttcatcaaatgaatctgaaaaatcttcaccagactcttcaacatctgtgtctcctgcttgatatgaatgagcagtttcgcatttaccaatcgcatagtcatcataaggcgaagcatgaataagaatatctgcttctggattattctgtaaaattttaattaggtctttggctttcatttataatacccgctagtagtttaagtctgcggcgttgaatacaccaagtgaagtcttaccacgtagtttaggtgaaaggacatactttgtcaatttctttttaccgtaccagcgattgaattcgtcttcagtgacatatgggttctggaaatcgtattcgcgtttcttatgcagttctttagcacgttctgcaatcttggttcgttggtcttctggaatgtcgaatgtattgttacgttcacaccattcgtgctctaatgcaccctgaagaaactgttcggtttctttgactagagtgattttagtcaagccttttttgatgttcatataatcatcgacgtatccattccaaataacaatctctggattgccgtcaatttcttgaagcattttgatcaagtcattctttttcatttaaattcctagaaattattttcaatagttaagtacattgtttctgtaaagaaaccatcttcttccatttcatcacctgaaatagataaagattcaaccttgtactcacccgattcaatccagttcttaatttcttcacgattacctttgtgacgaacatcatagtaatggatagcttccagtactgttcggtaatcatcaatatcaattttagttttggcgattaattcatcatctgcatcgctttgaatcaagaaatatgccatttgtaccctatatcatgtgaattatatttggcggttcgtactagaattgaactagtctaaggcaaattaacagtttgctgcccaaccaataggccaacgaacctctgtattttagttgcaccttgttaattcaagctttctacctttcgggtagttttttgtcattctccttacaagagaagagtgcaatatttggtgggcctggcagggaacgatcctgcgaccaatcggttatgagccgaccgctctaccactgagctacaggcccgaaatttgcgaaagaggtgggatttgaacccacgaagcgttatttctaacacttgctcgcttagtaggcgagtgcaatcaaccgctctgccacccttccgtatttgtttattatatcaatactgaactatttagtcaataataaagtactgattttttaattacttaacatgtttccataatttatatgatgctacatccgatattagacttggatgtacaccaaattgttttgctaatacacatgcaccatattttttatcatatggtttatacacagaacgtatgtatctaacatcatcttcggttaatttggatagtggtcgatcaacaccttttagtggaacgttaagaccggtatcatatgcatgtctattattctcactataagtggcccattctaggttccaatcttcattgttgagtttattaccatctttgtggttaactactggtttgttgagcggatttggaataaatgctttagccactaagatgtgaactctaaaacatttacaaataccatttcgtccaccaattctagtacttaaaacactgtagcctttctcattaacacctaatgctaaaattttatttgttcttttactaaagattctacctttattactgacttggaaatgttcttcatatccaactacatcacgccattcttcaaccctttccatgagttttattttatccttttgtttacattatacggtactaaacactacagtaaagtacttttaaattaaaaagggtgttcctagtgtttcattatcgttagtactcatataataacaatatcatatagaatcattatactcgaacatcacatgaatacacaaaccttatactaagacaagttattacaaatcttagtactcaattcttttcggaacaatttggcagtgagtgtgggattcggacccacgatacgctttcgcatatgctaccttagcagggtagtgatttcaacctctcatccaactcactaaattaattatatcaatacttaatactactgtccagtactattttcggaaaaaaccttctccaacactttaaatatcacagaatttaattcatgcggaaacacattttcatatactgttcgtttctggaattcatctgcttcatcagcacatagcttgaaagtaatgtattcagtacttaaactatttactatatctcgtaacgtaggatattttagtttttttatttctttattttcttctaatgattcaaaaacaatttcgttatcattaataataaacgattcatcgttctcattaaaaacacggatttctgggttatcctcactccaatttttagaagctttagatgttaattttgaattcaaaaatgatttaagaaactcttcatattttgaaatgtctttaacactcatatcaccaactttaattaaaaaaaatggatggtgacgcttttaaacgccgctgttaattcagctttataaccatccgttttaacttgcctttcggctaccttgacgtggggcgtacaggctactaaaagcaacttctgtaaacatatttccacgccttacccttttaaataaaagtccatccggttttccagtttggtgaaggactgtcacctctagtttcaacctgctagtcaagtaataattgcctatcgtccaattatcaaacccgtctaggttaacattcaccacttcctagagtaccagagatcttgttctggattgcatcgacgtaacttacaccatatacgtctgattgtggaattcattatatcagtactgaactatttagtcaagtacttttttacaaatctggacgttcatctttaaacatattaatatcctcagtactgaattatttagtcaagaattaattcgcatttttttgaattcaccaaccaagtacttatagaactcataagtgaacaatggttcttgtacagtactcatttgaaaatattcttcttctgtctttggtacaggtgaagtatatgaaatatagggattataatcttcttctacataagtagaaacttcaacattaattgaactaagatctttatgtaacaaaatgtttaatataacagttcgttggtcaggagtttctccattttccatccactgtaaacacaatctcatcagttcatcccaaatataaaattggaagttgtaatcttcaaggttgcgttttattgcttcttcatattcactaaacatatcaagttgccatataagttaagatacaaacattatacagtactgaactatttagtcaatctttttttatcatcggtgcacgatatgcatcagtacttcttcgtcgagttcagtacttaaatatgctttgtacatacacttaacacgtataacatcccacattctagaatctaatggtagataataaggattccactttaatttttggcgtttcatccactcttcatgtgtcataatcgtaccagtagttcaattaagtacatttcatatgctggatcgttgataagtttatcatacagatgtggctctgaaatgaattcccaatgatattttctccaactaccgatacccgaatatctaaaattaatgtcattcatccattcttcatgcgtcatggtttttaacctttaattaaaattggccgaggtagagggacttgaacccccaacctagagattagaattctcttgcactatccaattgtgctataccccgtatttggcggtgaaggtgagatttgaactcacggaggactttcaccctcgcttgttttcaagacaagtgcattaaaccgctctgccacttcaccagtactaataattatatcacatctttatgttatgtcccattatataatgaattaatgatttatgcaagtgctttagatacaccgacaccaataattccagtgatatcgatatggatattggcaagttgattactatcatatgggtttgtttctgtaataaccaatgttgtatcattgactaaaaccacagtaccttttacacgataaccatgtagtagtacttgaacctcatcttcaggttttaatgattgaataacttcaaataaagttgtttccattttttgtattccttgtttagttttgattatttgactttctaaatgccagttcgcatataaaccagggttttctggtatccaaaacatatgacctgaaaagattttcatctcttaatatatcataatgtacctgacgaatgccattcccaaagcagtcatgttctttatgctgtttggacatccattcttcgtgtgtcattttatgtatccagtacaattaagtgctgcatctcttcttttgtaaagaaagcactgtcatgaacaatagaaccagtcttatcaactacatagtacaggtttccatattgttgaacatcaattccgtcaatttcaattcgtggaaaattttgcacaacacagtctgcaccgaaaacctcaccaaaaaagtttcctgctggattgataatgactttcatattaaatcacctttattatatttttgagcaggtatggggatttgaaccccacccccagaatcggaagtactgtatgccgccatcaacactttacctgcaccgtaataactattatatttatcttactattttttatctctaatagcaagctcgtagatgaaccagtggttggaatcttcgtccaaaaccaatgattcgaacgtttttttatcgttcaaaacatcataatggccttggcgtataccaaatccaaaatgatcatgtttatattttagtgactctatccattcttcatgtgtcattttatgtatccagatcaattaagtgtttcatttattcttctgtaaagaaagcattgcaatggacaatggaaaaggttattatatttttttgtctctaaccgcaagctcatagatgaaccaacgatttccattctcatctagtacatatgattcgaacttatatttgtctcgtaaaatatcgaaatgaccatcaataaatccatttccaaactggtcataacgttttttcatcattgccatccattcttcatgtgtcatctcttaatatccataacggctatactaaaatatgtaccaaaatcatcacaattgataatgttgttatagtactcaattgggttacgcaatgatatatacaattcaagcttaaaatagtatatatctgctgcatttatattatagtgtagattaaaccactcatcaaatgtcttaggctgcattatatttatctttataaaaatccatgattttagtcaacagtactgcaatcgtataatctaaatcaggataaagtaaattgtactgaaattcttcctcaacactatagttagtggtacagtactggtaatctttataacctattgaaaaataattcggatacaatgtacaacgaaagcgataagcttcatctgtcatataatcattgtattcaacacagaaatatagtgattttgaatttaattcgataagctcaacgaatccatcaggtaatgaatggttataaattactgaatcttcattaaaccattcatagtatttttccaaaaaatcactaatggatacatccagactttgtataggtggagttatgataatttgaacttctttattcatttcgatcccttactatattttacgtatgggctatcatacagatcataacttttttgtgcacgttcttttcggcgttcatacatgattctatcatactctttagctttctgatttgcttcattatacaattttaaaattagcaaaaatgcatcaagatctggatagtttgctggattgatagtactcagcataaatcgttcttcttcagttctagctaagtcaaattcatacttaatagttttatacccactccatttatatatatgcgttactttattagtaagtacattatattcaacgaagtcagtactaccatcaagtacgcgagtgatcttaatagatgtaccaatgacaatctgtacagaactcatttctgaagttttaaagtaataaatgttattacggcgaagattaacttctcgatctccaatgcgaacatgcttaataacttccattaatggttctggtacaccacgaattggcatgttaatgctcctttttaattctataccttttaacagcactggtttcccaaaagtcaccatctaagttgctgaatttatatatagtttcgagattttcaccatcaaacgaaaacaacacaacatcttcttgtacagtgccgttatgtaacatgatatcataaacttcatttcttacaaataattctttggccttagaaatatcaaaatcaataaatttcatatatcctcctattatcattatttgtattatatcagagtttcattgcatctaccagcatgttttcataacttctgtgatgtaaatcattttatcttttagtgtgtaagggatgcaaatttcacctgggcttaacgttgtgttcttttgaaactcatcttcttcggaatctgccatgtaaaatgggtatgtcacaaagttatcatcaactggacgattatgtggtttcattaatgcatcatgattgacaaaataataagcatcaatatcaggacggaaatacaaacaatcaaccttaatgcacgggtgtaaccataaggacaaagaatatgttatttggttaccaatttgtcttgggcctgatgcaattgtattgatgttatttttatcttgtaccatttcataaatgaaatctatcatttcgtgtagttctgattcagtcattttatatccttaaaaaaatacccagtacttgactgggtatttacaaagtaacgtttaatcagatttcttttcgtaatctgtaaaaacagtcaggattgttgcacatagtgaatcaactactgatgcacgtgtgttatcaaggtctttagctagtgcttgaatctcttgaagttttactactaagtcgattttttgattactcattacttctcctattggatgttttttagatattaatttttataccactaaggtctagaacttttttattagatactgtttctgattctaatttagtttcttttacctcagtgttaatatttacgtcatctttgagaatatcagggataataccatgttgaatatcatcgtacatagaaacaacggtttcggcacaagataacatttcacgaactttgtactgataaccctgtggtaactcattgatgatttccataatatctagtaatttagtttggacatcaataagaatttttcttgatttttctggttccattactccaactccacaacattactttttttggatttaatcactgatggtggctcattaacgcttgtttgaccacgaagtgatttttccaacgcaatgatgcgttttaaagtttttattgatggtcgcttcttcgtcaactcagcttttgcttctgaataatattttcttacatatccataggcataatattttgaaccaatgaaaatttcagcaactactggatttgagtattgtgtatcaattccatctagatccgtgtctaccgagtagaatgaaatatttgtatcacatgctgaaattttagccaccaaaagatttgcatcgaacttatctaaaattagagaaattgttttttcggcatcagcactatatggcatagcagacattaaaagttggaatgtcttaaagtacttacttccactaatcatggtattgaaaatcaatccaatggtgattaatgcaagtgtaccaatacacacaaacaaaaaccaatattcaacactcatttataaatcctcttactttatatgattaaaatgccccatcaaaaatgatgaggcggtaagataaattacttacgatttgctttacgcagttcagatagttcttcttgaagacttttcttccatgcaatcaagtgagcaaaacggattggccttgcaccagtaccgtggaatactgctagagcttcttctgcttgatgaatctggaattgaatgtagttcacagtgcggtcgaagtcggtgatatctagtacttgtgcgttagtttctttagccattttaatacccttttatttcttttttatgaaaaaccctcatcattgaggaatggtttgcattttaatatctgccgataacaaacattatatcacaatatctgttcttgtccaatttttaattattagaaagaacaatttttgaaactggtaaatctgtatcatttacacgttgttcattatatccattctgtacaagaatgtcaataactttagacttatcaattgtaaatgattctaacatatcatatcggtaataaccaatagtctgactgaactcatattttcctggctgttgacgacaacacgtatttgtttcagccataatcttattgattaggtaatatgtttcagtactatcaatatttggaatatagatcttatcatcaaaatgaattacttcatgtttattcatagagtgattcaatctccgctttaagaatggaaatgatctctttctgaaggccagtaatttcactgttcaaagatgatagtcgcttcgataatgccatgaattgctttgcatcttctttagaacggtcatttcgtactttatcagaactccagttagcatatgattgctcatctttcctgttaaggatatcccagtctaaacgtactagtttacgttctttcttcagttcgcttaagcgagatttcatttcgtctttagtcattagattgttcctttcatgaagtctggaataatgattacgataggaggattatactctacataaccattttttgtcaatagacttttaatatctgaaatcacattatcatgctgttcaatatctttatcacaaaagatttccaattctttctgaaacggttttttaaccgagatgttttgagtcagtgtttggattctctgtaacatatcaattggatctggactgaactcattaccaacataaagagtaccagatgcatctttttctagcaagacttctaaaattttcatttcgtatccttcaatttactaaagttttctcgtgtaaatccaggaactggaaaatatacatcacagtcaacatcaggattcataattaccatgtcattacatattatatcacgaattttactgccgtccacgattttttgcattaaatcattccattttttacgagaaataacgaatgtactaattatacataaatcatgtccacgttttgaaatatatcctagtacttcattatcgtaaacaacacgtatggtaacttttccaattgtaacccctcttactggattaatactagtatcttcaaaaattaattctaatttaagtttaccattcgaaataagtgatgaagtatatttagaaaccattttatcaatttcttgagtcaaatcatctctacctagatattcaaatacagaataagttaattcgtctgcacctaactgttggatagttggaagctgtgcaaccatatctaaagatacaggttcgatatatattctttcaatatcagaagattgtacaaatagacaaccatcaggtgtcgtatctctaacaatttcggcataatatgtataaagataaaaaacattagactcggatgagtcagtttctacccaaatctcagattgtttcatttcatctttatgaagaattcgttgagtaaatcctatgtaaaaaccaagatataaatcatcatcagtttcaaacggattaaacatcaaatacggatatttgtcaaggtactcattgaacttacgctgtacatctctatcacaatccatgatatactttcggaattcagaaatgattattttttctaatgacataatcaatcctcaagatgcatgtagtacataaacatcgccaaccatataaaaaacccgaaacaacgaagtaaaatatcaattgttggatctgtcccaccattaacttggtaaacgattactgggattaaagcaatagtaatagacacagcacataagatgaatgcaacaaacacctcaaacataaacttaatcgtttccattattatccttcaatgtgtagtgtagtacatctaaaaagttatacattgattcattacgcacaaccttgattgttaaattacgacaacccaacatacgtttgaggcgacgcttcaccgcagttaaatcatgtgtactattcgtatacagaccattaacctgacctggaacagttggcacatgaagaatgtaatcataattcattagtaagcgttgattatatttctttaatgcttgcttgtattctgaaatattttcaaagaatgtacaataacggtcgtaacgattcattttattcaaaattgaaatacgaaaagcgttaccactattccaatcatcttcagttgggtttgggttgatatgtgccatgttagctgtactgtacccaccacttgtgaaaacttcagaatatccattctcaaaaacatacaatgttgctttgtggcctctgaattctttacggtactttgacagtacttggatgtgattacgcttggacttgtacatttcgtaaccttcataatctgaactgaattcacaaattttatcaacaccagccatttcgtatatcctcgtttaattaatataggagtattatacatactccattttcatgtgtcaagctttataatacggaagactttttactaaagattcagacgtattattttttacccatgtgctaccgttgtcattagatacgtatccagtaccattaataaatttacgcataataccagtaaaaatattagtatacaccattactcagtatcctttggtttagaatgtaaaccatacttttcatcataacgatcataggtagtaccattagtactagctttgatgctttcagtacgattgattggttcaatcttaacaccacgataaccaatctcttctttaaattgttcccatgattcacgtaaactcattttagccccttttgttatttcatacactcacgtaggtcaatcttttctactgacccaccgagcactagatagtgaaaattagaatctttgtttgccatattcaaaagatctgctttctgttgaagcgtaaagcgtgaagtactgttacgtactggcatagttactccttaaagtagatatcacgaatttgtttaatcatctctaactcttgaagtcctatcataccaaagttttcttgcactgtcaactgttggaagtacatttcctctaaattattataaggaatatccactaatgataaaggaacactttcaccacggtatagcagatcttcaacgaaaagttttaaaatcatgatagaaaatgaatctttttggatatgaaatttgtaaaatgtttggttagtactgaacattgtatttgatggattgaaacccatttcaacaaatactgtatctttatcattatgtttgaaatatgtacatcttgaattcgcaagaactttagattttgggaaataaaaatcacccatcaacttctgtcgtttccaatcctcgtatacaactggatgcttaaccttcttcaattggtgcagtactgtcatagttttttccagtccaatgaatcgaaatcgatttgctcaggattatcaacagcgacaactcgtgcattatgaagagtttcaaagtagccgttccacggtgttcgtactggaatttttttatctccaatttttacaaagaaagagaattcacatgacattggatcaaaccattctttatgtttggcttcatcgattattgtcgcacgttcgttactatatgcatcatcgagtttcttaaagaatacccaatgctctttcaaagactgtaatgctacaactgcctcatcctttgattcccattgaacatccaatgtattggtaactgaatcttcagtttcagtgtcccctgtagtgtaatgtacttcaatgctgtatttcattaatcatcaccttttagtaatttacaaatttcaatcatatgataataacatgtattccaaaattgtccattagtacttccaacatcatgcactgtactttgctggaacacatattcatcgttgaacatcattttaatatcatcaatgtaaaattctggttttgaatcattattgtattcaatactcgtttcaccatctggatcaagtgaaattgatgatatgtcgtgaattcctctcggatttgttggataaattctcaacgtaagaggatagaagtctggatcggtttcataagtatattcgattatgtaataaccatcaccagtaattgattgatatttaaatgtagtttcaattgaatttgagatgttaaatcccagtttctttatctcatgtagatgtgataatattttatgtaaagatcctaaaacatgaatcaaattatcaattttcatttacgatcctttgaaaagttcagtttaaaagttttaccaaattccattgtagctttacccagattgttaatattttctttcaacatttcttgcatcttcctaatactttcaatccaggcttcttcttcgatacgaagaattggtcgcaatcgttcctgaatatcgttaaaacgtgtattgagttcaaccaatgattcatatgtgaaatctttcatatcgataatagtacttctttgaaagaattcttcttcagacaaattacttaaaatgattttatcacgaccaatagataatgtcaattcatcatctttattttttttaattacaatactaataggtgtttttaatgtaatgcaaatatcatgattattaaatgtttcagtttggtttgacattctgaattgaagtttcccagataaagcatgtactggtgatggttgctttttacccgtaataacatcttcccatgaatcgagaatattattaataattttaacataaggaattggcatatatgcacctgtgaaaaatccacgcaatgcgtggatttgtaattattcaagtatagtaatttcaattaaacgaatttcgataaactcgttttcagtttcccatgacgtgccaaatttcttttcaagttcagatttcacatcacttttaaattttcccatagtattaggaataatttgtttggttaatttgtcgtaaccacaataaaacataggtttctcccttcgagatattagctgaacaaaatcttttggatatgcaggtatgttatgcatcacttcatgaatacactcagtacttgaatcttgtactttgtacattacattaagtttacctctgaaatttgcggtcatatcaacaatagttcctttacccgatttaagtaaagttccattctttgaatgagagcaataaaatacctcatcaccaatattaggataatacaaattaaattctaattcagattttacagccagccgtttgaaactttctgtacgttttatataagtttggtatttgtttatgttcaaaagaatatctctcttagtaaatgtgatataactggcatagtccatccattcccaagcattttgtatgcttgtgtcttactagacactttaaagaaatcttcaggaacaccctgtaatttacaacattctactacacttaagtgtctatagtcaatatttcttttgccattctctaatagatattgacgactgatcactgggtcacgaaacaccaattgtcgtctggatttattaaagtactggttacaatcaccacctttaaaatagttagcatctatacagtacgaagcggttctgtcagtgtaccaaccatcttcaataatatcttgaagtttaggtgcattggataatgcaggtggtataaaaagcttatcagtactgtaccagtaatatctctgcctgaagtgaggcgtataatgctgggagtttatcagtactggcgtgattcctaaaatactattaatgtattctttgaaatcttccttcattttaacattttcaaacagaaatttcaagttaggattgagacttttgatatgatcaaaaatttcaaccattactaaaaataactgcccacgtatatcatttaaaccaccctgtttacctgcaactgaccaggcttgacatgggaaaccacccattaataaatctattttatcccactcaatatcccattctctccacttagttacatcacccaattggataatatcaggaaagttagcttgagattcagctattgcgtacttgtcaatttcggatgaataatatttttcaactgggataccagcatcttgcaatgccatatatcccacactcattccattaaaaagagaaagtactcggataggtttcatataaaatcctttttatattgttaaggtactataatatattatagcatcttatttagaaatcttccaaacttttttcatcacaccatcgtgatgtacagatgattgcagatgccagaattgaagcacttgcacgtcctccaccgagtaagtactggctaattacgccaatcatattgaacactttatcatactcggttagttgttcaaaacctttcttccaatgctcatattcttcttctgtgacattaaactcaccatcaagttcctttaaaatctttttaagcacatcactatgttcactcatcatcatctccatatcgttcgtcataaaaatcatcatcacgatctaatggttcttttggcttttcagacatatatttcctcacatggtaaaggtattatcaccatccatatcttcatcagttgcttcagctaatgtcttgattgtaagtaatccacgcttcacgtacaacatgaagaccttttcataattaccaaacataatctcaggtgacatgtaattctctgttacaatgacgattggacggccctgtgaaagcatacgaaacatagtacgatatttgtcaaatgtgcgaaattcatccatgttcatcatgtggcgtttacgaactactttagtcatcttattacctttagttaattgaactctacttctggataatgattatagaacatctcacgaactgcgtcaagatgttcttgaaattgttttatatcttctaatgatggtgcatcaataacagtactaagttgaaacaacgattcttctgtgttatatagtgacatatcaaatgaattattgttgtcatcagttatgatattatcacaaatttcgtaagtgtcaatacaaacatcatcaagtgttgtattatcatatacagtgtatacgaatacaaaaataaaagaagaatgttctttaccataacgcggtgggtcatatgtcacatagcatttgtggtcaaatgtatcgagttccatagacaccaccccagcttcacgatattcattagtttcactggtaagatccggtattgatgttatcgaaagtaagtggagaaatttacttggatttagcatttcaccaccattggattttgcgactgtatattaaaaagggataatacaaaagtactcaatttttcgaaacaatctactaatacatttaactcatcataactaacaccaatttcacgaataagcgattgttgaaagaatccttcttcggttaacgttaaactactaacctcagttatgttataataactttgggatgttgtggttgatattagttgtattgcaatcgtatctgatgttgtgttgtacagatataaatattttgtttttctttccaatggatctatacatgaaagatcgatcatgtcataggtttttccaataaaaatattacaatcatctgacaattcacaacaaatgcgtatatgttctttcgggtcatgaacacgttgtgtgtcaaattcacatgacattgcaatttcaaaatgattttttatttcgtcaacattcatccgcacccaccattaattcttatatttgtatagtttaatgcttttttaataataccaatttctgtaattcctattacatttttctcaatcaatgacaattggaatagttcctcttcggaaatatcaatactgtggattcttgtacaataatcgttgaagtcatatacatatcgtattgtatagtcgtttatagaaactgatacaattgcaatcccatcatggatgtaagttagttcatttgagtatctattaaaaattaacctatctggtgaacctattggtagttgaaatgtatttctagtatcttgaacaataacaaaatcatcatctatatttctactcagaacacccaaaatatcatatatagtagtcatgttattctttaccttcagcagttctgataattttcataacttctctggatagtgcgtatatttttttatagtactcaaatgtaactgaaccaaaatcattaatagtactagccatgaagaacgattcttctgtatatagttcatttgacaaagcaaccagttcttggtgaaattttgcgtccttccaataacgaaattcaaaaacaaattgtccgtcatgaccgactctacaacattcagaacgatcactgtctacacagctaaacacaatatccctttcagagtcgtaccagatatttccaatatttgtttcaataacagcataatcaatttttttagaatttggaattaaaccttttttcaccagcactaaactggtattatcaatatctagtaaacttaccatatcaattccccattactaaagtgtttttaatctccaacaattcactatacatattcttcaattgtaatatatcttcaaaagtaataccaccaagatcatcaactaatgaacgttggaataaagattcacttgtttgtaatgtatctaaatcggtgatttttaataaagaacttggattaagtgtttcgactagtagtatgtttttgtatggtacatatgtgatcttgatgttctttttataattaatcttataaaatcgcataattgacgattcatcacttagttggataattgggtcgtcttgttcattagaccaccatacagtactagtcatatgattgacgtggtggttcaattctgatatgtccaaatctaaaaaatattttagttcattgtgtaaatctaaactcataaatttatcctcaatgcagcatcatcatgtattgtaggataaacccacaataatgtcaagatgtgaaataattataccagtaatatagttcttttaattcttcagtactgaacaatacttcttctattgtagattgttgaaagtgatattcatcatttagatacatagaaatattactatatactttcctattgtattgacataaaaaagaagttttttgattaatgtattcagtaaatgttaatttatctaactcaatatcgaatgataatttaataatatgactattatcatttacatacattagtttctttgaaaaatgatcaattgtaatatattctttatgagagaactgaaatatattattaaatttattaccatttgtgcttctaaatttttcaaggtaataagaaagtggtttaattattgaagttccaatattgttcttcatatatcctcaattttagataagaaaaatgccccgaagatcggggcagtactaaaatgattttgtaccaaaaggggaataagaacaaaatgaaaatataataacgcatcattattatgtaagggaggaaagtaacatgatatgttaaccatttctggtatatttatttatcatttaattctttaagttgggtttgtatatctttagttatatttcgaattttcttaaagcaataaacactatcgtccaattcgattttaagttcatgtgtaaatgcatacagaagttcagcaaatactaaatcttgacgcatccagtttccatctttatataaagtcattacacaatatgggcattcactattagaagtttgctttccaataaaaacactttgaattgattcatgcttaaagccaataaaactttcatttatttttttaatttcagtactgatatcgaatttagcactggtgttgattgcaaaaattttattcccactttcatcagtattgatattgagttcaatatcactacctagtttacgtactgctagagtataaagaagtaattcatacatgtcgtaacttgttacattaccatttggtgcaattacatcaacactaacaccgtgcatttttacttctgtattaaatccatctttatcagaaagaaaatcagtgatttgctttgtaaggattttaatttggtctatcatatttcatttccttatgtgataaaagcctccataatggaggcttttgtatttacttagagagattcttcgtattcagcaacaatctcaaccatttcattaatgaacttgatgtgagaatgtgtcactgtacggaagtcgtaaacaagtgactgttggaaaaatacatcttcatcaagagaaccatcaaagttcaaatcaatgttttcatcgtcattgcttggtgcaactttaatattcagaagattttcatcaactgcaagttttacaacacaacccagtgcaatggcaagaacatatgctggtttcttagctttttcattacggaatggtgcacgtagagcacaaaaagtactgctaatctcatcatttggttctttgtatttaacattgaccattagttcttcgattttgacgctctcaataacacgaccagtttctggagcgaagaaagaatgttcacggatagtttgttcgatattcatatattattccttatttagattgctaaaaatacgaagattgcggtttgctttaaactgtttcaaatcaccaaatctatcatcaacgatgaaagttgctgatttctttgactgacatattgtacaaatcaacataccttgtattgtatactcagttgagcaatttgtacagtactttttttcataaagttcagtactcataaaaccttcacatcagtacgtttttctctttgttcttttttaacctcatcagttctagtatcttctaattgtaacacaacttcttttagaatgtcaacatcaattgttgcttctacatattgatagtcgtttacaccaaaaacatactttactgcaacccatacacggttataccattttaaaaaaggatttaaacgcatacttatcagacattgaccaagtttatcatctccatattcctctgtcaagtcaaattgtgcaatgtgaacgcaatgctccattttatcgccacaagaacaacgtaaaatatactctttactatcttcactcatactggataagcctttaaaaattgtttaagaactccaaacttagatgaatcgtaatcgtattgatagttaagctctcgcttatcattcatacgatacaccatatgaaaatttggataaccaattctaacaggttttttaggattagcaagtaaaatcgcccattcttttactggaaatacgttttcagtcagcattttgatatttgtttcaaaatacttcatggcttgctttccgtgtttgtaatcttcttcactaatctcttgacaatcaattctatgtgtttcggtatctaacacccattgttgatcttcggtatataaatcaattacatcatcaatagtataactatcaggtaaatcataaaatacccaatgagataaaccagaacttacaccaattcgaattttaaagaacttcattctttatcaccttttacataattataacacacgacacagtgaattacaagaagaattatttccacaatgttaagagacaatacatgactctgcggtgtgaaaagtgccaataacaacattatagcaggtattgtgaatattttccaagtttttttcattttattcctttgtatatgcatatggtaaaaataaaacctctgcattaggaatgcattgtgccaatccttcaacaatagatttgtttttattacattgccaaactttagtaattttatgtctaaatacttttttatcaacgacaatccagtacatgtccattttaacagtactgttatcagatggtgttagtaaagtatcgatgtcatatgtatcaaagattttgtcgttcatataatctcctaataaaatattctcgattctctcttatatacccagatacacagttagttgtggcttggttagtgaatgaaatctcactattggacacgccatttgcatcacacaaaggacatattcccatgtacttgggggtcgggtaggtgtccaatttgtatttttcattacacaccatgtactgctgtggcaatacatctaatattatttcatattcttcatcaaacaccttgaagcatacccaacatttacccattatagttttcctttaacaccgttcttatatattcgaatgttttaacaaaccaatcatgttcgtcggatacatctacaactttaccaccatatacatagtaatggtaaaaaggtaacttgctttttcttaatctttcggctaactctggattttgaattatcttagcacaaatagcatcttgaataatagaaatacaatcatccgtcatttcaattcgatcatgcatatatttgttagcggctgcttttgctgctgcaccagatacttttctaaggtcatcatgtttttgcccagttaaaaaccaaaagtaaaatgtttcaactgaagggaaccaaccatatggttcaagtgtgaagctatgtgaagaaaagttagatagatctctacctaacttagttctagctttactataaatgttaatgtgtcggtatccatcatcagtagggtcaataaagtcaaatgactcttctgggaactcaaacataattattcttcttctcctgaaggagttccacgtagtttgtcaaaatcaacccaaataccatgctgatttttaaatctacatttctcatagtaccagctatagtcagtttcaacaccttgtgatatagatctaacactacaatcatacatattatataaatgatccctgacaatatacgtattaatcagaataacaaacaatacaataataccacagactttaggatgatccataatcaaatctagaacggaactcgtttcagtactgtcaattttactacgaccgatggcaacagctttcagtactgctaatgataccagtaatgaaataacaagaacactcaaataaattagcataattagactcctacaccaaaacgtaaaaggatgttattaacaaacacaaaatcaaatggagactttggttcagataccgagtactgaaaagtttcagcggagaaactttccctattgtgccatgttgatgaatcgattagtaattgtttatcaccaattgacgttgaatgtaatggaacgtgtgctgatgaatttatggaatacgcatttagttttccttgttcatctaatgtgatactaagataatattttttctcaatatcaggaataagttcttttgtatacgaatagattgaatcaacccattcatcatgtacattttctgcaccaatcaggtgtccgaatgataaattacgtttaactggctttgatcctggtcgagttagaatgaattgttttgttaagtaaaaattattatgttttacttcaatattaacatttttaaaattcaccactttatcatatacatttcgaaaaactgttatatcccaagtactaatttcatccataatacttatcaccagttcttctagttcttgtataaatggcaaatcatcttgatgaaatctagtcatggttttcatatacctttttcaaattcataatttcaagaatgctgtattctttatcaccaatcaaatcttcagtgaatgcagtggggtcggcatcgctatacaacttaccattgatgataacacaaccattactaagatacaatgcactcatgatctgttgtccttctttcacattttgtgctagacctgtatttgttactacaaatccatttgttgctaatgatgatgttagttctgaccattcaactgatattaagtcgcgatagtccttagatacttttatattcacaatacaagcaactcgtttaataggtggagtgctaatcgtgtacatttgtggttgttggtaattagagttgtatgtttgtggtgttttaacagcagttcctgaattttgagttgatttggtaattactggttctacactggggactgttgttcttagtgatataatacgtccagtttcatccaatttaaggactaaacgatgagtttcatcctcagagtaatagggaaacaagccaccggaattcatattttgaagcattttaattaattcataagtattttttaaaaacatagtacaccccatagaaaaggggagtacaaagtactcccaacatttaattatagtttaattgattcttgaataccagtatccattgctttcttggtacgtgtatcagatactactgtacaaaggtgttcaatattttcacttggaaacgtattcgaatcaagaattttggaattccagaagcctttgcggaacttagcataatcagtacactggtcaattttcattttctgaagattgttgaactttgtacgtcctgcttcaattgtcaccatcaattcctgataaattttaggatcaagatttggaacctgttgttgaatctgtgacattacaaacttctggtcaacaccttcacgccctttaaagtatgactcaatcgtttctttcaacgcatttttgtacttatctgctacttgaaccttatcttgaatagtaagagtataattgctaagttgactttcagatgcatcatagtactttttaatgtttccttcaaactcaactgcacgatcatgtgcaccaacatacatactaatagaaccaaacaccattagtacaataactaccaaaataccaattaacgcaaggagtttaccattcataaatcgttatccctcatataaaggccaatgaaaatagacagaatcaacaaaacaatggaagcaccgataagaacatcttttctaggttccatttttactgacaagtactcaaactctttattagagagtctctcaaactgtgtgtcaatattatgtacttctttaactagtaagtcaagagttaatttttcatttaatgcatcaatacgcatctttgcatgtaactcttcattcttcattccttgtgcaaatgatgtactgtaaaatttgacaacgttaccatcattgtcaataccaaagaacataataacatcattcttcttaccaccacgccacgatgcaagggtagcatcaacaaaatccacatctttgtaatcataaactagtacttggatgtttacctgctttcgtgcacccatcgtttttagctcattacgaaggtattcatcgtaaccatcaacgttgtaatttgtagtgttaattacgtgatgtgttttgtaataatcaactacacttgggtattctggaatagtactaagatacttttcatcatacatgttgtgtagttcttcaggactaaacaatgagttcttatcagcaaatagatagttgatatatgaactctctgcggcggcatagtcaccaatcataacttgctgccaacgtggtggtgtcattgtaccttgacggttcacacgttcaatctcaaactcacctactgtacttttcacataccaatcaacttcatatgagtaatcaaaaaccttatatgattcacactcacgatgtgatttacctttactatcatatcgcgtatggcacttctcatgccatgtatagtgcttacatgaactagattgtgtgcaatattctttgtggctgtattttgaagttacttgaccattcagaatctcaacatcataaagctggctatagttgattgcgtatgaaataccaagaacaagagccgcaccaaccagacaacaaccaatatgaatcaatagttctttagtactgatatgcttatcgtacatgtatttcataacgaatacaacgataagagcaggtattaacagaataatgaaattcatgtattaatccattttaagcttgtttagacagaatgaaatctggattgcttcacgtgctgcatcaaacagtgggtgatgtaactccaacccattaatcccacacgtatttgcatatgtgataaatttatccaactgtaccgaaacgatttcatccatttcaatacgagcttcttcattcaataaacgtttcaatgtgcgtgcattttcaggtgcatcatacttccacaactcaccagcgttcattagttttaaatggtttgcttgtaaaatactacaatcgaagttacatccgttgccccagactgaatgaggaacttcttcaccataatcattgtaacgtaattctttccagaaatcaacaatactactgtatgcaaaaaatcgtcgtgattgaccattcggtccatacagttcaggtgctttgagtttcatagtactggcaacttcagaatatgcattagggtattctttctgacatgtattcatccaaaaatccattgcacctgcgtctgattttaaaccagcagcaacttgatcctggtatggtaatttaatatataagaactgacgaatgtcattttcaggtttacttggaactactactgctgcgtaatttgggataataatatcataaccggaaagttcaggtgttccaagagcttcaatatcaacactaatatgacgacgtttcataagttagttccttatctgtacattaaaaagagtgcgttttcaataagattatattaaaaacgcactcatatgtcaactattacttgttagctttttcggcaatttcacgaagagtgtcttccagttcataggaaagttgtgcaatttcctgtttagcacgttcacgttccaatttaccttttttctcttcttcaataactgcttcaatactgtcaatcatcgttttatgtacattacgcaaggttttaatatccacaataccacggttgtttgcctttgctgcgtccaacatatttgctgcaaccattttagagttagtttccaaaagacggtttgtctcattatcaattagattgcctagttcattatccttacgttgacgctcggaaattaactgttcagccaattgagacttccatgctggaataacaacagattttaaatcttcaaacttagaaacagtgttcaagtttacttttttcatactcatcaaacgtggaccacttagctcgcacatcatgataagacgacgaatcttatcttcttgtttagaaagtgcttcacaaatcatcttttgctcttgaatagcaaaagagtctacatttttgtctgcttgcatttctaataataatgcatcttgtgttttagttacttcttctaaaccaactaatgtatcacgtaattcaaacaaatattctttgttttcattatatgctttatcaagccattcacattctccgtgctggcgattaataccagtttgaagagttttcataatttcgtcaatttgctctttactgtttttgtactgatcacctactttctgttgagcattaacaaagaatttcttaatacgaccaacaattgatttatcttcttgaagactgtcaatatcaactgcacgagtcaacgtaagaattgtggtgattgatttaccaaactcggtattgtcatccgttacattaactttagacataatttcatcagccaaacgcccaacagcagcaccagcagttgtaccaacagtattgatgttttgaactgttagagacatagtatttcccttaacatctttcagtactggtagtgattttgtagtttggttaaaaatatcacttgcatcaattgtatgacctttagacgcagttttagtagtgcgttttgctgatttagctgcggtggatgcttttttaggattgatttctttctcggacatttagtattcctcgtttaatttaatatgatgtgctgctctgtgataaacattatacgggcagcacgtatgatagtcaagtatttttttactctttgttaccatatgccagattacgaataatttctacagtactctcatccacagctttacctgtctgtgattgtaaacgattgataatcaaaggaatagtaatagtttgaatatctaccatacgattcatatcaacttgatattgcttacttgttgcaataatgctcgtttcagtcatggaggtggtgattcccattttcataatacgttctaatgttaattcatattcaaacgcatcatccacacaacgtagtgcgtattcacaacccaacttaccatattcaagttcatttttgatttcattaacttcgtttctaagttctgaaaacatcgtactaagaccactaaacttattagtgtcatacttaactgcttcatttagtgctttcatcacttttggtaaatctgatggttgcactttgatatcagttttaccaaacaatttctgtgtaaaggtcggcttcaatgggaacaacgtctccaacgcaacagtaaggttattcataagcattctaatataatcactatgctgttgtaatgctgagttaagatccaattgacgttctgaaatttgttgaatcttagttccaatttcttgtgcacaaactggtaagtttacaaaccagtctagtacttttactgaattcttttcaatagtactagggaattcaacccatctttcaatgtcatcaattctgctatcgtctgggttgataggttttttcttaagaacaataggtgcaggtacatctggtgatgtttgtaccaagtctaaacgtggtttggcacgaccttctttccattcacgatattcacgctctaatggcggtactggcatgttaggatcaattctaatattactaaaatgaattttatccttcattaaatcaagaactttcagacgtttattatcaaaatagatttcatctaatgacagagtttttacatcaaataacggattacccagcgagtcataggtgcgacgtacaattacattgtaaatgtattttttgtttgatgaacggtcatattgtttcaataaagagttcagtacataattatagttaaattcttgaatctcaacttctttgccattttcaatgaaaaaatatttacctttcattataaaacctcataatcaattaaaatttacgctatggtgatattgtacatacttcgactacacatgtcaacacctgaaaagaaaaaaggacgcaccttagtgcatccttttgttacttttatccttgtaccatacaaatgtcttgacaggtggatatttttcattctttggtggttcaggcatgtcgtatacagttgcatttctaaacttaagaatgtatgtgtccattaaacggattatacaatagtttaaacatttttgtgctctttctttccaaaaatgtttatatggttctggacaaccaagataatcaagtttatacatactcatagcaacttgcataaatctttgggccgagaattttcgcttatcaatcttacttgctctgtgttggtcacatgtccaacttgatacaccaggcaagtgacaaaacaaatcaaaactaaccatactatcaaagtatttgttatgaccatgtaactcaccataaaatacagcttctgacacagtatcatataatgagaaatttgaatgtatatgttcattatcaaaaatactttttaaatctttataagtttctggaacaggtggctcaggtaatacttcaccgaatacttcaacacaccatatcttccataaaccttttgtaaatttattttctaattctctatcactatcaatataaaaagttttttcatttatgaaaacttttctagccatgtatgctttaaaaattgcatctggatcaatgtcttcacgatttacatcatcccagcctttaccaattcttgaaatttcaaatctacgcatatacatacgacatgctaaatctttagtaaggctgcgacgatacttttcatcctgatgtaatttggttgtttcgtgaagagatttaagcatatttaaaattctcatcgcaacaccaaatatttcccgtttcttccaattacatattgatcaccacttcgtagtactgtatagctttcccctagtatggaactaagacgcgaagtgtctaattgtgtatcattctttaataactttttcacatatgtttctgaaacaaaaccgcttccagtactgtaatgtaatttaccatatgctgtttttaatgtcaacatgtttccttctttgattactgaaacaccagcataatcaaggaactcactaattgaactaggaatacccaaatcaattctctgctgtatttcttcaaaatcaacatcgattgggtcattaacaccatatagttgtattttccaacctgggtctggacaaatattttcaatagttttaattaaacgtaaaagtttttcagggaattcggcatttcgttccatttcaacataaacttgatatcgaccatctaaatttggtgtttctgctgcttctgtatcagctacatcaataggtgatttttcaataaaagaagataaatcatatgctgcatcaaaattgttaagtacctgaaacataataacaatattactatcttcaattttaggagtatattcatcaacactaatgataggatgaatcaaatctttgagaacttgcggacgtaagccttgttcatttaatttctttttcattacattccaccttcttgtgtctcatccgttacttctacatctaaatccacatcatcaccagttacaggttcttcaatattctcaggagaattcattggattactattgaattctgctgccattagtttatattcatcaaaactttctggattaatcaagtttcgtggaatctgcactctaaccaatagtactgggattctttcattttttggtatacgtacagagccagattgtgtcgctacacttttcatgtcagcttgacgatttggttctttaataggagttatttcataatcagctttaacatatactttagttccatgtttctctaaaatagagaatgcggtaggatcgggaaaattttcacgatagtatttaaatgtaacagtacaccaatacttacttacaattggcccctctaccaactcaccctcaataattcctttatacgcatataaatcattatcatcgaaatatttctctacagcaagaagtatatctaacataccactgttatcatacaactgctgaatagcattatctgtataatctaaatcgtccatattttatattatccttaaaaactagcacatataatactatttactacttttaaaatacaacaaaaggggtttgaatcaaaccccaatttaaaagttttatttgtaatatttacctagtactgaataaattttcagtctaagttctgtccagttttcgatatattcaaaaccactatgattcttatacatagtattatgagaacatcccatcataactgatggaataccaagacccatagcagtttcaatattattgatataatcatcaatcattagttttacatcatatcgtgtttgtaaatcctctaatgcttctttctttgattcattcatttctatgataataatctcatcaaagcagttttcaccaaattcacgcattagatttacatttcgtaaaacttcaccatagccttttttaccacattttgtgagtactacgaatttttctttatgaaaacgatcacgtagctcttgtacaatatcaactgtatttggttcgactggctttaacaacccaaacaaatatgattgttggttgaactgttcaagaatctttttaacttcaggttgaggaacacccaaccagtctgataaatcatattctaatgggtatggtgttgatggtgtgatattataagtttgttttacaaactcagaaagcatacccatatggtccaatagaacttcatcacaatcaaaaactatacaacgtggtttcattacatgttccccgaacaaattaggtcaatctcacacagtaaagcactaagattcatttcacggtctgatactgttgcttgcttaacaactgcatcacgaattttaactttaatcttcatcagtgtgatttcatcagtactgaacatttcagcatttctgtacaagtaagagaaaaatgcatccatctcatcatcagggatattttgtacaatttgttcacgcatttggcgaatgttgcctgcctttaatgcttcaacaattgcagtacgataccctgctgaattttcaatactatcttcaagttttactagcttaccatcaacaactgaactttgcaatacgtttagtgttttacggaaatcaggataggaagcattgatgtacttttgaacttgttcaacactatcatcactactcaaatcaacaccttctgctagaagaatattataaattcgagtcatgaattgttccatatcatgcttttcgattgtaataacttgaacacgagaaatgataggtttttgaattttatgtggttcgttacttgttaaaataaagcgagcattttcatgatagtcttccattacacgtttcaaactaccttgtgctttgtggttcatctgctccatttcttcaagaacaaaaatacgatatctaccaaaacatgatagctttgctgcggcatcgattttgtcacgaacagcatcaatgccttcatcggacatgttaagcgtggtcacatcacttggatcaaggtgtccattttgaactagtccattaattagtactttgatcgcagatgttttaccagttcctgctgggccaaaaaacccaatatgtggaatgtcaccagtcttaatccattcttccattttctggcgtagtgcatcgttttttgatacataatcttccattgattgtgggcgatatttttcagtccatagtgtggtcatttgtatttccttatgtgtacgtgttatagaatccaatcggctgaattatataataaagccgtgaaaagttcttctgtcatttccaattgatttaataaaaaattaaaagaatttgccttatttttaatcccagtactttcagcttgggctgatgcaactaataaaactttaaacatatcatgtgaaacttcatatacatatttggtattttttctatcttcaaacatgaatcttccgtttttagatactaatgttacatccttgaaactaaattttccatcatcagttatcatcaaaatctgtccaaataaaaagcccagatattcatccgagctttaattatattttattaacgaccaaaggttagcattttagttcgtggatcttcatctgaaactaaactaactgcggctggataatcaaccaagtttaattcaataccatcaacttcaatagttcttgaccatcgaccatgatcaattaaaatccattgaccttctttaatatcagtaatgtcttcgcctacagaataaacttttgcccagcgagaacgaatacctctaattttaccgtcatcgtttgttaaaacgataccacctgctgttttgcgttcaccatgttccagttcagttaccagtactttacctttacatgcagtcattactttattagtcatttaatatattactcctgatctttggttctagctcgacgtggtgctttcttctcttcagaaacctcagcttcttgttcttcgggcttaacttcaaaactctcatcatcccatacttcatccgtaccatgttcagtactatgaagttgatgttcagggatataatcaggaatttgcatttctcgttctttttcttgaatcaactcttcacgagttttaataattgttccaccggaaccgattttatcaccacgtgcgtttagattagcattacccaatgctacctgatgttgattttggtacttgagcatatccatgtcaattgttgtaccacgataagttgtatgtttagacatatcaaaatccttttattgtatgtgtgatataagcctacaataaacattatatcacatgtttttctaccatttcaaaaattcgttaacatcaagttcgtacttcaatgaatctaccatatgtagtccaatcaaaaacaaacagtatgatgcaacagagcttccacgacctagaccccaaaagatctcattttcttccatataatcaacaagccatatcatacatcttagtagctttgtcatattataatattcatataaatcaagttcatactcaacacgttttcgtgcttcatcggatgtgcatttttgtaagaaaaagtcacgcagatttatattgtcgtatactggatcatatcgccacagttcatgatttttatcatgctcaattgtataatccagcatacgttgttctaagccaaattttttacagttatcattgaatttcaacctttcaggttcatcaatttcctgcaattgtaagtactggatatctgcaccgcaattgattgcataaacaactgcgttaagattacatttcacatcaccattgggacttataaatctgtttccttgtactttcatttttcttcttctgggcctcttcgttgtcagttagatatgaatccatatcgaagatacatgggtcttcttcgtcataaacagttttttctttttgtccttggcgaagttctagttcagcataacattgatttaagacagtttgcatattaccaataatcatgtcgcttaggccagcagcacgagcagaagtcaaacgcattgactgttcattaatttttaactgtagttctttttccgtcattccagacgggtcaaaaaacggattaaacatattaacctcctatgttattgttttgcaatgtaatcaaaaatgtatctgaaacataattcactgattcatgcgaaaagtatccgaattcaaccgatgtgatttcgaactctacacctaccattgtaccatgttcattgttctgaagtaaagtgttgaaaaatgcttcacctttccctggttgacaatatgcaactggaatgataggcatgaattttttctgtataccatcttcaatgtatgggtgattcataaatcttggaaccgtatcaagcatttcatcactgatacttggtatcgcatcaacgtatagaccacgattttgtaaatcggttgggtcttttactaagttggttgtgtcttcaccaatagcctgaaaaatattttgtcgtaaaccaaataattcaccaagctgaccgttgtcgatttgagtatattgacgtggatttttggatacagatactaaagaaccttcaggtaaaacctctctatataatagatcatattgtaagttaccttgattgtcaagtgctgatattattttataattacccattaccattttaaattttccatttggaatagtagttccatttgggttaattatactatttctcaatactttcttgatatcagaaaggttagtatatggatacgtttgacttaggaagttttctttcaataacatcttcggtattttctgaagaccatatctattgtcagattgtcggaaaaatagttgattagtgaatgatgaagtacttatacatttaaaccattctctctcaaatgcaaccgaaggtaatacatgtgcactcaaataattctgtccgaatcctcttacaatcttaaggttaaatatttttcttgcttcaccaccttcagtactaaatgctttaacataaaacgataatttaatatcatcattttcactaaaatcaatacttttggcatatgcagttcctacaagatatccatctggtgtcaaatctatcccatactttctaatgtcatcaccaccatctaaaacatacgaaacttgattagagctatcagtttcaattttaggatatatactgtctccaaaatattcaccaacatgtatggttcctaaatcactatcagtaataaagtttatattattaccttcttctgcgtttatcaaaaccctgaacattttttgcataccaatgatattatcaccaagagtagagtcataatatcctaaatcaatccaatcactactatcataaacgggcttaattgttccattatcgtattcaccactaattacgtatggatacacaacattatcttttaattgatataaatgattgggtagtggtttttctgaaatagaatatatagtatctatgtcttcaggacaaacccacatttgatatgctttatatcgttgattgatagcaaacctttcactttcttcggtgtatgtacttaatatatcaacaatctcaactttaaaatatgcatcacaagcatctgagtcatataaaaatgtttgcaataattgcccatttgggttgaacaccattccagtgtcaattaaattaccatttctattttgaatattaacttttacttctttgtttataccagaaataggccatgttgattgtgctggcttgaatactgcgaaatcattcgtaatatgtttatctggaacttcagaaatatccatgtcaatcaaacgatatgctggaaaaaagacacgaggtgtaatatcagtagtcatgtcagtacccaaaatgaaaggtcgtcttcttccaaatccttgaacgaacaatgtactgttggagccatactcaacatcaccaatacaataaagctttttgtcatcaccaatctcaactccgggtgtaacccaaacttcttgactatcatatgttattgatgtatcagttaatcctagaacaccacttggtgaaatatttccaaaatacataacatttactgcttgtaaataaaaatttataatttctgtattattataggttccatcatttttacaatgaatttttataaaataaacatcttcactattagtacttgcagataagttaaattcatttttgctgattttacacttatgcttaccatttactaatttattaccagttgtaccatctgaaataggaacaaaagtattttcgtcattaccaacataaaaagtataatgtggttctggatcaaatacagcacctgaactatccaagcattgtatgttaagaatcatttctaagtattcatcttcatttaatacatagctatcatccgttgtgctttctttattgatactcaaacgcacaagaatgtcttgtccttcttgtatatatcgagcatcggcttttatatcccatcgtggggtaaaagttgtcattataattctccatagccaagctgccattatctatagattatttatataaaggacaaggaagacccataaggtcttccattaaatatatcaattgtctgatttaggagtaaagtcaatctttcttagttcttttagttcagatttataaatgtcccaaattaagtcatgattagataacagttcattgtacttatccatcaaatcaagattatcttgaatatcttgtagtactgattgataattatcttgcgtccagcgatatgaagggaagtttacaatgctttgaatattttcttccgttgcttcaatttcggtatttaacgatttaacgaattcaaccatttcagcacggtttgcaaatccttttaccttagcaatcatatcattatcgaaacattctttaattagaattttataacgaacttcagcagcacaatcatcaagtttcttttcataacgcttgatgtaatatttgaaacggaaatcaacgaagtctttaatcaaatccatcgtagtatcgtaaactttcactttgccattttcacctagaacagttaaatgttgagtcatttttttgttaatgccaaaatactcaataacatccatctctgtccatttagctgacgttccacgtggaagtttaatggtaatatcaattacatcagtactatcattgtcataatcacgaatctcaccatcatcactcattttgattagtttttcgatgaatttctcaatactgtaattaggtggtaagcctgttactttaacagtgcttgcatcaataacctcagctttaccatagaattcatacttattttcatcaagcttagtcacaacatcacttgcaccacatgaaacataatatggggtcatttcttttagtggttttttatcaatagcacgaatgcaattatcaataatatcttcaattttatgtggtagaattgtactcttataaccaactgacatactatcattaccaaacaatgataatggaataataggcaagaaatgaacaggttcatatgttgtcccgtcatagttctctttcattggtataatatcagcatcacgcaaaacaagcatctcagtactcttattctttttaacataagtgtaacgagcagatgctggtgtactgtttacttgtgtaccaaaaccaccacgttttccaataagaggatagttgttagctactggagatgctagattttgaagtgttcctgatgctgacgtgtccccatgaagatagataccatcactaatcatttttccagcacatgatactgttttaatttccccactaattttagataatgtgaagattgctttacgttgtgaactctttagaccatcaattccaggaatagcacggtctagtgtatacatcgaatattctagtgatgttgtattcacataatcagaactgttataatctagtagagttagtgtttggttatcgatattatgattttctgtttttttacttttagccattccattgtctcttggtaaaaggggaacaccatgttccccattagtctatattattccatccagttcttacgatcatctgcacgtttcttgttgaaaatcaaatcaagagtttctccaagacgtccatcatcggtgatcgctactgcaacactattagtgaatgcatcacggaagtttgctttttctaaagttcctaaaccttttgcacgcgttgctttccagcctttccaatcatctgggttatattcatgcacattatgaccatagtagtattttgattctttacctttctcaagaatgataaatggtgttttgaatacatacacaaatggattttctgggtcttgaaacaattcaggccagaatttaaataagaagttacacactagagcaccaatgttcttcccatcttcatcttcatcagcacagatgtaaagcttaccatagtttagttcagaacgttctgctttaacacctggaactaagttgatactagccattatatcatgtaaagccattgaatccattaattctttggttttctcagtaccactgacgttcataattttcccacgcaatggtagaataccatgaatacttggtatacgagcactagccatgttggaaattgcagagtcaccttctgcaatcaatagaatacactgtgaacggtctgttccagtactatccaatagttttgcaactttaccttttagaagtttctttgctaggcgacgatcttcttctgcatctttcttatttgtacgggcagcacaacgttcgaagatttcatcaacccattctttgttcttcttaactaattcatcaaaccattcggtactcatagcttgttgaattggacggattacgttttcattagttagtttagatttaatctgtgagttgaatgaaggtgctttcatagttgtgacattataaatcaacaaaccttcttcaatatcagaacgattaggtttcatcctacgtttcttagattctttctctagtgcagttcctacaccgagtgagaagaatttcttgaatgtatcaagatgtgtaccaccatcaaatgcaggagcattgttaaccaacccatgcatatggaaattcgtgttcatgccagctactgcattaggaacaatataaaaagtactgttaaaattgaatgaatcatctttaacattcaactgcattaatttagatgcattgaagagtgctttttcagtgtttcctttaatagcaatacgtttcccgttcagaaagattttataagttgggttagctgctgccatttctttaagaatactataaagtaattcggttggtagttttctgtttggaaaaacttctttactcaaagtaaaacgaattgttgttccagttttatcggtttgtacctttctaatagtaggttcgtgtacatgaagctcagggaacataatagttccttcctcaaacttctgattgaacttataaaacccatcataaccatcattactactttgtgttttatacggacgaccttggcgatgaatttctaactctgccttagaactgacaatcattgcaacagaaccacctaaaccattctgaccaatcgtttcatcacgttttgaatcgtcaaagttacggcctgtttttgtttcagtcattaccatagtacacaagtttttctgatactctggaacataatcaattggaataccacgtccattgtcactaatttcaaatgatagttcttcttcattgaaatcaactttcaaaacaggttctttggttccagcttttttaaattcatctaagctgttatcaataatttcacgtgtagcagtaagaattgcaggaacccattctacgttcttaacctcataacctgattcgccaaaaatcagtacttgactttcatgcactgaacgagaaccaagatacatctcggtacgcaaacgagcatgttgataatcatttagtcgttgaacatcatgttcctgtagaacagcactttctttcttagccatttgaattccttatcatgtctctttgtcataaaacattgtatcaccaatgttttgtttgtctcaaaaaaaaatatcggaacaatttgtcccgatatattattattttactaacataagttgaagttcggcacttggacttgattcatcatcactccagtacttatgaaccttatctggactcgcctttgcaagtacttcaccaccaccaacaatataaacttgatgggaaccaattaaacgggtccagaatttaattgcatcatcagtatgcagactatcactcagaactttaataccatgtgatatcatatccataaaaatattataaattatacctttagttccagttttagatgcagttgcggcaatttcaaaaacgttttgaacaccaagtactgcatcattggataaatgcccactaactatagcaagctgtttaccagacttatcgtaagcgataaatccagtaccgtttttgttcatatatacatcatagtctttatgttctgcgaacttaaccatgttgtgcttacctgtcatttcggcagttttatcgacaaactcgtctcggtcttgaccttgaaaactatcgaaacgttgtggcatttcatccaacttatctttgtcgtcttcacatgaatccattatatcacaagttctgtcgtctgtatcagctaattctgcatcttgtacaatatcgactaaactacgcatacttgcttcttttactttattaggaagtttagaactttttttaagatttccttccttttcatcagcggcattccattctttagcagcactttgtgaaattccagctttctttgcaaattctggattgtgtgcggcggctgcgaagaatttagcctgacttttactcttacttggcattataaactccctaagtctcttctcatttgcacaattgaaacatccctgtccaatgttttaagtaatttttctggttgctccttcatgaaacgaagtatatatttcataatatcagttattattttatcagatccaacaagatacatatttctcaattgtggagatgatattaccatacgaccattataaggttcaacaacaaattcagtgttgttaagcttgaaaccttcatcggttttctcaaagtttaatccaaccatatccgaccactgttgaactttactaacaacaccatttactgccttcgcatcatcggcatccatatgcaatatttcatccataaattcaacaacttcatcggttgagaaatccatacttgctaatgaacctacaaagttttgggcttgtttataattcattatatttctttcattctcagattcacttcgtatctgaataataatagaatccctattttctgatggcttagtaataatcatttcccaaccatgttctttactttgagaatgtattttagtaatttcatctcttgaatgaccatacaatctagtttccaaataacgagatctttctgcaatatcgcttagggttttcatttcattaatagaaactcctaaatcttcaactggtccttcttcatggtcagtacttattttattaatagtttcaaacgcatccatgaacttcttgtataaagtactcatcactgttctatactttttctgtgaagttttatagatactaataatgaatccacgtgcattatacttatcatcacgtgataatacttgttgaagtactttgttgaatgcttcttttggatcttctggtagattatcgtcatcaattaataattgtgcttcattttccatcgcatcaattacatttcccaattgtggtgtatattctataccagaacttaagtattcatcatggtctttaccataatttttctttacttgtaattgatttgatttactattaattttctttattactgaactctgcacaaaatgttgtgcttcatgatatgcagtactcattaattgcatagaagatgaatatacttctttaggaagtaatttaatgtttactcttataatatatgcattgtccgcaacttcagtcatagaaccacgttcttttgcagttgaatcagtagttataactaaagacaatttcgtttttttgatttcgtcaacgacttctggtgctaactttttaaaatttaattcttttatatactgttcagcgtcaaaaggtatttttaccgattggttaataatgttattaaatgattgtgaactaatatttttagcaccatatttggaacttaatacattaagtgtttttttacattcagcaataacattagcttttattttatctgcggcggggtgattacgagtatcagcatccatttgtatgtcatattgttgaataaattgctttatcttaaagtacaagatactagctacatatttgtttatctgtgacatagtggagctaggaactttaataatagattcttgtaattgattatatttcatcggttccttcctggtcatttccttttaacttaatcaaacgtttagctatatctgttatcttagcaccgatttgctttggtgcaattttaccagtttgcttacttctccattgtttcccttgaaacacataatcttgattattaggtgctctaaattgataccctactggtatttcaaccgttttaataacatcaggtgttaatgcatcttcccactcaccagtttctacatcataacgcaaacgttgtttaatagcatttggatttgatgtatacgtctttttggagatagaactggtttttctatatggaaacttatcacggatatatctccataaaaatctacctttagaatcaacagttaacatatgtcttactaatgattcgggtacatcatcatactcgtatatacttccatttttaaaagtaatatacaagtctttaccattatgttcaattgttttaagatgtgatgactctacatctgttggagcaattgcttccattattgctttatataattcttcataactcataataaaaaaactccaagatttgttttagatatttatcatatatctaatcttggagtttttaagtctatattttaaatatcatctgggtaatctttacgaatcagtgtttctagaacttctagtgctgaatcatagtctttaccatttgcttggcatggaactttgtcatattttaaattttgacgcagttgttcgttaccattgtcaatcattgcagcgaatgtaatacacatttcatcagtaaatgtaccaacatgatatgaatgtactgaagagtttagtgcttcaataacctcccatgcttggtcttggtccatgtggaatacttcactacaaacacactcaacatactctgcatgtgtggtaggatcatctaacaaaataaagtgaaacttaggaacatccaactgatttttttcagggtgttcttttaaaaataactctagtccagctttaagtactttattatcaactttactatgttcagattgtagttttgttacataaggagtaatatcattactccctgctaagtaataaactgaatctttatatgtggctttcacaacgctgaactgttgaagtgaaaacacttgttgttcgatagtatgtttcatagaatcgtccttattattttactttgacagtacaggttacctttttaccttggaactcgactttttgaacatatgaaacgttacccaaacgattaacgaatgattccattgcattaatatttgcttgaattactgatgcattagttccacgtcctgaagttttcattacaatatgtacatgttttccttcatcaaggaatttttcagcactttttgctttaatctgcaaatcatgctcttgtgtaccaaagttgaattgaatctctttaatactcacggcattttgtcgttgttttttaagagaagccttttcagcttgcttcaactcatatttgtatttgttaagatctgtaattttgacagcaggttcatcacctacaccaataaccaccaaatccaatccttgattttctgctaaagtaagtgctttagagattgccatgacctcacttgcaccttccgtaacaagacgtacagtttttgcggtgatttcgttattggcaataatagatttcatgtaataaaagctccaatatgattttaatgttttgttcgatagtaattataggatagaacattagttctgtcaagcactatcattgtgttttttaattgcttcacagattgcttgaacttgaacaagataagtttttgcaaattctgcttgggttcgcacacgggggttcggtgcgtctttgatcataagttctaggtcataaactaccttatcaaaaactcccttgtcttcaataatacgatcataaaatgttttgtcagtcatgtcaagaactccatgttataaaattataatttaacgtaagatactacagatgcatcagaaacagaaggaacattaagatacacgttctcatactcaatgaaatcaacagtactcgtagtaagagcattcttgatacgttgtatggttttttgtacagtaatttcttcattttctagtgcattagtgccattacctttcaatgaatcattgattagtgtttggataatctcagcagcttttgctgttttcatatcttcagtagttagtgctgcttgttctgcaacactcaaagtactaagaaaaggttgataactaatatatccaacggtgattgttgcaccagttggaatcgtttttgcagttcctggtgtagcaaattcaacattgctataaactggtactgaataagttgaaagcaaacgagaaagttgtaggtaacgcaaaagtgcaattgacttatcaatagtttgctggtcagtcggtgcggttgttggggaagatgaatcataatcaccatacatataatatgggatattatctaggttcgtccctgcaacttcaattttaaatacttgtagtaaattgttcattgtatattcttctccataatacaaaacacttttgattatttattattaaaaatcaaaaatatttacgtataacatttagtcttttagaatcgtgcattttgtctcaacataacactataacgtggacgtgtcatggcagtgtataaaattctacacttagtatcatttgtaccaatacgttcaataaaatcagtatcaaaccaaatgttatcaaaagtacttccttgcgatttatgaacagttgttgcgtaaggataattgataatatgcaatttattctttattacatagtaatcctgccacatatatggtttctttgtcaatggatttatttcttttttctcaatatccttaacaagtttatctagtttttcgtccattgcaattcttgtttctggtcctacgcctaaaatataactaccattaggtaaacggaattgccaacaatcaatccccataaaactttcacgtttcacttcaggacattgtataatttgttgtactacatatggactattctcagttatgctttcaaaaacaattggttcacctttagtaaattcatctggtacttcaaatagttgacttctaatgtaaatattagccaaattaactcgatagttagtatatgctaagattttattttcatttacgaaatcaaatatttttttagatgaacccttgttttccataataaattcacgataaacatctaaaaataaatcttcatcatcaataggtgtaatagtgcttaaaccatatgtctgatgcataatatcaaatggatttttactagttccaatacactctcgaatagcagttgcaactgccaaaatcggattatccaatgcttgacgtaaaacctcagttaactcatattgaacaggtacatcaaacgtaggagacaatttagtctctcccattgtaccttcggactcaactgggggcaattgacaacgatcaccaatgaataaaactgctcgacggacacgccacaattgatcctgaatatgttggaataattcttctgaaatcatactacactcatcaacaataagaatgtcaacgttagtattactaactttactttggggatcatgtttcagtacttgacgattcttttcatatactaattttagtcctaaaaaagagtgtattgtactaacttgtgcatcttccttagtaagaccagcattattgattagcatattacgaataacagcattggctttatgtgtaggtgaagttactgcaatattatagtttttacatagtgcttttacaatctcagcagtagtgaatgtttttccagttcctgctggggcagacaaaaccgaaatggtcttacctgcatagttgtaaacacgatctataaaatcatcaaagatttcttgttgcttatccgtaagcttaattttactcatcattccctcgactgatttttacatttcaagttaactgcctttcatttcctcggcagcagtacgtgcaagttggtcagcaaggttattataaacattatctgcatgagctttaacccattcaaatttacaacctgaactgatttcatccagaattttccataaagaatcattctttacattattccagttacgttttttccaaccagctatccattcattaattccacgaactacatagttggaatcagtgtaaacaaatatttcagggttttcatatgtatccttaacatattgaataccagcaatagttgcttgtaactccattttgttatttgtagtcattatatcaccaaatgacagtttgtcctggatttgattatcaataactacaacaataccaacaccgcctgggcctggatttcctagacaagaaccatcagtatataagtctattttcattggtatgcatccacccaatcatcgtaaacatgaacaatctcgtaataatcaacaatcgtaccgtcagataatgttttagactcaaaccttgataattttacacgcttatcatccttaaatcgaacaaaggtatcacatgtatatgtacccttgacagtactgtgaataatctcattaacgtaaggaagagcagctttataaatcttagcaccaccaataacaacacattcggggtttaactgaatcaattcaggtaaactcctttctggtaagaaaataacattactatcatcagcatatttttcaatatcatcacactcacgagaaattaagactacgttcaaacgtttttgaagtggtttttttggaagtgatttccacgtattataccccataataatcattcgtcctgatgtttcatttttaaagtgctcaaagtcagctttactgtaccaaggtatcgaattattacaaccaatcccataattttcatcagtgcatagaatcatttttgacatacaagttcctctagatctttttcattttttatacgatacatagataatatcacaattcccaatccaagtaaaggcatttcgagaaggcttacagaaataatactatgtataattgtagacataaaaatattaatataagtattttttccaataggaaacagactagttatcaacggtaaatcatttattatttctttttcttttatttttatacaatgaataagtgttttatgtaaatgtaccataaggcccaaaactacaagagagatacagtacaaaatactagcaaatccaatatatccagaacaaatgaatgtcaaaattatatcaatccacattatttgtaaaattaacatattacttctttctccatataaactatgtaaaacgtaaaaatgggtaaatactttataaaaataacaataagattggagattaacaggtatatgaatatcgacttagatagtagtataattaacaaaatccttgatgttatctcccggaatgcctgttattagaacaatagtagtgacgttatgtcttgtattggggtttgtagtttatataacttccagttcatgggaaacttatataaacaataaacttaatcaccccgaacaatttgaatcgtttaaacctcataaatatacaatttcaccagaaaagttggagagtattgataaaagcctatataaatatgtttctgcaaacactgatgatattgctatggttttggtttacaagtttgttcctgataataatacattctatcaaggtagagtacttgttacagacgaaacaaatgcatctatgggattaaatattaaatcttacaatttggattggttacccataagtgcttttagtgctgagacaaatacattactaagggggaaaatattttgcgttgaaatttctaaaatttacacagaatatttaaatcctgataatgaagcacgaaatgagtatctatcacctattaactttccagcaatagttcaagatggtggtgtttatcttgtttcagtaccgattaagtacacttcaattgaaggatatgttagtgtttatttcaaacgtgtaccacaaaatgtggaagaagctgagaagtttcagagacttgcacaaaaagttgttaatgaagtaggatattatatctcattttaaataaaagaggaaacacatgtcaacacagaaaagaatttactattctattctaagagtgttaattgtatgttcttgtatcactttgagtatttttctctttcttaataggtcacaaatagaaaatagaattaccaaatcggtaatacccagtattgaacaatatttttttaaaagttcgttggaactggataatgtaaatgaatcttttgctaaaataatttcaaaacattcagatattagtacggtggttctatacaaatttgtaccagacgaagacactaaaatgtataaaggccaagttcggactagttctaagagatcgctctggagttaggagaatgcgtactgatatgtacactttagacagaagcgatagagcatatcaagaaatatttcttaataaagttcattatgaaacaatcattggatctaaaatggaatgcagtttatactatgataattccaaagattattcatgcgatgatgttaaacatattcgttatacttataacacaattataactattcctattttagataaggaaaagtatgaagttgctggttatgttatgattacaactaatagaacattgaatcaacatgaagtacaaaatctgattaactatatcagaccgtacattcgtaattttgataattcaatacaagatattaaatgaaataaaaggagcaacattttgttgctccttttttattaagcgtatttagttagatctggttcaaagaaatcttttccttttaaacctttaccatctttcccacgtttaataacgaaaacattcccactctgctcaacataagcaccagtataattatctttttgttcaatgcgttttggtggacttgataatgtatctgcttctgcaagacgaaactcaatactttcaagggcttctttctctgttttacaaaatttactcatattactacggtgaacttcatcatatgcccctgctaggtcaaatccacttgcacgagcgaatgatacacatgaagatacaatacgaactagtccatcactgatagtgcgactatcaccaatttcaacaccacgtttaaattgctcaaaatagtcagttaattctttaacataattcaaagcagtatgtttatatagtagttggcttttacgattttcagggtcgattgtaatttcgtattcacccaatgcatcaatgcagccataagttgcgattgcaccgtatgtaacatacagaatatcacacaatgcatctagaataccaaccttagaatccttattgatagaatcaaccaactcacctgtcccaaaaatttcttctttaataagctcaattcgaagatttgcaattttagaagtttggaaagttcgagtggtgttaactggctggttacatacttccatgaactctacaacttgtttatattgatctaatgttgttgacattaccattctccataatatgcatcaccataagtgatgttgattgtttcaactgttgcaaattccatttcaatattggataattcgcacattaatttatttgtaaatgttttaatatattcttcagtactgttatcatcatacaatgattcaaattcatgaagaattgtaaatccattgtctgaactacaaacaaagcatccaacatcatgttcataaattacatctaaacatttgtcagtttgtttttggtctaatgaaaaaagctttactggaataacaatagaagccaaagatacagcatacccatccaaatgcatttttttaagagtacgttgacttctatatactttttgtttaggaaagttttcatttacttttgaaaagatatactgcatattattcaccttattttctattagctttcttggattttttagctagtttattacgagtgcgatttttagcttttgcttttttatgttctttaattttctggtctttacgaacataatatccagataactgttcaataatttttttagatagttctaaatcttctggtgttaactcatacccagttacttcttcagcagcatcaatatttttttctaccatttcatttaggttattaatgttcatcttcttctccagttgtttaacaaaaatcattatagcacacttttctgttttgttccaaaaatttatacatgtgggacaaacataatgatgtgtgtttggacaactctagtgccatcacttaagattataccattatcacaaacatcaatcacagtacccgttacctttacaccaccagtaagataaaaatcatatataacgttagcatctattgtaaaaatatctttcatatattatacccataagaaaagggattcatagaatccctgttagttagaatttatagtttgaacggtgtgaatgtatctacttggatatcattcacaataccaccaatgatataagaacttatttcagtttcttgtggtgcaacttgtactgaaccaccactaacccaatgctcagtccaaggtagtgggttactcttagatacggtatatggacatttaattcctagtgcagtcatacgcttagaaccaatccaacgaacatattgttttaggatttctgcattcagcccaatgattgaaccatctttaaagaggaagtctgcccaagcttcttcttgacggatagcagacataaacatttccagtacttcatcataacactcttctgctatttttaccatatctggatcttcttttttcagaagacgtagaatcatttgggttgctgctaggtgtaggttttcatcacgacagattagacggataatcttagcattaccttccattagattgttttcagcaaacgcccaagaacacgcaaagcttgcataaaaacgaacaccttcaagaatgttaatactattcagacacaaccaaagttttttctttagttcgtacaaactaatttcaactgtttcaccattgattgtatgtgtcccaacgcccaatgcacggtataaagttcctaatacatcaagttcatcgtagtatttggaaacatcagccgcacaatctgtgatttctggaatgtccaacatagtatcaaatacttcagatggattaggataaatgttacgaataatgtgagtgtatgatttgctatgaatcgcaccttcaaagaatgcccatgtctctataaagttctctagttcaggtagagatgcatatggaagtaacattaggtttggaccacgaccttgtacggaatcaagaagaatttgacgtttcaagttagaggtaaaaatgtgcttctcggaatcattaaggttggcaaaatcaattttatctttagatacgtcaacttcaccaggagtccagaagaaacttttctgttgctctgttagtttttcaagtgtagagtatttgttactttcaaagcgttggatatcaacactttcatcaaaaaacatatttttttctaggtgagacttctcgttaattttgaaaactgacatatatattcctttatatattttgaaataataatcccgccgaagcgggatcttaaattagattttacaactatcacaatcaccttcatccaaatcaggaagtgatggtaatacaaattgtccagattctggtttggcagcttctttcagtactttttcaacgtctacttcatctgaaccatcatttgtattatgataataaagatttttcaaaccaactttatatgcatacataagttcagttagaagagttgacattggcaacttaccatcagggaagtgtattgggttataactagtattaacactgatactttggtcaatgtatttttgtagaacaccacagatttgtagataaccaatgttatctttctgatcccatagtaaatcatatttgtttttcaacttattgatttctggaactacttgtttaagaataccatccttagatagtttcttcgttacaagagaacgtggcttttcaataccgttagtactgttactgatttgtgcacttgtttctgctggcattaatgccattgttgttgcgttacgaataccatattctttgatatcggcacgtaaggattcccaatcttgttttagttctttagttactaattcatcaatgtccgatttataagtatcgattggaaggatacctttggcatattttagattatcaaatccttcacacttacctttctctttagcaagctgtacagaagatttaattagatagtaagaccatgcttcagcccactcgttaactgtttctagtgctgcttcattataacgtaaaccacgtttagcaaggaagtatgcaaagttaataataccaacacctagtggacgatacatttttgttgctcggtcagcatgaactactgggtagtcttgatagtccaatagtgaatcaagagcacgaacagaaagatcacatgcagtttccatatcttctggtttatcaaagttaccccagttaattgcactcaaagtacataggctaatcaaaccttcaccagtattaatatcatcaaatggcacagatggtagtgcgatttcttgacacaagttggattgttcgattggtgcaattgattcaacaaatgttgagtgagtgtttgcatggtcaatattttgaatatagatacgaccagtttctgcacgttcagtcattagagtactgaatacttccacagcaggaacggattttttacggatgctttggtcagcttcgtattttttatatagtttttcaaattctttttggtcagaacagaatgcttcatatagcccagggacttcattaggactaaagaatgtaatattctttccatcaaccaaacgttgatataaagttttgtttacttggaaacaatagtctagttgacgtacacggttaaactctgtacctttgttatttttaagtacaactaggttatcaaattccaaatgccacaatggaaagtgaacagttgctgcaccaccacgcacaccaccctgtgagcagcttttaacggtcttagcagttgctgcgataaaaggaatcaacccagtatgtactgcatcacctgaacgaatctcagagtctagagcacgaatgcggcccatattaatacctagtccagctttgcgtgagatataacgtagaatagcgtgatttgatgaaccaatgctatctaaactatcaccaacgttcagtactacacaagaactaaactgacgtgtattagtacgtagacctgccataataggtgttggaagactgatgtcaaaattacttactgcgtcataaaactttttaacatatgacatacgtacagaacgatcatactccataaagatgattgctgcaatagtcatatatgccatttgtggggtttcataaattttcttagtgactcggtttttataaagatactttccttcccactgacgcatagcaacataagtaaatttgtcgtcacgcttatgtttgatataacgcccaagctcttctatttcttgaagagtatatttctccaaaatttcaggatcatatattttagtatctaccatttcttgaagatgagcagtatacttaattgggtcatactgtccatatacttgcttacgaatactatagtttaataatcttccagcaacgtattgatagttaggcgtatcttcagaaataagttctgctgctgcttttattagaatatcatgaatagtactagtttcaataccttcataaaactgaagttgtgctcggatttcaatttcagaaactgaaataccacttaaaccttcagcagcgaaaaataaaatttgatggatcttatccaatgataacggctctttcattccattacgcttggttacgttaatcatgtgtcatccttgttttttgatgtaaatttctttttttagtggaagaaaaaggcgggacgccttttaaggtttgtcccacccacgatatacaaattctatatgatatcctgaatttaaataatccgagttaactatgttaaattgcatatttccagttgtagaatcatatgcaggatcttcaaatgagatagaaataattgcgtcagttctatttgtattatttgactgtgcaatcatcgtgtttgtgccagcagctacaatttgaatagttcctgattccaaaaccgtttcggtatcatcatatgcaatataatcgatgaatactctactttcactttcaagaataacttctatactttcttgattttgtggaagatcaactttaaacggtctgttaattatttttgataccgttctccacggtgaaaattctgtaattatttctacgttttctttacctgaatttggatcagtagtccaagttctacctgcaactaagctggcggggtcagatgatgatggaaggccaataaaaacacgacccacatcagtactgaatcctatctgacctttttctaatgcatcaggtaagtctctctgtttaccagttcttacttgttgtaaagcaatttgttgttgtgccataaaaactatctcctatagtattataggattatttagctttttctttaacttccgcaatacgctcattaattagttgagatacaactgagctatctacagaagataaaatttgttctggtactaaagattttaaatgtttaacatagttggaaacacttttaaattctttagtctgtaatgcttctttgataatgtccaaatcttctttagatgaaacaacacgctcaataacaacttcatcttcttccaattcaggagcaagttcttctgcaataatttcaacttcttcagaaactttaacttgttcttcactatcaacaacatactcttggataacttctggtggtacattgcgtgatacttcatcaacactaatatcttgtgcaatttgttctttaatttcttcaacaggtttagcaccacgttgtttataatctttgatatttagaattagcttatttgataaatcaagtttatcaatctcttcttcactaagtttaattacttcttctaaatcataacctttacttactagtgcacgaattgtatatagatcttgtttcatttttttatgctgctccatttgattcaatttctccacgtaaaatatagtattgttctacacgttcaatccacatattgactgcatctttgaagtcctgaccttctatgacaaactcttgatattgtagattgttaggatcttttcttacacagatgaaaatcacaccacgttctatattagtaccaaacatttgattatgggctaatgcatatgctgcaatttgcatacgataattttcgatttgtccccacttcttaactttacgggaatttttataatccataatggttgggattccatcatgaacacctactaaatcagttgttccggcccataaaccttcatagtacaatgggacttcctgtccccatacttcattaattctaggccatgcttcttgctgaattttgtcagccattctacgtgcaagaactcgaattggcataccgccttcatggtctggctttccttccaatctaaattccaagttctcatgcataaaagtaccaactgtacatgcttctaatgtaatctcattagccttttcttcaccaacaaattctctccatttctttaaaccttcgtcattcgaggtcgcacttagaattgttgttactgacggcagattacctgttggagttgaataaaggcgaccttctgggccgccttcaattctattgtaaccaacatatgtatatctgctaacaattggtggtgtgtacatccgtgtactcctaattatagcattatattttaatttgtctcagtttttttgtttatttgctgtcacagcagcttttgtggcccaatcttcaacttgctcttcagaatcttgctcgacttcttctgaaccttctgctgaatttcctgcaaaagttacaacatcagaattagcatcctgtacaaaaggaagggaattcaaaatgtccatcattacattgtatggaacatcgatgttggttctctttttaatttcagaaatcaaagattgaacatttacttcttctcgacccgtggacactaaagacaacgcaatagtagtaatcatattgcgtatatctttaccaggagcctcttcagtaagatcacgaaatctcatgtagaattgtccttaattattttttaacgtatcctagaacacgtttaactttcttttcattctcagaaagccatgttttcatttcttcttttgaactaaagtatttagtacccacagttccgcgaatactttccatttttacaccaactttacttggtttaacagattctttcatttcacgttcagttggtactggctcagagataatgtcttcttcaaagtctgcgtctgcatccatatcaaaagttggggtatctgctgcaatatcaatatcaacatcttcacttccaatatcagaaacatctggaccgtcagtgatatcaccagttagtttaagtgtttcagtactgattttgtcttttacatccattaaggtagtaactgcatgttgtagtagatgacgaacattatcactaaaattttgtgcagcatctagaccttgctcggctttaatacggtcaagtagtgggcctagtacgtcaacacccatgttgttaataacctcagattgacgttggagtttatccacaatctcaccttttactgaaagaacaatttctgctttttcaatattagattcatttagttgaataaacttcatagcttctgcacgagaagctgcttccattagttttttatattttgacatttgtatttccttataaaatatcactcatttatttactttatataaccttcgccttttagaaagtttaatacacgctcttttaatttatacgcttcagctttcttttctgcaataattatatctaaatcttttgcttcatcatacttcgattcattaagtacgcgttgacgtttctgggctgctttcaatgcttcactaatcacattcgtgtattgaagacccgaactgattataccaagtacttttgcatctgtcaacattcttccttcattgagaagattaactaatgtaagtgctgcttcatacatcataatattattcatgataatttgtgaactatgattacacttaatgctataaactttagtagatttagtaccttgtactttttcttccactaaactccaattagtttttggtttagctggagttcgttgaactacaggttgtactgattgatgtccaagcatatgttcgttgtatggtgcatagtatggaacaacttgtgggtgttgttgctctgggtcaaccccataatccatacctgcttcatttaatgaagttaaaatagaagccatagcaccgatatcaccaccagttttatatggaacccccgatgcgttatgtgtttcaccagcttcaatgtcatttaatccacttaacaaatcagccatctgattaactgattgttgatcatattcgtaattcatttactactcctaactgtttggtaagattcagtaccgtcatcattttctattttatttagaacaccacgtgataccatcttatcagctaattcctgataatattcatttaccttttcaactggaacagtaccacgtgcttttatcttttgtaatagtttatattcttcattagaaaccattgtattgtgaccatgcacatttagtactgttctcattaacgacctcgcatacgatgacagaaatcgataatttggtctaccatgtcatcattatcagattgtgatgtgtttgccataacactttcatcaccatagatatcatcttctttttcaatatcagaaattgcatgtatcatttcgcccatacctggtgcatgatgtgacaatggtgatggtgtatcaggattactatcaggctctaaactggaattagccataagttcactgttaatttcttgtggagatttttcttcacgaattggattattttgattatcaataggattaacatcactcaaaggaaaaacgttcaactcatttggcttggtcccgcttttagtaataactaatgattgctccggtgtttgacctgggtcaacaccaactacaggttcaaccgaatctgtcccgctttgtgtaccaggaacactaactttcatattattagcatttctttgcaactcagcttgtttcattttagcttgagtttgtggattgacttgttgttgaccctgagaaacattcattttagcaatttgttttgcttgcatttgtgtggcttgattttgtaaatcttcaaatacaattgcttttaattcttgtgtggttagttttgttatatctgaatatgtataatttttatgatactcttctgctaattgctttagtgacattgaatcaacaatactatgaagttcagtactttcattaatatgtttgttaacatttttagtactaaaataattataacattcactcatctgtgctttgtatttttgtaaaatttggaatatttcacgattgtcagaattatcaatcgcagaatttaaagtgataaaatcacctgcatccatattatcaagaataacagaaacatcaacattcaaattatgtgcatctgcgaacttttgaagttcagttgctgtttggtttatatccataatttctccatataaaataaaaagacctctgtcttgctttatgatatttatcacaattaagaaaaggtctgtttgctgatgctaatgttaatatcatcaccagatgtgataaattttgttattcgttttccatttaattcggttggtagaaccaatggtataccattcaaacgaagttcgacatccattggtaatgcgaatttgaatgtgcttatggtacatcttccccaagaaattggcatgttataaaaagatgaattattatctttatataaatcgacttcatttttaacaacgcttaccatcattggatagtcatataccataatagcttccaacaacctagacaagttcatagctccagtgaacttagaatctatgattgttggggttttaccatcaccaatatctactacagtgtgaattgtgtagaatgtatatggtttcattctttgtccttatcttttttctctacgactttgtatccaaagaagttagtaggaggcaatctacgatgtaatggataatgtaaaccagtactgactgatgcaatagcacctgctgaagtagctccagaagatgcattttctttgatattctttttcttcatattaatttcctttattacgtttttcatcaagtgctatattctctaaccctttttgaaactttttataatctcggttttttatacttagaaataagcgtttttttaaatcttcagcatcagtttggttaaactcatcttcaatgctctccaataaatgaatcacagagtttattgcgtggtcggcacgattactaaaactctgtaatgtatctttctctggcgtatagtcaactatactatcaagtagattctttttattggatttactagacatttatcatttcctttgatttaaccattgcttcattgcatgaacacgatcagtaccagcatgtgtctgtggattctgtatttcgttttgtgtcgtagagttaggagcactatcagtatttagtgttactgtattgtcaggttgcacagatggtgatttagctgcaccagaaagcgaatgacgtaatgtttgcatagtgctgggtggtaacgccatgttccctccaccaatcttagaaacaccgctgtgacggaatccattaccttcggtttccatttgttgtactgtagttgcgtggtcaagaactctcaatgaatcaatatcataagacatacgcaaacgggaacctactgcactactgttacgtgttttttggaaatcaaaccatagttcgccagtttcttttcgtgcctcaatataaattacgttatcagcagtataaatttttgaaataccgccagcaatctgactttgacttttcttatcttcgtccataccactacggttaaactgagatgcagtgaaaacagttaaatccattttggttgcaagtgcacgtaattcttctgatacaaacttatctttagtaaatgtattggatttatcatttggtccaagacgattagaagttaatagatccaaatagtccacacatacataatcaagtttgatttccatcttaatttgtaattcacgtagataactttcaatatcgtcagtggttgttacagattcaggtaagcgtttaatacgcaacataccactgtttttaccttcaactttaacagcaaatccaatcttttcagcttcattttttacgttactgagttttgattcagtcatcataccatagatacgaacagcaaccaactcttcagctagttcaagtgaaatgtatgcaccattcataccagctttcgcaaagttaactgctaaattttgcagtactactgatttaccaccacctgatgcagcagcaaagatctctaactctctacgcccaaatccaccgaacagtttgtaatcaagagtttcccaaccactcttaaatgacccttgcattgtactgagtgagcggattgtatcttcagggttttcaaaaatgtccaaacctaactcattctgtaccgttaccaacattgcttctcggattagttcttcgattccaccatattttttctgatggacaagttccattcctttttcaacggctaacgctaatgctttatgacgacaaaattcaccacaggtatcaagtactgattgtttatgtaattcttgaacttcatattgatcgtattgataaccacctttaacttcaatatctttcaaagtaggtgatgaactatattttgcagcataatcatgtacgtattgaatactttcatgaaatgttttatcaaaatattctggtttaaggatatttttacaacgtacatataaatcaggattactgaaaatctgagataataagtattgttgtgcattaatcccatattgtttcacatccactgtgctttgaatcatctatgttccctcattatatgtattacatccatttatccgtttgagctttaatataaaatggctcatctactatactatcatgtattaattgtaaacaaaataacctaccaaatcgtgcacaagcttcttcaaagtctttgatatgacgtattgtactaccttctcttacagcaccaaagtctgggaaggaaacactgaatccattttcaagtgcttggtctatagttattaatccatctttatctctatctggaacaataactatttttttacctttttgctgtgcatcttttaatacatcaatctgtacgtttgataatttaaagttattagcagatacaccacccattaatgctgcgtctaacggaccctcacatactaaaattgtttttattcgttcatcttttaataaatcatagttatatagtatattagtacttacttgatttatgaacctgtatgtacttccaggatcttttaatttatgtcgtgcagtataaccaataattttaccattcatgaaatatggaataataaatctgtcatacattttatgttctttattaggtgaccaatataattctaagtctaacagatatgggtttctttcattgacattatgcaaaacacttataaattcttgtggaattttatcttcaggtaaagaagcccattcccaaaatgtttttgcatttgatggcaaatcacgtactgttactcggtcatacaattttgatgcaacagtttcttgtgcagcaaaatcaccgctgtcaaccatttctttaatataaaacttaactaattctatttctttatcttgtgcaccaaaagaaatgagcaaagactccatatctttgctcatatattttcctggttgccaaccagtttttaaactacagttaaagcagttatatgaaacggaaccatctgcattgaacatatgattaccacggtgctttgtatccggccttgaatgtcctctgaacacacaagctggacagttgtgttgtgaccatgtaccaatcgcaggtactggatcattcataatttgtgccattatgttttgtacagcgttcataagttaatccttgtcttttcttacaaatgattatagcacaccttctagttttgtctcatctacgtatcaaaattttaggtactgttaggaaagggtcatacacttttcggacagcagcatagtcatatggtactggaacaattttgggatgaatagcaaccaccaaacgtaaccacatataatttcctttaaaattaaatgcttgtattccgtcaagttcttttggaaaaccttctgaatcaattccattttcaatataatcctttccatctaatttaataataaaccatttatagttttcattatcattaggtacgttgttacacaagcacccttgtagctgtattctaccaataaatttatcaaaatagattgcaatactacttaatccatctactaatccaaactgcatttgtgctggtagtggagttgatgcgagaatatcatattcaccaatcataccatttccaattggttcatgatataaacgctttatagttgtccatgctggatttttattaactgatatttcagtactggggacaaatacaggtgctgcttggtctgaaattattagctctgctgatgcctcaaagttcatccctgtgtatagatattgtgttggttctataagtgaaccatccattgttactttagtaatgctccatctatattttgaaccaggactggtatcttgaataactcctgctggaacaatacatccataatatactttctttttatttcctaatgtttgtcttccttgtccactttctgataaccaactgggttcttgtttttctaatacaacatcaaatagtttagtattatttcgtgcatcaaaaatcataaatgtaagatattcattatctttcaataaagtatattttccatcagcgttgtgaacagtaaaagataaattattatttgcccctctatatatagttagtttttcattgctatatggcatattaaaattgcccaatgatacttcctgattataagggtacataaacacgccgtgatgagccatagtttttccttccataaataataggtataaatttatactaatatttatggaactaatatgaatcaatataacactattccaccattcattactgtaatccagtatgatggtaaaacgtttgttggtatcatcaaaatcaaaagcaaacagtatacaactctttactgtttcgatgatatggatgattcaatgcaagacgaattgttaggtatagcacacgattggtggtggcaaagtaatagaaccattccagtttgtctattctttcaagaagagatggagaaatttgaaccgtacacacagagattcgatacaccgtcggtgaatttcgtatgtggtccagtagtttctttaagcaatttgccacagaaacgcatcaagcgtcgtaatgtggctcttaagaagaagtaagatgttcaactaaagcatttagttgtacaacaatcattaagctatatgcgtaagcatgtggctttttgaaatatcgtaatttatttcctgcttggtcagttcctatagtactataatcccatatggtagctttaacttcgtcccatgtgttcatactttggcactgcctttttcctgggcgaatcattgcaataaacattgctagttcgtctatagatttaggcttccatacatttaataaagttacatgttttttaatttgcgatagatgttctacaatttcgggttctaacaatagatcccaatttggttcctgattcattagttcttttaaatgctctctatcacgaacatacatgtaagctgactgtgaaagaatatcaactttttgataccctaacctttcagcttctttatattgtatacttgccaatccagtgattgggtcaataggtatattatcaaaatgaacaccactattatgggggattaaaccatcctccgtaattttttcagtacttcgcacacatggaagtttagcgattacgcttttactatccttgaagtcaatgtcaatatcagttcgggcttttctataatgtttagaatcggtcgaatcctgcattttttatttgctcctgtaactgtttaactgtattagtcaaagttgatatttgattctctaataatctacaattttgttttgtctttgccaattcttgacttaaactgaaaaagcgttcttcgtgtctttctaccaaagaaataattttttcaatacgagcaggatcatgaacttgaaatgttttaccatctaaagttatttcagtaatagatccttgtctaagtagagatatttgttttgatttttgttctttaggtacaggtacatacccttctggtattttattatatatactttttccattcataatcctgcctcacatagcataatcttaatttcatcacaatcctttttgtattttatagttttgatttcaaaataacttggatcgatgtatttaagtatatattcaatttctgagtttgatagttttttaaaaaacttattagtactttttttaggagcaagccagataatccaaggtgaaattttaccactctcaatccatgcaattgcacgggcagaacttacattttcaaagaaagtattccattgtacattcaaattttcagcccattcaaccagtgagataacacttcttgcaattgcttcttttgggtgctcggcacgaattgtttttaatatccattcatcttttgctttatatgtactccattccgtgattggtttgttattgataatcaagtactttacaaactcgtccacattaataatatctctattattcaaatagtattcggcaaaactataaaaatcattaaagtactttgactttataaaagcaataaaaggctctacgccttttttaaatgggaacttattcaattccataaattgcatatatatacgaaaagcctccatcatctggcggctttggcggtcttcgtatcggtcacgttttatacatttatgtgtgtttacagtttcttcacgtttaaattcacgatcacaaaatctacaggtatatacttgattacttgatttctttgccatattttttacattcttctttaaacaatttcatcatagatttcttttcattatcttgaaaaccattattgtcaagaaatgtctcaaatgtttttttatcatactgcaatagaacaattttgtactcatcttcattcatttgagtagatatagtatcaggttgtgagcttttaattaactcaaataattcgttatttgcctttttgaaattcttagaaaagtttaaccagttacgtggcatttcttgtccaccaatcatatcatggactgaacacataagctgatatactaattctggatgttctttcatatcccaaaatccatcattaaccatatcatttagcataataagttggtatttgacaacttcagtatctactaatgaaacaatttcggaacctgatacgccaaattcgaccattgaggatattaatttttgtgcgtcatcttttgattggactgcaaatttaatacgccaatcataatcactatgacagtacttagttactgatgaaacatttgtccctgaagactttaattcagtaactagttcagtcagtgcttctttaccaccagatttccattttccaaatacactttcaactttactactagggtaggttacttgtaacgaatcatctaaagagcttacccatcgcaaaacagtatatggagtaaactcttttcgttctttttcggtcatgtcattatagtacttataatcagcacggtcaatgtgttttagaaattcagcaatagaaaaagaatgctgtgttggtttttcatcatcatcgaccgacttatttttaatatcactgaaatcaaacactattttatactcctagatacaaatcttgaattttttcgttttcatctgcaaagtacacacatggtggattttcaccactatgtagtgggacgcatagtaaattctttttaggtaacattggtatctgccactttgtagttaatgcaaatacacgtagtactttgactggttcaaacttaggatacattgaacggataggattgtaaacaaaagcttttggttctttcatgttaagaatgttttcaattgtacacatctcaaccataccagtttcttcatcacctaacataatttgccatcctagaggcacttgaataatcttttcaccaatttgaagatcagcactaatactattaaatgatacggtgtttagaatatgtctaaaataaaaatcagattcaccatttgggcttagatccaaaacacaatacatttcttcagggatatgttctgttactaaatccatgtcaaaagaattattttcaggtgttaatacgttcatgtcatctccttagtactgcgaatcttcttcgtcatcataatattcttcatcatcttggtcttctaccccataaaattcaagtccataagtttcacacatctcttgaattttatctacatcagtatccagatatgaatcaaaattaccacttagacttactacatcaataaaagttttcgtgtcagtacttgcatagatgatatcatatttcaatgattctactttagaatcaattcgtgtctgtaattcatagatattaatccaagaatcactatcaatattacatctccatacgttagtatcatccgtttctagctcaggtatatagtcaagagaagataccatgtcatccataataccatcatcgttcaacaatacatccataacttctaaagtttcttggtcacaaataaaagcaatactagatctcaattccattttattttacatccttgttgttgtcatatgacacattatatcacaaacagcgggtttatcccgctgtgttttcccaatctttaacatctattatactatgaggatattgtgcttccttatagtaagctaaacgttctcgtaaatgcttggcactatacttattagaaccactaatatcatatatttctacgtggtctttatcttctgctcggcgtaatccacgtccaattgactgtatagttcttacaaaactttttcctggctcaatcaatactacattatataaccttgaaatactaatacccgtactggcaacgccgtatgtcgcaataagtattttattatcagcccaacgaatttcaccataagatgattctcgatctttctttttagtttctccacgaacgaattctgatttgggaatgcctaaaaattcacatagcaactcacctgcttcaagtctatctactaaaactaaagtgtttcctgattcagataacgcagatatcaatgacgctacatatgccatcctatctctgtcagttactaagtatttcaactcttcagcatatgatgcaaacttcatactactttttagtttgatgcaattcacattacatgtacttagtatttgtttatcttgtaattcctttgcagttattttaaatataacatcaccaacattacatttgattttcgcggcaactaccggatctttaggaattgttccagtaagaccccaacgtaatggtacgttattcataactttagaaagtacttgaactaatgcgtcaccgcctgcaccttgacactcatcaacgataacacaaactactccatcgataaaatcattcacgtcttgttcagttaattcaatttcacctttcttggttttcttccatagagagttaaatgattgccaagtcgtaatagtatgttggtgaccaaaatctttttgtgaaccatagaacatgccagtatccaacccacacataatgtagtcatcatatgtttgttgtactaagtcagtacttggtactattataacagaacgtccatactcttgcactttctttgacaatgcagcagtaatgagagttttacctgcaccagtagctgccaatagtagtccgtgtggattagccaaacatgcattaaccgcattaacttgatgttcacgtagttttatggatttaccttccatgtggtgtcctgcaccgaatacaacatcactaaaaatatcttcatcaatggggtcaaatttaaatccataatctaccctatgatctactaattcaatgtcaatcttagcttcatcaagaataggcaataacttatctaacatatgataataagttgtcccgcctaaattcataaactgaactttaccatcccaacgtccaatacgtcctgctggtgtgaactttgcatatggtaacacatattcagttgcacgaatcatcttttgtctaattgagggatcaagtccctcaaatttacaattcacctcatccaataaggttaacttacaagttttcatccatgattacctttattaattagttcgagtattatattcgtactcaaatgtatatactaaatctttatcacagttagggttacttgcatctaaaatgtcactattagcaatcatccattcaatgtaattcaatggaactgtactcattggctcacctttgtgtttaccaaatggcatgaattgataacgcattggtgtgttgcagaaagttacaatttgctcaccaatatcaccattaggctcaatatgtccacgttcgattgcaatttcaactaatttgattagaacctgataacacatgaacacatcgtcttttgctgcgtgtgcattaacaggtcgatgaacatcacgataacatccaaacttataccacaaataacttagagttaagtttttaaattcaatatcttctgcgaacattttcttagcaagacgaagggtacaaatccatttattttcatcaagtaagtactgtgaaattgagttacgatatttatattcgttatctaccatcattctacggtcaaattgtacattatgaccaacaaaatacttacggcatcccataagtgcatcaatgttatctaaatcatctttatacccaacacaattagctacatcctcagtactgataaagtgcacagcagatgcctctggtggaatatctttcaagggtttgtatctcaatgtatagttatcaatagtatcaatgttttcatgtgaagtatgtggatacgagatactaaattcaataatatcatcttcactctcaaccccagtagtttcagtatctagaactgctacatttgataaaaactcatttaattttgtcattttattctcgcatagaaaaaggacgcgatatgcgtccttaatgataattattctaaacgtgcatcctcaataccagcggcacgtagtctcacaatattgtttaactgaaaagctttcatctctaaggatttaacaatacttgaatatgtatttcttatataagatacctcgtttataagttctgctaactcacaaacatctttatcaccttcaacatactttttacagtcagatgaagatagtgcacggcggtatccttcgagaaagtatttgaacttctcggcttgtacctgacgcatttcaatttctaacatttccaatactgcttcaagttcttgaagctggcttagacgcgtctcatgccagccaggaatctcttgagcaattttttcaatgatgccaatcttctttacttcacgacgagcttcttcaacttctttgttaaagaactcaatcatttcaataattttagatttatcatctttgataatccaatgccaaggtttcattattcctcactaatatccacatcagtaccaaaagtttcatcacctttttcttcttctttaacttcttcaatcaaaggatgatttttaaattgatgcattaccaaatcaagacatgaatcttcattacgcatccactctttgcgatattttagaatctgttcgccagttacaatatcaacatacaatagacggttacctgatttagtgattagaccgtatttttcaaacatatctagtagaccactacgtgggtccatacctttatcccaaggaattttaatttctacatcttcgaacggcttgttgtaacgagtcttcatgactttacatttagcacgaataccatttacttcggaagttttatttccgtcttcatcttctttaagttttaatttacccattgcgataaccatagatgaagcataaatcaagccactaccacctgaaactttaggatctgggttaaacatgtcctgagattcataactgtggttaacgcaaaccataccaatgttcaatgaaccaatagagtttacacagtttgtgatatatgctttaagctgtttgggtttatgacccatgtcacctttaaggttacccgctttcatttgatcattggctacttcagtgtttagcataccaattgaatcaataataaacaatactttttgacgttcatctttaggtgtattttcgtattctttacgatatccttcaatgaactcataggtgaattttgcaacgtcaccaatcatacccatattgactttcaaaagtttttcttcagaagtgtcaacaccaagtgcttgaagccaatctgaatccaatgcgttctctgagtcaatcataacaacaaagatgccttgtttttgagcttcacgtgcaatattaccagatacgataaaagatttaccactacctgattcaccagcaaacatcgttactttgcctagtgggataccacggtcaaaatagccactgatgcgataatttagtgcgtagttaccagtactaacccatgtatctggatcatgaaaaccaacactaacaccagtattctttttaacactaccagtactgtttttaagaatgttcgcaaaaccacttgtcattttcataattcgctccttgaatttcatgaaataaaacggggcaaactccgttgccccttaacttttcaaaaactattacttaccttgttgtttcaaacgagcaactagtgcagatgcagatagttgttcttttggtgcttcaggagtggttgctgctggggtagcgactggagttactggagcagcttgtggggctggtgtaactggagcagtaggtgctactggtgcaggtgctgactcttgttgtactggagcaggagttggttttgattcagtaacagttccagagttaggttttggtacacctgctggacgatatgcaaatgcccaacgtgctggatcatatgcttcaccatttactgatgcttcgaacatttcttcaattgctttcaactcttctggagttggttgttttggcataaaatcatttagattgtataggccatatttttcaattgctgctagttcttcttcgtttagtggacgctcagacatggagaattgagacatgtcgtagctattataaccaccaccattcttagttttaacaataccaaaatcacgaccttgaacgtagtgagttggagactctttgatgcctggatttagcaggatggatttaactttatcaaagatatctttgttagccagaatacgacgaattggattttctggtgcaatgtcgtcttttactgcaacgctatcaggagcaataaaacattgcattagataggttttcttcttccagtaacgaccagccattgcttttagttcttcgttccctgtttcattcgcactttggaaccattgacgtacttctttcagaaccggacaggatttaggaacccacatttcgttacaaggtacttgaacggtaactttatcagtgtgcataccgactacaccattgaaagttaggttaatcatgtcacgttcacgccagaagaatgggttagactcatctgcatctggtagaaaacgtaggtttagtggttcgttataaggtacgttccagaaagctaagaacgaatcagctttacgctcaccagtaaatgtaccattcttttgagcttctgctttttcttgttctgcttttaggtgtgcacgaatttcagctagagatttcatatatatcttccttgattttgggtttctttgttatttgttaattggcttcaatgtttcagaaacttcattgttccttcaacgttttacattatagcacaggtttttatactgtcccatattttttaactctgtttgtcaaggctcatcacctcgacaaacatcattatatcactcactatttgtttgtcccgctattttttaccatttgcccattccttgagcgattcaagttcaggctctagtaagatctgctttttcggtttatttcctaaaagagaatttcctactgcaatgataaattttgcgtcagatggttccatgtaaggtttctcacatatacccattactgcgtccttaataataccatcttgaatcaaatcaacgattttattaccaaacataaggactttattttcatcatctggtatttcaccaaattcaaattcaccatcaactggtacacaacctaaacatacacgttttgcacttcgtgttatttctttgggatctgagatgtcagtactgatattttgttgtattgtatttaaatattcagataacattttacactcatcgagtagaaaatacttcgcaaaacttctattatggtcgtgatcggagccaagtgttcctaacttattagcaaaattatctatgtatgtattaccaattctcggtagttccttgtgtgtactcagttgagtctgatatccacgtggtgttccagcgagctttaagttatttttcaaattattaatgtattgcatagttttggaagcataatggcttcgaccaccaatttctagttctgatagcaacgcttttaaattttcaaggtcgcgtgctgaaccttctatataagacccaaatttatcaccatactcgccaccctcatttaaatgatgggtcattgctcttgctgcatgtaaatttgtagtactcattcgtctacgttcaccattagattccacaaaaatctcttttatgtttctagttcgtgaacccttaatgccttcttctacacgactcttatgaaccactaccatctttgctcttggtagtttgtaataagaacgcatagcacttccatcaaggctttcatttaaatcattttgtttagtttcttccatattacgcatggcaatgtgagagaactttttaggtaaattcccagaaccaaagtcgtatacagtgaaaccatatccatattgattagcaacgtttttaagacgttttaaaacttgtaatgtttgttcatcttttatatcagtacttttccatagataaacttctgggcgtactgcgtcatcaccacttggtgcttggatcataaaattcacaggtctaatataaaaccacttagcttcctgtggactgatagttccttcaccttcgtcattgaacatagtaatactatattcatattgtggtgctgccaaaatcttataaatgtctgaacaaagaacccctttcatcatagtggtgtctccttcattttttataatattatttatcggttataagtcatcatgtacccaagtggcataaaatatgactcatcgaaatcttctagtgtttctccaataacatcagcagtattttcttcaaatttagaaataatatcaatcatacgcacaataagtagtgttgcacttactaagtcatctttacaacctaattttgccttaaaaacaccgtcttctgaacctgcacgtataaaatcgttaagctggcgatgtaagtttttactggcaacatccattcggaatgtttccatcaatttttgcatatgaatacatgcagtttttttagtacttttagttgtagtcattcccttacgaatacgaccagtgcgtgttcttcttggttcattgattaatgttccagggaaattctcaatacctaaattctgtacagcaagaattgctgcttcacctatactgttattttccaatgtccagaataaactatcttctatgtttctggctcccatttcttgcatttcataagcaatctgcaagagtattcgtcttaaaagttttacttgatctgtaatcaaatatttgttgtttttccattctgcaacttggcgtaaggttggtaattcatatacttggattgctgcgtcatcaccgccagtaccgccacttgggtcaagccccacaacataagtcattccatattcaattggtttgaaccactgaatgtcatcagttactttaataggttctcttacactacgttttttaatttcacttagtttaataccgtcaattaaagtttcttggtaagttacaaactcacaattgtattctcgtttaaaacgcgatgaaccgatcttatattcttctttagttgcccattcttgtgtacggtcagggtgagaatcccaacgtaccattatacctttaaaatcatttataccagttccattaggatcgtattcattaccaccttcatcgacaaaacgctgggattcgttccatatagaagcaaactggtcatactcagtgtttggtgtactagtgattatacaacgacctttggatgatacaagtgttggtgatactgctgaccagaattccgcttggaaaccttcaggtacgaatgcaaattcatcaagataaagtaagtttacagaaagaccacgggcagcagatggtgtagttgcacgggcaataattcttgatttattttcaaagcgaacttcagttacgttatacttttcaacaccatcacgtataaagtcaggacacatctcatatgcaaactggatacgttccataatttctttagcagttgctagaatgttccctaacaataaaattgtttttgtagagttaaacatagcataccacaaaataaatgctgctgcaacagtagttttgcccatctgacgagccgttaacataatgttgttttcataaccttgaaagtttcttaccatttccttttggtaatcatatggcttaaaaagtatttcaccacctttactaacaatgtaaaagtaattttccataaagtaaattgggtcagcagcacactttgctaattcttcctgttcaaagacggtatagttcatctttagaccaggtttttttattcgagtatattccaactcatcttcataattgtctatattttccatcatatttccctttcattaggcaatattcttcaaatttatgaatgcctaatatatttagcattgtttgttggtatgaaaacaaatcaatactattatgtaagaaaaaagggagatactctacttctggaaatttatctaatatagagaaaaaagataatgaacgagaattaattattacttttatatttttacaatatctaattgtatctatcatggcattgaagtgttcatccctcatatgcgttgacatatcaatgataatttcactcctaccaaatccgcgtaaactatcatctgataaagatctatataatatttctcctataacagtacttttacatctaataatacttgatgaaccagtatgcataactgatagttccaaatcaaagttattattaatatttgatatcattttttcaaaatgaaacttcattgattgtatattagctttaaacgaagttggtgctgatataaccatactttgacgttcttttgatttcaaaatcttgtaaagtgcataagcacctatagattcggtagtaccaattcttggaggaactacagcaacatacgtattatcagatttttctaacattctatcaaagatagttgaactatcataattcgttaatgtattataagttattaaattatccataacaaataaagggaagtacttttcaatatacttccctaatctccttataagtttttttgttgataagttagttccataaatgttttatatggaccatatatatcgtctttatgttcatcaaatgtatcagtactgattgtacaacgtgggttatatgtcccagcttcggttttaacaagccaccagccaggataaaaacgttttttggatttttgacttttcttaaaagtacacaatccgctgtctgtttcttgtacatcataaacattatcggtttcgttaactggataatctcctatgaacttagtatttgtatccttaacttgtacttcttcatatttaaatggtgttcctaatagttcttccaactcatttaaagaatcaaactttaataccccatctgacgtaaaaaattcaacacctttatattcagttgggcttctatcatgatctattagaataccaatcttttctgaactatcagtttccgcgatataagaataatcagttaatttttttagaattgccatattactcatccttctttgtgaatagtttaatatatgattcaggggaacgttgaacgtgtactaaatcatacttagcggcaaatcttaagaaatgaacaccgattaatgggttatttttaggttcacggttaaaaataacatcatccatcatttcaataatttcaggtggttgtttagtcaaatcaaccagtacttgattatgtgcatatgcatctttaacacagacttcaactccatctggtctagtccatttatgattcataaatgaattccatgcataaccgcgagagtgacgatcattaaatgcttcttcaatacctactgcttttttagtacttttcattcttgcaccaggatatgcactgaatacattatctgatgtatcacccttaatacatttttggaacaataaaaactcagggttaggagtttcaatcggttttccttttttatcatgtgctggttcattatttttatcaaaaacaccagttgttgtatacatcatttcttgtactgggttatattgacgaacattaaatgcaagtaattgacggaagtcggtatcagtactgacaatgatatggtcatcttcaggatgtgtttgaatccagcgagcaataaagtcgtcagcctctgcttctggtgcacgtagtaaagtactgttagtctgattatctacgaagtcgatgaaatcattaatcatttcaaacatcacttccatttcttctttttcatctttagttttgctggctgcttttactgcacgatttcttttataatcttcgtcaaactttttacgccatgatttaccctctgcacagaaaacaacgtgattaggattaaacatgtcttgtagttttcttaaaccgctcaaagtaatatgtagtgctaaccccacctttgtccatatgtcaatactttgagatgatacgttgatactacgatggaaacagttttgagtatcgacgagtagatataattttttcattgtaaatccttttaatagtgttgatttggcacatgaaaactcaattttcattgataattatagcacatcttgaatcactttcccagatttgataaataatatcatagaaattcattaaatatctcagtaaatttaaatgctagtgatattttttgataaataactttaagcaggatatacctgcacaaaatttgacaaggagattttcatgagtcttaattcttttaaccgtaactatggtatgtctagcgttgctcgcgaatggtggggtggtaataacggtttcgttaccatcgtaatcgatctaccaactgatgttgaactaggtactaccaaagttacttctgacggttctgatgttcaagctgaagcgtatcaaactgctctaagtaatgctcaatataacctattcatggttacccaactactacaacaacgtgcagttctagttactacctctctactagctcttgattcagaagttgttattcctgctgatttcaaaaatgctaatccaaacgtagttgcgttcggcactagtggtgctgatgtagcaggtggtgctaattctgttgcattgactttcatctgtgaacgtcaagacgtatttaacaagcaagaagttcgtcctggttcagcatgtcctgctccagttgatccaactgttgacctagctaagtctatcgctcaagctaaagttttccgtaccaaaactttcgtaagtcaaggtactgatggtgttggtgatgcaggtgcatctactgctgtagcaattaaagtacgtgctgctcttcctgttcaactataataggaggatagattatgtcatatactaatacttcttttgaacgtatcaatggttattcctttgaacgtattctaggttacttttgtggcactaacgccctagcatccattgctatcagtaagctaggagacgtaaacgttctagttactggtgcagtttcttcttatgctggtctacaacgttttctaaacactgatattccagaagaaattctagcatatctaaatgataaaggtatcaaacgtattgatggaactgcatttgttcttggcacactagaagctgattacaatgcatcttatgcagcacaaactaacgttaaacgtattgtcgatgttgttcaacaacgtgcggttatcatcgctacctctaacatcgcaggtaatggtcttgaagtatttccagttactggtttcaccaacgcacctgatggtgtattgagtgcaggttcagttagtattgctgatgcttctgttgttaccttcctagttgaacgtgcgggtgtctttaacaaagatcttaaatcaccacaaggtgtaccaagtactgaatccgaagaaggccgtctactaattgatgatctaactggtgttccactacttgctaaagatggtgttaccgaagtttacctacgttcccaatctgctgatgcagcaggtgatttcggtgttaaacttttccaatacatcccagcattggtttaatatttttcaaaagaaaaggagagcatttgctctcctttttttatatgttatctatatgaacgaaatccttcaggcaaaccaggtagcttgtctaatccttcgttcgcactcaccagctttgtgtcgtaatcatcactgaaatcatccgtagcaagtttacgccccaagtctctcacaaagttatcgataatttcttcttcatcatttcctggatgaccttcagctttcaactttttccagaaatattcattatagtcaaatacaaactcaacttcattagtttcaggatcaagaacaacatccaaatcaatccaaggttctttacgaagtgtgtatatttccttagaatattcactttgtgtgatttcatcgtaacgatatgcaaattcaatagccttaagccttttttcatcaccttctggcattaactcaatgatttccatatcatattctttttctgtaataactccaatacttagttttgcatcaagaactttaacatcatactgttcacgagtaattttagaatattttagttcaacatcaagtgcagcaattagatattccaaatctccaattacgctatatttctttttaatatccaattgggccacttcaacttcatatggagttagatatgtcaattcagcaactttcatatcagcttcataatcatcattgtagtagtatgctttagctatctcttttgcctttccagaaagtccccagtgagcagggaccatccaaaatggaataaatttctttttagccatttttcttaccaaaaatctcttcgattttcattacataatatgtatcttcaccgccaccaagatcttcagtcagtggtgtgttcaaagatgaacgaccaaacacaaccatatcaccttctttaatattatgttctgcaagttgtccgttcggaagaattttacctggaccaacggaaattaccatcccaatacatggtggttcaacattacctagaataataccaccagtacttttattctgtgcttcaatttgtcgaacaagaacgtaatcattaatcattttaattttcatatcagtaacctccagtatttgcaaaccattttccacggaaataaagattagcacccttatcacctggagtgaacacttccaacttcatagttttttcaccattacatttaggacaatcatgaggttcatcacgatttgcaattttaacaattttttccatgctatgtttgcattcttctttttcacaacgatatgtatataatggcattttgtattcctttactttttaaatcaaactaatttggggaacatagtgttccccgttatttatattagcagcctgttacgtaaaatttgtatactgcaattccagtatctagtgttacatttagcataccagttttagtaataccaagtgatactgattcggcattagatacgcgagataatgcttgaagtacgcgatcaatattataaccaaaaccaagacctaattcaccttcagttttagaaaaagctagagaaccaacgtggttacttttgtttttctcaccaacgtgaaagtatagggtgtcgccttcagtatacggagttacaagagaactaaaagatttaaatacaccagaaaaactctttagttcctgaacttttgctgcactaggaataacctgtacgtcatatggttgttcatgaaaacgtggttgaactggaataagtttttcagcttgtaccataaatgtagtgcttgcatcttcagatttaaatgccagacttttaactgaaccatctttaacatttgatgtgattgtggttccttcggtactgtatgtttttagagacattagaccctgaagaagacctagattacctaagccaaaacgaccctgaacttcaggaacatcttctttagtatatgctcgcattacaagagttcggtcatctgtgtacgcttctagatatacacgttgtccttcaccacggtcttcactgcttactgcaatacaagagaagtcaataccactggttgtgtttacgaggtcacgtagtacgttgcgtagatccattatataattctccgttttatttgttaatcaaaaaatgtttttatgtaagattactacaagcaccattatatctcaaaaatgatgcttgtctcaattttttatcagtattttgtattccaacgttgaagataaggcttatcaattgtagaactcatgccaattttatctcgtaattttttcaagtcttttaatgtatgtacatcatcgacaaaaacaactttacgctttttcacaagagtgtaaacatcagcaatctctccgtcaacttccactgaaccagtgcgagtaaaacccgcaccaattagaactacttcttcatcattatcatatgctagtacagaattaatgataccattaccttctaatacttcaccaatacgcttatatatattactcatcatttttaccttgtaatgaagtccattctacatatttttcccatgcctcatttacactttcttcagtaagattcaacatctcattagtgaaagtatcgtttacttcgtcatagtttagttcaatttcatttacaataaccatattattactccttaccaagtgaagaatccattgtttactgacgcagtacttttttcatgaataccaatatccatatccaaaataccaaaaatattctctaattttttagttagaacaatctcttccattttttcagtatcaaatggtagttccaagaaccattctggaagatactcaacacagtcaattggataaccaactgctttaattcccataggattatcttttaagttacagacaattacttttgttccatctgttacttctggaacagatttatcatcataaacttcacgtagacggttccattggataccagcaagaacgtgaccaactttacacttaccagttagctgatattcagcctctaaattagtgtagttttttacagtttttggtgaacctttttcatgtacaggcatatccttaaatacgtccttaaactcacgtacacgctgttttagctgttgttcactctcacctaccagtaatgcgattagagtctcttctaggaagttctggatgtattttggcgtgtctgagcgtttaatttcaagacccatcgctttgatttcacctggtttaccatcaatatctttacggaacccatcttcccagtacttcagaattgcataacgttttttcttcaagaataggccacgcgaaccaaccatctcaaggtctgcaccaacaatcttacctttttcaataccagtgttgaacatctcatgcataaatgatgggaaagattcaccaacttcttcaccaattttaatatacatatcaacaatctcttctttagatagattatatggaataccttgttctttcagataatgagttacactaaagtaaactgagtcagtatcaccataaattactgaaccaccttggtggttatatacaccagtagtaatttcattgatacgacttgccatatgtttggtcatagaacgtccagttaatgttacggattgacctaaacgtttgtcaaaaaaacgagaacctttgttcaatagtgcaccatatagactgtttagaagaatcttacgaatctgttggttctgtttccagaaagcactacgttgtttgaagtaatctttttcttctttaggacagaaaatacgaccatcttttagtactaatccgttttctacaatcaacttagcaacttcatcccactgtcctttaccaatttctttacgaagtaagtatacaggatcattatcatgaatattagttctaaacattgtaccaggggtatagtttgatagtagtggttcgactttttcatagccattaaactcccaaccatcagtatacatatgtttgtagtcaatgaccattttttgctgtgctttacgttcagaataccattgagttagaatgtcaggaattacaccagacttagacttatcaaaaagtgttccgtttgcactaagtacaatagtactatcttctgcaaaaataatatcatatagctctttgcccgttgctttaaaagaactcccatcttctaaatcaacaatcaatgtttcttctgacttttcatgaaccattgtaaattcaacagcagcaaataaaccatgccatgccgcagtccaatctggttcaaatgatttagatttagatttgttcttctgttcttggattttagctgcaagatacgcatcggtgtaatcttgacgtaattgaccaagaatacattcagtactcatacccaaagtacgtagaacagtagggtaaagagagttaaagtcagtacacccaaggtcacttacaagtcctagtactggatcttgtacccatgcacctgctgcttttgcactaattttctcatcttcttcttcaccatcttcaccataatattccatttctggatcaaactcaagatcatctttcggtgctttgttgaaaacaacttcaccacgagtatgtgctaagttgataatagcagtgtcgattagtgctactgaacccattgttgtactgataagtacacattctttgtgtgcaagtcgattgtgtaggttgatatagtcacatttagcatcaatctttttaagaagaatactatcctgtttagaataacgcaagaaagtaatgtaatcctctctgtaaagtttatccaatgaaccttcataggatactttattttctttagttactttttcagcaatataatctagtttataagattgttcaacttgaccagcatgtttcttatacaaagccaaataatcaagatggacgcgacctaccagatcatatgtttgaacagttttaccaaagttgtctgcttcacgtgaatttggttttttattccataaacaccaacgagcagttgttgcttcattgaagatttttttagttcgattgatcatatatggaatatcaaagaattcactattccatcctgaaataacatcagaatcatcaattaaactaaagaattccataaacatttccttttcgtctgtatataaaattacagtactgttaggatcgtttgtttcttcatttagttggcgaacaatatcttgtgcttcataaatttccatatcagcaggtggtaaagtaagtacataatcctttccagtccatgattgatatagagaaatagcggttactcggttaaacgggtctgatggtggagcataaccaaatttcttatggaaatcagtctcgatatcgaagaacacgatgttcaaatcgggtgaaccttttcccatatattctttagctaatgttttaaatgtaatgttacaatcactttcaaaaatacgtagaccttcacttttgtgttgctctacacttttattcatttgagcttgagtttgaaactcaaaatgtttagccattgtaccataaacagttttatgtgttccttgtggggattcaacataatattcatatactggatctaattcgcgtagaatacgtttaccattcttacgttcaactacatgaagaatatcaccagtacgtttacgttccatataagcatcgatatacatcgtttgtattcccttacgtttattaagttaaaaagaaagcctccgtcattggaggctatttaatatattttagtactaattagtaatcatctgcttgtggaagattattagtaacactaagaatagtttcgatattatcgagtttattttgtttgtcaaagtaatcacctttgtacatacgttgtgcagcttgtttgatatcagatgcatcgataccaagttcatcagaaacactagaaacaaaatcagataaggatgctttggtatcatcaatgaaagttagttgtacaacaatgttgttaagtgcgtcaccgagacgtttacgttgttcatcgtttagatcacgaatttcaactttaacttcttttttagatttagccattttgtatttctccatgtgtgttttcaaaaaaatgtcacctcaccacaatcggtgagatgacttaattgtatcacgtctttacgtgttgtctcattttttttccggtttaactggaaatgaaaatgttttcttgatcatgtctgctggtttgattgaattcaattgcgttacataatctttcaatttcacaaacaatacagcttcttcatcagttgctaactcaagatccatagccgtttttaagtgtccaagttcttgaattgcaatgtatttcaaattagataattcattttttaggcgttcaattttttcttctttagtttcaatatagtcatgaatagtatttccatcgtaaaccataccataaagtttgttaatatcaccatcatattcaatttcagaaacactaaaacctaaaggtactagatcataaatgttatatgatgctgaaacaattaaaccgttaatatcatacataaattttgctttattaatgtcaaacaattcacgagattcataccaatccataccttcatcggacatcatatacaaagaattaggattaccaccttctttttcatacatcttaaaatttgttagttgcattacacattccttattgttgacgtactgtttcccagttaccatttatttgcatttgaacatagcgataactaattcgttctaagtgagtgcctgaactaccattaacagaaatccatacgccatccataaatgcaccttctggtgtatatgtccatgaagaatcaggtattttacttgtttcaatacgtgcactcaaacgaatactttgtacgttattagtactaatttgcaaagtaacgttgccactagcatcagcagcagtaccgttaattgaacgaacaatatttttaccaccaacagtagctgagttgttagaaacagttaatgatggagcagctaaagtaccagaagagtttacagtaacttctgctccaccggaacgtaatctcaatgtattatttgaagagttatgatacactgccgcacgctcaccaccgcttgagttacggaaatatagaactaatgatgtatcatttgacttaattgacgcactgtttgcaatagtcaatgaaccagtcattgtatcaccagtttttagtacataacgagtgtttgcaactttttcactcaatgcgacgttagattcagcaatgttatataggtatgcaacgttaaagtgttccacatcaatgttgctaataccatgatagtgtggttggtttccaccaagtgtgttagtgtttccactaaatgagtgaatgtggtctggtgcttcgttaatgttattgattacagttggtataccgttatcattacttgaagttaacgcatttagaccactacggtccataccttttagtgcttgactatgaccatgacgaccagcagcaccagtggttccactaaaactaaatgagtgtgatggtaactgggcaacacttaatactgtgccgctaatattaccgctactaccaataacactatcagttttagttacaccagatgtagatataccttttaagtatgcgttttggttaaggtttggtacttgtttggtaattgtaccattttccccctcccattgccaccacataccatcagcaaaacaccaaccgtcagacgttttccacggagcaccttgtgaaccgtttcgtccactttgtccattcgattgccctgacatttgttcacgtatactagcaacagattgaccagaagtcaatgaatattgtgtaatagcaccaggtttaagtgaagtgtaaagaccagttggaccagaaccaccactagaagcagtagggaatacaatgtttaagtttgttccactaatacttgcactaggaacagtactactactgtatgttacactttctacttttaaatttaattttctgtttacttcatctaatgaaattctaattggttccaaaatagtatcagtatcatatactgcaatccaacttgtaccgttatgatacttcaaaactaattcgtttcgatcaaaaaccattgcaccttgttcaccagtaggtaacgtttgtactggtataataactgatgacgaattaaaacgaataggtcttgggttagttggtgtaccaccaagcactattagttctaaagatccattagcaccagtactggtcattgtatccaatgggttattaaaacttatgctcatgtataaatccctttatgattaatatatactatatttattcctatagcaagtcgttatccatatcatcccacacagaatcaatgatgtttgctgctatctttttagacattttaaaccactctgtgtttggttgtctagttgcattcatttgtttaagccttttatgtatctctttttcagctaaacgtgcgtcttcaaagtgaacttcatgataaacttcaaaatcacgaaacggggtagctgtctgatacgttctcaaacgctctgtcatttcagatttagaagtgaaaccaatcttaacatagtcaggccatgcagagtttattataacataacatatctgtgacatagattcaatctccatcattaatatggagatatttatctatcaactaatagtgaattttaaaccaatatcaattaaacgttgaaaaggattatgtggctgaaattccgatggttcttgtgctatgtttagtacaggagcatcagaatgcagcaccgacatacgttctctataatgatctatgtattcttcatacaacatatcttcagtatgtgtattaagtatatcttctatgaaagaatctaaactataatccaatctatcatcattataatacaatgtttcagtggcttcatcatatccaactaacgtaccataaggaacatttatttctatatttgagtactgactctttaagtactcttctttgttaaatttgtatacagttaacatccgtgtcaactcctttagattgtttacttaaaagtatttacaatttctaaaacactttcaagatacttagcatcaaatgtttcagtaaatcctgacggtaactcttcagtacttacaacaccactttcaatgtatttctttatgaacttttccaacagtaatggttgattgccatcttcaaagtagcgttctataagtacttcatgctcgaactcagaattgcggctttgttcgttgacacggcgtttcatatcaccagtgatcccatatttgtacaccgtcttgttattgttagttagtttttgtacatagaaatatccaggttttgatggttggtatccatacttaccacagttaggacacccgcgtcctgaaaggtgtgctttgggctgttgtttgaatttttcattgcaattattacacttcatatccatatattcttcactaccagtatagcatgattcagaataatcataatcatcaccatgtactttttttgcttctttgacaaattgctccaatgtcctcccgcctttaccagaacaaacaccacaccctgatttacctcttaacaaagtattggcagatacaatccaatcatgcacatcattcggatcattatgacacgtaacgatgactcgcccattactgtcactttgttttttgtagatagttttctcaaatgacaatgttggatggatggttttaactttttcaataaacgtttcagtcgtgtatgctgtgtttttttgacaaatgttacatccttttgcagaaggtcggactatttgcataggagtgattttgaaataatgaccaccttctacacaataaagttcaacctgtttatgagcattaatatataccattttatcaaacaaatacacaccagtaccgtacttttcattcactgtattaataaatttttcttcatttggtttcatgaaaattcctcttcttcatttataatgtacgcgtattattacacaaaaaagatggtgtgtcaacacaaaaagaaaagggactccgaagagtccctattgtttttaatttcttgattaaatcttttaaatctattacaattacatgaaagtaacgtttttgatagcgattttgctgtagtagtcagcagcgttaccaagagaagaagtactatcagtcaattgtacataaccatacctggtaaggaatgtggtcacgagttccccagtgttagggtccattacagtaccggaagccattagtgggatgtatgggcaatagaacacaccagcatcagtttctgcattacctttataaccaattagaatatcttctgcatcacttgcataagtatcaacaaaaatacgcatagtgctgtttagagtacctacaaacttaacgttagttggtgcttcgaaagtaccttcagtggtacgtgcaaagctagaagtagtagcagattgtagaatggttagtgcagttggggaaacaacagcccagtttgcagcaccacgcttagtacgacgagcaacttcgtttgcttgacggttaattagagttgctagagcagcgtgctcatcaccaacgaaggttgcaacaccagtaactttagattggtcataagttacagcagcagcaccaggcagtgcacgtagacggcttagtagctcttggtcgatttctacggtaacttcttgagcgattgcagccattagttctgcttcaacgtcaacaccatgttgggattgagcatcttgtgcagattcaacagtccaacgtgcagatagacgacgagatttcgcttcaacagtttcacgtagaatacggatgttaacgcgacgacccatagtaccttctagttggctagtaggagcagcttgtgggttgctattatccgcatttagatcaccagagtaggatttagcgattttgtatggagaaagcatttcttcaccagcgataacaccaggtgcgttatcagcatattgcacacgtagggtgtggatctgaccaactggaccagtcattggttgaacaccgatgatttcgttagcaataacggttggcattacacgacgcataattggtagaatcactttgtttagagtagcgatgttaccagcggtagttgcaccagaagttgcggattcagttagcataactttacgatggttatcaagaacagtttccattacagacttacgagtaccctgtagaccttcaactagtttctcttttactgctacccatttggattcatttagtagttgtgacattatatatctccttaaagatgttatattcgtttttcagtatgatattatttatagaactgaaaaatttgattattaaaatgctttaaaatgtttattttttattgatacctgaaagaacatcgagttcttttaggaatgccatatcgtcagcggtcatttcttcgctttcaacaatagcctgacggttgccagtgattactttaccttctgcaagagttttcttagcggaagactgaactgcttgacgagtggtagcagattcatttactttagtaccgttaagtactgacttatggtacttgctgaaatcttctttaagcttttcagtaggtgaagtagctagaagggattccataatttgtttttgctgtgcagttagtggttttactagttcagacataatcgcattacgtgcttgtgcatcttccataatacgtagtttggttttagcagctttaaccgcattagcagtttcatgtagttcttgcttaacttgagcaatttcatcttctttagatttaattgattcagttagggaacgtagcaatgagttttcattaaattgtttgacattaaactcttgagcaaatgcttcaaagattttacgaccaaacatattttgttttgcttccactagatcttgtttcaacgcatatagattcttctgagtggtttctgcaatatatttagcagcactttcagatgtacgtttgatgaagttattacgagcttcagcaatttgacgtgaaccttcagcaagtagtttaacgcgagtttcaactagttgacgtttttcagtgtggaattcttttagctcttctgctagtataccgttagaaaaattaacgaatttacccatgcattcatgaagatgcttacgttctttacgcatttgtttaacttcttcagccaaaacagagtttgaaaacgcagagaaattgcttagtgttttacgtagagttacacgatcttcaacgagacgttttttctcttcatatacagcacccatttcttcagcaatgacttgagtaaccatagtattcaaaccttcggttagttcagccaaatcttgctgataacggcctttcatttcttcacgcatctctgcggctagtgtattcttttcttcattccatgcttcctgaattagctgttttgcctcatcagaaagagatgattcttttagaagcttttctaatttagacattcgttctctcctttaagtactgaaatatctgtacttcaacatacagatatttatatttttaaaatgttaaccttttaatttcttgaaaaaatcgtatatttcagaatctaaattatttacttttttagattcagtgatttttttagaactattacaaggtgatccgtacttactcatcagagattcaaataccgctgttgggtatgcttctggagcactaggttgagcaacaatatcaatagtgataatttcaaaatcagaaactattccattataatcaacgttaccggaaccgcgagaacttacaccaagttttacaccagcctctagcattttacggatattttgaccatgtgcagtatcaagtagtttgatttctgccataccattagcaccttccatccaaaccttagtaatcattgctgctactcggtctaggttaatagttagtgtttctggatggtcacattcaacaagaatgctttcacctttagctaaacgctggttcatgttatttactgcccttgtaatttcagataaagggtaaattctctcgttcaaatttcgttggtcggcttgaatagcaataccacgaagatagcagtcacgcccaccaaatccattatcacgatgttccaaaacaactttagaatcattgaatgaagaccattcacgaatcatactactcataatgatctcctttcagatatttattttagtttaggttgtgctttgcttagtggtgatttagaattagatgcagtagtttttggtgctttaacatctttcatttcaccgcgagcatttttaccaagatctagactatcttttggtagaacagatttatcatctaggtctagtagtggtgcttggtcagttttcttagcgaatttaactggctctgctcctgctactggagatttagcttctggtgctactggagatttggaatgagtgccagctttttctttcttatcaactggagcaactttttctagtttgaaggattcaccgaatttttcatcaccgaattcaacatcagcaaattcgtcgtcaccgtcaacgccaacttcttcttcgctatcttctacttcttcttcagaatctagatcaacttcaccgtcaccgatttcatcaaacatttgttgtaggccacggaaagcatcttggattgattcccattggtcttcggaaggaacatcagcatcagctttcacttcaacgtcaacatcgtcttcaccgtcaccatctgcatcagcagagaattcaacttcttcttctgcactttcatcttcttcaccaagggtgtattcgatttcagcatttagaccttcgtctggttgtacatcaaaatcttcgtcaagcttttcttcatctttgactttaacttcgacttcacaatcttcatcgtcgtcttcatcttccatgctttcttctagttgtttgttaatttcttgagcttgctcaacgaaatacttacgcatttttttatcagcaatatcttgttcgccatttgcaaacgccgcaattgcttcttgtagtagttttaaattcgccattatatcctccatagatatattacattcgtataaagtatgatattatttagtactgaataaaatcgccttttttaaaagctttaaaaagtgcgatttttgatttacattaacccagaaccgtcaccagttggtgtagcggcataaacaactgcaaccacatttttgcggcgttgttcttcatgtgctttaaattcacggtactttcttaagttgtttaatacttgtaatgttagtttcggttttctggaatcagtaattttatatacgttctgatcatcttcagggtcgtacattgaatcactgctagattcaaagatgtcctttaacatttgatctccttgaaatatgcattataaatgagggtaaaaataaaccctcattcttatacactgttatttatgtttaaaaagaattgcctaaattattagggttgaaaccaccacttccactctgttgctcttggtattcggcatcagcactttccaaattaccttctccatcaataccaagatccattccaggatcatttggagcatcaataccaacagactgtaatcctgcggaatcttcttcaccaccagaaggttgggaaccatcttgtggattctcttgtaaccacatttgttcattcttaacaatatcagctttagaaaagcccattttttcaagaattgtttgtttcgccatataaggcaagtcattaagaggaagatatgtattaattagtttagcatctagttcagctttacgataagaagctaagttaataggtggattcataataacttcaaaagatgaagtactaatgttatatccatttttaaccataaatcttttgaattcagcatcaaaatgttttgcaactaaacgttgataacgcatacattgattattaaatcgcaattcacttgccatagcttgtgtagcaccatcaccaaataatgaaacaccaccatcatctggaccttgtggtagataagaagctggtatttgaagaccacgaatcaatttattattaaaataacgtaagtcatcaatttgtcctaagttatcaccgcctggtaatgtttgaacatctgaaccacgaccttcagaagtttgtgggaaaaagtagtcttctaaaatgcttaatggattatatgctgcatccattaatgaagtacttccacctttgtttgaaggtattctacgctggtggatttcatttttaaatctttcaacataagccatcgcttgatgtgcttgcatatcaccaacatcaattttaaatacacgacgctcaggtgcacgttgtacacgataaattatgatactatcttccagaagttctttttgcttatagactttaaatacgtcctcaagtatactagtaccaaaaggccataccccatcttgtcctgtatttagcgttaaatgaattacgtgttctgcaccaacaggaataacgtctaattgaccgttagtactgaatggatcagcagtatttccttgacttgtaaaaccagatgcaccacccgcagctactgaaccaccaccacccattgttgtcggaatagctcctggataagcggttttatcaaatcctacttgaaggttactaaaaactttatctttcaaatttaatgatacgtcacgtatataataaattactggtgttttaccagtggcttcgttaacaaatacttgctcaacatttttgggacttacccaataccaatcgaatgtttctggatctcgaatgaaaaattgatcaccatatttcagaagaccacgcacaatttcatacattcgtgttttaaaatcattttgttcagtccatgcatctaaacgatcttcaatagtagttacttcagtatcaccaatatcatctttatatttgattttatatggtaaaccaaaatcttcagtactttgggtacaaaagtcagcaattatattcaatgcagttctaatttcaggatcttggtccatttgctcatactgactataacgctcagtacggtttgccaatccattatatacaacaggaagataggaagcgaaatttgttttcgttcctgttgatttattgctattactggactgattcgggatggtcgatagtttagaccttcccactgtcatatgtcgtttccaactcattattttcgtccttaactgtttctctcaccttgagtgttttcagagatagttcttagatagttatttgtctgttgcacggcagatagagattgctcattaacatcagcaagttttttaagtaactctttcatgtcttctgatattgtggcattattattagcatttgccatactactaccactatttatcatcgctttcatggcctcataatcgtccggttcagcttgaattggtggttcatttggaccccatgctgatttatcaaaagtttttggagttatggtaacatatggtgcaacatgttcagatttttcgattctcgcagttgctcttggcttattttcaagaccactactaataagtttttcagcaactgattcatcaaggggttttggttgtttaaagtttctacttgaattccattttaaaaaaccatcaaatgaactagaaatataatcaccaaatgaattcattttttcttcaaaataattattaactttttctgcaccatcggtaacagaattgttttctacttttactttatcgtctgatccaccaaaccaacctttaacagaatcccaaagtttaccaggaagatccattaggttattcataaagctatcaaatgcttctgaaactttattatatccactaccaaaaatttcagtacctaacccttctaaccactgctcaaactcaccaccaatcctatccaaatacgcaactgcatctttcgcaataggaaccaaaccaaaaccatcaagtgctaactctccgataaattcccatgcaccatcagtacggtctgcaatatcagtaaggtaatccgcaatagaattttgtgtatctgcatacattttattaaatggttcagtaaattctttactaatccatctattgaatctatcagtgaattgtgttagtttatctgctggttgactcttaggatcattaatcgcagcttccatatcaagtagttgttggttgaaggttgctgccgtagtgtttcctaattgtatctgatttaataaatcttgctttattagttctttgttctttttaacaaattccaattgttgacggcgaatttcttgtgaatcagtaacaccactacgtaccaagttctcacctaaatcagcaaattggttcagtactggagtcaataaatcatctggtactccaccaatagttaaacgatgtgaaattaaacgtagaaaatctgcaccagcatcacccatactggcagcagcttcgttaaatgcttttgatgttgcaactgctgctttactagataatccagaatagttttgtaatgcgatttgcattgaacgtgtgtctaatgatttatctaagttttgtgttttatttaatagtgcatcaactgactcacccatacttttactgaacttagtcatactcatgataaactgttcagtactttttgcttgatccatactacgtaacatttctcttccaccaaattgcttttggaatttaatattacgtgcagttaaatcagttaatgttttttgagaaactccatataaacctaattgattttgtgcttgttgcacagtacccaataatttaccaaatgtagaaacaccatcaccatatgcaccatctaattgtgcaacaacggcactatgagtttgtaatgcttcaccaaatgcatcaatactcatcattgatgcaccagcaccttttaatatggagccgtaaccttcagatagagcgacaccagcactgtttattctattataaacttcaagctgtgcatttaacacattataaactgctaaaccagcgtcagcaaccaatttgaatgcagatgctgctgcaccaactggacctgggatcattgctaatgaaccagcaaatgaagatgcactcattcctagtgagtttacaacattgctaacgtttgcagacgtactcatcatagttttgccgacattcgatacttcagatgataatgatttgaatatttttccaaattctttaccatcatcagctttgttatttgttcgagagccacggtttccagtacttgatgaattacttccattacgttttccacttttagaaccggatttctttctatcattttttatattttcagccaataactcacgtatagcactcaaactatcgttgttatctttagtttgattaaccaactgctggagtaggtaatcacttgtatttccagccataacattcccttttaatagatgtattatagaaatatttatgaaactatagagaatataaaaattagtttaatttaatcttttttagtcttataaatactaaaacacatttattacatggagatttaataaaatggctatgaatccacttgctaagtacactaaaattgaagagatcagtactaagttagttacaaacggcgttattccttataaagaaggagttctaggtccaaaaggtgtcaaatgtggagtttgtgcacgtagtgcacgtgatgaaatgacacttaatacccccgatatgttactaaacggagatgcagtatcccgtgttattgaaaactgtgttcctaatgtaattgacgctgatgagttgtatgtaaatgacgttgaaatgcttcttattgctattaaagttgcttctaaagaagaaacatatgatattaacgttgtatgtcctgaatgtgaaaaagaaggtcgatttgaacgtaatctatcatatcttcttgaaactgcacaagcatttgaagaaatcccatcaattgatttagataatggactacgtttagaatttagaccactgacatggaaagaatattcatcgtttgctgaacgcatgttcagtgagcagcagaagactaagtttcttgaaactgctgatattgataaaaatgaaaaagtaaaaatattttctgaagtatttgaaaacatggctcaacttaacttcgatatgattggtggagttattgcaaaaattataacaccagatggtgatgaagtagttgaaaaagaatttattaatgaatggcttggacaacaatcgaagggagtacttaaactaattcgtgaaaaaatggatgaagtacttgaaattggtgtatctcatagtatggaagtagaatgtgatggatgtaatcatcaatgggaaattgatggactaaaatatgatcctagtcattttttcgagtaatgcttctccagtcatctcctgaagaaatacaagaagtactgaaggagatagaactgaataagtcagaaatcaaaaatgcactaatggaatgttctgtatatatggataacattgactatggaacactccttaatatgccattaatagatagagacttattagttaagtcttttaataaaaaaattaaaaaacaaaacgagaagcactaattttcatatagccagcacattgttgctggttttttttttggttttaaactacagaattatttgaattgaattatgaaaggattaattttaatattattggattcatctaactcatttcattcgttagctgaagaatattcgttactacgtaactcatattcatttaattaaattaattataaagaactttaaaagatttaatacttgacgggatttgttgaggacattttcatccccccgcaggggaatgaagacaataaaaaagagacaatgaagtctctatttcttgacgctgatggtttcagcatttattgtattgcgaatttcttaaaaatatattaagaacgaaagcgggttgctctgtttctctctatcgcagtcatgtgcaacggtcgtcagtcttaatcatcctgacactcacctgaaagtctatacaatcaaacttcaggctgtttattaaaatcacttaataaactcccttagcaaatctggtaaggtgcgatccttatatgtctatctaggaactctctgtatgcttatcggagttctttattgagccgcattgccgtgaggggttcaaactatgcccacatctaacgggtttcttttgctcatcgcactgttgaactgctcatctgccatctacattttcgataggatcaggttctaatttatatgcatttctgcattcaacaggattgtcattactacaacaaacattatagcaccatttttaaaatcttcccactaatatcataaaaaaataaaaaagtacttagtacatttttgaagtataaaaaaccaagtaacaaaacattacttggttcataaaaactattcaataatttatattttttgatatgaagtcttttataattttaatgtggtcatctgaatactttattctaagtaaagtaatattattatcataacaatacttattcttaatttcatcatttcgttgttgttcagctaaaccttcttctccaccgaagtattctattggtttgaagtgttggataccatcatattctattagtagattaagttcaggaatataaaaatcaaatggtaaatgattgatgtttttacaactatcaaatttcttttccatttcaaacattatatcacacgtttttaaaaaattctgaatttcaataacaggttttgattttagttcttggtctgaacaaactggacacccttgttttctatgataatgcttagtagctagtacggtgaattccccatgtctcttacataatggtgtaatggtttcatacatgccattatattttgtattagagtaatcataattatccatgtgtatgaacttacaatcttcaaagaacacatcttctggagttctcttctttaatccattttgaattttggcacattcagggcaaccttgtccagatagatgattactaactacttgattaaattcaccatgacctttttctttgcatataatagtaatcttttctgaacgaatgttaaaaaacacttttgagtaatcatacttatcaccatgaacttcggtagcttcagtgaagaatgaccccagagattttttagactttcgttctttctttgcaatatcagaacaaactggacaaccttgttttgcagaaatgtgtttattaggaactactgtgaagtcaccgtgaatgttacacgtaacagttattggatggtgtgcattgacatatattgttttattgtatgtgtaaatactaccatgaatattcattgatttatctatgaattgttgttgtgtaattttagccattcttgtgtacctcacaaaactttttaatatacattatttacagaaacaggacaaaacgctatgaaaaagagattgaaaaatcccaatgaagcagcagcttacagaaaagaactactaaaaaaacaaaatggtattgaccccattataggaataaaaataactaaaccagtacttgaccactatcatggtggaaatcaacattgtagacaggttcttcaaaatgaggtgaatggatgggaaggaagggtcgcaaattcatttaaacgctgtctgggccatttaactgataaacctcttcatgaagtactaagaaatctggcagattatcttgaaaagaacaataacattccacctgaagagcaagtcatacatcacacagcactaactgtggatgttaataagtttaaaaggcttccagcaacacagcaaaacgcgattctggaagggttaggagttgtccctggtagtaacactactgctcgtgtaaagcaagctagaaagctgattaaggacggtaaattaaatatggttgatataaaaaaagggagctaaggctccctttatctttaattagaaaacatcgtcaagggttgcatattcaacagtactgaaaccgtcctctttaacaactttgaggattttttcagtcttagatagtaactcttctctgtgggaaatagcataaacgttcttaccacgtacagcagccatatcttggaagatagaccacacacgtagaacaccacttgagtcaagaccttggtcaatcatctcatcaatgataagaatattaatactttggtataatgactcatatgtatcacggaaagcacaagataatgcgatgtttacccttgtacgctcacctctactaagctgtttatagtcaaagtactgtccactcttctcaatttcaacactcaaatcattcaaaaacacaacattatgctcagaaccgcacatatcgatatagtactgaagtcgtgtattcaaatatgagatattttgctcaataatacgtttacggacataagaatccttgtttaaaagtaatttaaccaagaaatcttggtgatttgacattttatcaagattattatagtcgctataatcgattggtactaaagaatcagtcttcagggtattaatttggctaataaatgtgttagtagtcttcaattcacgatctaattgctgtgataatgaatttacagtcatttctaactctttaacttcatatttgtttaatgtatctggaacttccattagttcatatgagttaagttcatcatatgatgacataagttcatttgcatagatgtttatttgttcttcttcactctttctgaccaattcttgaagcttatgttcatgcatttgtgcttctgaaagtgtattataatatgtcacgggcttaggtggcatatcaaaaatctcaatactatcaatttcttgaagtaatgtttcaatttcagaagaagaactatcaattttagcttgaagatcattaatagtactttggattttgtctttaattgaagaagtatgttcgttatgttctaattcagacatacaaagtggacatttgctgttttcaactgttgataatttgtcaatttcagcattaattgaacattcatatccttttaaagctatttttagtgagtttagtttttgttctttgaaacgtttttggttattattctcttttagaataccctctaactgtttccatatctccaactcattatgattttccaattctgcactaatatcaatagtttttagcttatcaatgcttagatttaatgctcttttagatctttcaagttcacggtcatatgcatcaaattttaaagccaactcttgtacacggcgttcgatttccccacgctttgcgttatgaataagagctttctcttttatatcagcagcttcatagaggtcattaaagtctaaagttttatatatattcaactcttcatttaacttagatactctattatttttatcaatttcaaactggtttgcctgttcttgtagtgtctcaatacttttttgaatacgttcattacttgcagctacagtttcatttttgaacttttcttgttcggctaaacgtttagtatccttatacatctcctttagcatttcagctttttccgtcaactgtgttattccaagaagttcttctatcatatcacgttgtttttgtgtggataaagctaagaaaggttcaacgttagcattcagtactacaatatgttcaaataataattgagatataccaagaatttcattcaaatcttcttgtgtgtctttcttttctccccttgattcatcttcaattttattatctttccctaaagtaacaaaattgaaatacgtgggacttctcccacgttcaaccagatattgtacaccatctttttcaaactctacaactacttcacaatttttaccattagttttattgactaagttaggaattttaatatcattaccaatacttttcccaaataatccaaaaactaatccttgaataatagcacttttccctacaccatttcgacgtccggtactgtcaccaccttcaataactgcatcattattttgacccagtactaatgaaatgtcagaaccattcaattcaattgattgtggtgcattaccaaatgaaaagaagttcctcatagatatacgtgtaatgtttagcatatagtcccttataacgatctgtaaatttggattagaagatttttatcaaacatgggtgagtcaatttccataatttgctgcaacacaatctcatcaactgattcagtactttcaaaactaacaccatcttcgattaattctgaaatactttgcttgctagttacaacattaaactccctaatgttataaagtttagtaaatgtatcacgaataaaactaatctcatcagttgttattgatatatcaacttgaacttttgatattgtgttatcttgtagataatagcttggatcagtcaacaattcagaaagtgtgaatgttctatattttggtgcattatcccatgacttgaaaataggttcttttccatgttcaagaatcatcacacctcttgcatcatcccatgtatcggaaaaattatgtggaaaacaattaccagtataaactacacgagttccttttgaagttgtttttgactgccttttatgaaaatgcccactaaaaacatactcacaaccaccaaaagaaccttctgtttcttttccatgatcaggcatttctaccatcttgttaagcaagtaacctggtaactctaagtgaccaaaaacatacttactttttagttgaggtaacaacttatattcatcttcaatcataaatggaatgaaagtacaatcatcaaatgttgtaatttcattaatgaattctatattttcataaacttgagccatattgatacttgttatatcacgtttgtttttatgatacatatcatggttgcctactaaaaaatatactttttcaaaattatcatttaataattgaagaatttgtaaaccatagtttagtgtttggatattgatattacttctattatgaaaataatctcccataaaaacacaaactttgatattattttttttagctacctcaatcatgaatttaatgaagtttaaacaatcttcattgtgttgcttgctgttattctttaaacctaaatgaatatcagtgaatgtaattgctttatcaaacagagccatcttcatttttcctttcaatcatgttcaattcaatttcaatttgacgtgtatgtgatggcgtaaagccatgcatttcaagtaaatcatcacgtatatttcgaacatttttctcactattcaatatagaacgaaaactattgtttacgaatgatgtatagtaagagaaaggatttagctgaactgctggtttatcttttttataaagaatgctctctttaaagagaagtgcgtttttaactaattgtattcttgcatcacccatcatttcatctaagtatgtatagtttctgtaattagatttgtgtgagatttcctctgcaagtttaatgaacatcttcccaagttcatttgtaattttaccatgaacagtactgaattcaccagtttcaaggtcgcctttccagtgagaacgacaaacttcatagagaataccttcattatctacaatataatgcttgaatggttcaaagttaactctagtatctggtggaatatgttcatctgtaataacacgaataacaacttcatcaattggaacgtcagtgataactaaattgtgttcatctgcatattctttagcttttttagcactcatattttccttttcacgaatactatcaagcatttcattgttcagtcgtttaattcgggctgccttagctttttctagtaactcagcagtaatttctgactcatgaaaaacaatataatcatacatactatatgatttgtctaataaccagcaatatgaaattttacttttttgtatttcacgaagtaaatcagcattattgagatactttttacgctttggtctatttgtcattgtattttactctccatgtttaaatccaataggtacaatccttgtaccatcaatgttattatagcaccaaaaagcagtttgtcccacgtataaatacatcaaatgttcccttattatggagaatcaaaaagatgattgatcgtagaattcgattacgacctaaagccgcaggtgctaactatgtatatggtgattttggagatagctccgaaccaactctactttcgtttctgcgtccaactaatgggttggtttggactgtaacaccaacaattactgaacaaaggtcaattcagtatgaaacacagtcccctatacatactaacagtaactataacaactataagaacactactaatacagttttcacgattcagggtgaattttatgcgaataccgcagcagaagctatgtatgcgttggcatgtgttcattttatacgttctgtttcgttgatggattttggtagacaagctgcttcggctaataaccccgaactcgcaattgcaggtgcaccaccaccaatcttacttctaagtggatatggtcgttatacatataatgatattcctgttattttaaaatcttataattttacttacccaaatgatgtttcttatattcaagttccgttgaatagtagcgatagtacttttaatttatccgacatggatagtagaaaattcttcgaacaacttagaagtactggatatatgaacccacaagatgaagtttgggttccacaaaaaatctcagttatgttacaacttgaagaacaaccaacatcggattatatgactaaaacgttcaacctcaatgcattcaaacgtggtgaactattacgtaaaggaggattcatttaatgtccaactatagtcaatactcaccttacgctaaggtgaaacaaacatggtatcttgggtataatttaccacgtgatattgttccggctgatactgatgatttttatgagatcccattgaaatatgaatatcaaccttggcgtttagcatacgaaatgtatggtaatgaacgcttatattatattttcgcattgttaaatccagatatactaggagaagatcctatatataattttaaaagtggagtaacaattagaataccagcaaatcaaagagtacagaattatcttaatggtactcgaaacataggctaatggagtaacgtatggcagatttacgaagtacagttgataattttcaaaatgatattacaagtattactggtaaggctaaaaccaccacatctaatgcacttgatagtttgaaagctacagcaaatacattacaaaatgatgtaaaaactattacaaaaaataattacaaagcaaatgtaagtaatgtagtatcattaccaaaacaaagtgctagtgttgatcaagtttatgaagatctcgatttaagtcagtttgtaataccgtatgacaataaattattgaaatatgataacccaacttggcacttttgtttatttgccttagataaagatgattttaaaaacttttggctttacccagatgcagaagtgcaacgacatgtgatatcagaaagtggtgttactggcaaatataatatcactagtgtacaaatgacacaagctggaccttcaacaccaggaatgacaacaaactattgttttaatacagcagtacttaatatgtctgaaaataatagtatgagtctatatgatgaattaatttcgttaagtaacaaacttagatatcataaatttatggacttgccattgatcttggaattaaagtttattggctttaataaaaatggaatacctgaaattatcccagaaacaacaagacgctggtcagttaaaattaatagtgttactgcaagtgcttcacaaagtggtagtactatgatgtatactatgaacttagttcataatagagcagctttagttgataacattgaatggaccttaaaagaaccattcaattgtactgctgaaaactttggtgacttctgctttgatttagaagataaattaaatcagatggctgaccaacaatatggttatcttagatataaatttggtgaattatccgaaggtaaatttttcgaatttaaagtagcacctgatttgcaagatttgtttataaactatgattctaaacaaatggcagaggccggaacaactaaaagtggtgcacaaggttctaaaaacttttcatggaacccaagtactcctatatctcgaattattgatgacgttattgatacatgtactgtacaagccgatgatagtactagtgtgcgtcaatttgtaaacattataccagttaaacaatacgttggttttgataattatcgtaatacttctgtttataaagtaattttttatattgttagatttaaaataggtgatattgttcatgaatcggatttacaacctgaaaatttcacatttgagtacttttttgagaacgcagaaaaatacgtagatcctaatgatcaaaaaccaaaaataaacatgaaaacttataattatcaatttagtgggcttaatagtgagatacttgatttggatttgaaatttgatcagcaatttttcgtagccactacacgtaaccctggtccgatacaagatgtagcgaaccatgcaggtacacatacatcccaagaactcaatattcaaggtgtacaatacaatagtataccagacgcatgggcaaaaacaagtgatttacgtgtaactcgtgatttaggagggatgttaacacaagcccaacaacaattgttaactgaagttgaaactttagcaaaaaatcaaatgcaggttggtaacgcagaagaacaagaccgttataataactatcaagtcaatgttttacctcaatatattgaagattatgtaaccacttatgaagaaaacgatggcggtactgatggtgttggtcaccgttatggtgaagtgttcacaatgccaaccgaagcaactaacaatgaaacaactttatccgcttcgttaaacgataacagcagcacatatgaaatggatagacgtaaaatacgtgacaactattacaatagaccttttttgtgtaaactcgatatgcgtgtagtaggcgacccgtactggttagggtggagtgattactcttacttacaatatctagaacaagtaattaatggtgaagatatggaaattaacccagatgattatcatgtagcaaattatataacatctgaagcgtatctattactaaaattacaaccagtaatatcaataaatgataacactggtgttttggatattaatacaccaaccacatttaaccaaacaatttatcgtgttaataaaattgttcatgattttggtgcaggtggttcttttacacaacaaattcaagctgcaattgtaattcgtgcactcaaacgtcacgatagtatagttgattaaggaataaaatattatggcagatacaagtaaaaagtatgcacaacagcagttgggtcgttttgacccatcttatccgcagttagcaactgttatggataacagagatccaactaaatcaggaaaactgaaagtttggatacaaggttctcaaagtgataaaaactcaaaagaatcatggatagaagcatcttacatgtctccttttgctggtaaaacaccaggtattccaagtgctgatgcatatggtcaatatccaaaaggatacggtttttgggcagtaccaccagacgtagggtgtacagttgttgtaatttttgcacaagcccgtacattccaagcatattggattggttgtgtatatgaccagcgtatgaatactatggttccaggtatggcaactgaagtaagtaattatggtggaactgatatgccacttcctgttactgactatgatcgtaacactatcactaccgatatgcaagacaaatatgctaacgttccaattatcgcaggtcttaaaaagcaaaaccttttatatgacgaagaagctgggttggcgaatcgtagtagtactcgacaaaccaccagtactgtatatggtatgtcttcgccacgtggtaatagttttattattgatgatggatatactgaagaggaattaacagcaccaacgtgggatcaagacccagatggatatcaagatacacaatttaataacccagtaaacgatacacgtgttggttctcgtaaaaatgaaggtgtcgtaataaaaacacgtagtggtgcacaacttcttttatcagaagctactggtgatgttcttttaattaaccgtgatggcactgcacgtataaaattcactggtgaaggtgatattgacatgcactgtgataagaatattaatattcgtgctggtcaagatattaatattactgctggacgttcatataatattgaaaccggacaagatttcaatgcacgagttggtgcaaatactaaattagatctaattggtgctcttgatgcaaaagttggtggacaagttgttgttaattctggggcagaccttcgtttagttactgctgcatcattacgtatgcaaagtggtagcagtactgatattacggctggttcaaatgcttctatttctgccgcaacatctgcaaacctaattggatcatcatcagcaattattagtggtggtggtcaaacattaacagttaatagtggtggtaatagcggtactgctgaatttactgcaccaaactttagaacaccatctgctggtcttaatgaacacattcatgatattgctgcatgggttaacgctgaaaatcatggtagttatgttgaaccaccaagacaaggtggtggaagtggttctagtgaatcaccagtacaaccacaaccagcaaatgatgtatcaccagaattacccgtagcacaagacactgaagctgttcagtttgttaactatacatcagaaactgaacaagttcaatcacaagatttgatgacatctgatcctgggatgactggatatagtattacatatgaaggtttacatatgttaatgccatgtagcggtactattcgacaatatggttactgggggaaaggtgttccaacacaaagtggaggaaaggcagaccgatcaggttgggaaatacaatgtaaaggtgatgtagttgcaccagatggtggcgtggtagtaattactaatggtgctcttttaatacaacataagtctggatataaatctattttttataatattcaatctgatttattaaacaaagatgttgttcaaaaaggtcaagttgttggaaaagcaaatggtgtcatacagtttgaaattcgtgttacatcagcaaatgttcttggattcagtggttctgttgacccaggattattttatgcttcacaaacaggaacagggtctgatgcggcgaataaaacattaattgttggtcaagcaactaatcaatctgctccaaaagcagttgtacaaccttcagttgatagtgatgaattggtagttacaacaaaaatcaaaacgataggtactggatattctcaacgtggttctcgtcatgtgcctcgtaggagaagaacacagagaagtggagcttcaacaactccggtggagcaacctacctataatattggaaatgttgataaaactgcaatcgattggaaagttgttccaggtgatgcacaatttatttctgaattaaaagaatatgaaggtacattacaataccaacaagcaaaaggatattatcgtaatggtaaattctggcgttatttggatagtcgtgggtatccaactattggttatggtcacttgattattagtggtgaaaacttttcagatggaataactgaacagcaagccaacgatatgttagttcgtgatagtagtaaagctatatatgatgctaaatcaatttatgcttcatacaacatgaaaacaccttatttggctcaacaagtactatgccaaatggtattccagatgggtaaaggtggggtacttaaatttaaaactatgttgtctgaattagctaaaggtaattataaacaagctgctgctcaaatacgtaattcagcttggtatcgccaaactactcgccgtgctgagttaatggctcgtcgtttagaggcatgtcaataaatattttagtactataaataaaacgaggatatctttatgagtaaatgggaaattaaaaatacagatgagcaattttttaaggaaattaaagaatttgaaggaactattgcttatcagaaaaaacttggttattttaaaaatgataagttttgggtatataaagacagcttaggtcttgatactattggctatggtcacctagttttacctggtgaaaatttcaagaatggtttaacagaagcacaagctgaccaacttcttcttaaagatgctcaaactgcgtacaatgatgcaaaatcaatttatgaacaatttggtatgaccgcacctatacaggttcaacgtgtattatggttgatggtattccagatgggcaaaaccaaagttttaaaatttaaaaaagcaatgaccgcattaggtaaggctgattataaaactgctggtaaggaattgcgtgatagtacatggtataaacaaaccacttcaagagcggaaaagatggcacgtattgttgaatccgtataataaaggaaatagtcaatggcagttgtttttaaaggtttttctaccccagtagtgggtagaactgaaacattgtatgatagtgaattggttcgccaagatttaatgaatcatttcaatacaaaaaaaggcgaaagagcatttgatgctgactatggttttattgcatgggatttgctgtttgaattggaaggttataatactatcaaccttttggaagcagatgcccgtagaataattagcttagatccacgcttaaatcttaagaaattgcaaatttcaagaatagaatatggataccaaatgaatattgtattacagtacgtagtattggatacattagaagaacttactattgtattcgatgcaagaagtaataacagaatggcaacatattcagtatcgtctttataattacaaaagcactcttcggagtgcttttctttttgaataaatatttctatataaatcatggagtgatgtatgaaatatgcaaccactagatcgacaaaatataaatttgtaaccaattcaataaaagttcatggtatacgatatgactatagtatggttaaatatcataatgctaaaacaaaagtatggattggctgtgaaaaacatggattttttctacaaacaccaaatgaccatacatgtggtaaaggatgcatgaaatgttctattgaatataatacaaatagacaaaaaagtccacagaattttttaaatttcaagaaaaaagccaattttaaatttaaaaataaatttgattatagtatggctaattatgttaataataaaacacatatatcaataagttgtcccatacatggtatattctaccagcgacctgacaatcacttgaatagtagatacgggtgtgaaaaatgtatgagagatagtactcaatccaaggcagtatcagatatagaaactatattatcttcatttaaatatgttagagaaaagagatttgataattgtaagaatattttaacattgccatttgatttttatattgaagatttaaacttgtgtatcgaatatgatggtgaacaacattttcaatgttcagaacattggggtggtgcaaaatcactaaaacaaactcaacacaatgataaaattaaaaacacgtactgtacggagaatggaataaatttacttcgattgaagtataatgaagactatatttcagtactaaaaaagtacttttatgataattttaacatattattaaaggattaaaataatgtcacaacaaaaaagacagtctaatttatatagtggtgaggattggactcaagtatatgaaagtttttataaaatcaatctaacggcttatgatttcgatactatccgtcagagtatgattgattatctacgtgcaacttacccagactcattcaacgactggatcgaaaacgaccagtttatttttattttagatacgatttctatgctaggacagaacttggcatttcgtatggatttgaacacacgtgaaaactttttagatactgcaactcgtcgtgcatcagtactaaaactagctaaaatgatttcttactcaccacgccgctcatatccaggtcgtgcagttgctaaattaaccgaaattaaaacaaaccaagatgttcgtaatagttttaatgaatcattaaaagataaaatcattcgttggaatgacccgatggatgctaactggtatgaaaacttcattctagtaatgaacagttcatttgtcagtactaaccaatttggtaatccagtcaagcgtattgatgttaatggtgtctcccgtcaactatatcgaatgaacaccatcccaatgacagcacccagtattccatttattgcaactgtcaatggtgaatctatgacatttgaagtagtgaatcctgatattacgtctgttggtgttgaagaacgacatccagaaccacaagagcaaaaatatattgtttatcaaaatgatggtaatggatttagctcaccaaatactggtttttttgtatatttcgtacaaggtacattgacatatcaagattatcaatatgctatccgtgaagagaaccgtatacaagatattaacgttgataatatcaacgaaactgatgtatgggttcaagaaataaatgaagatggtattgttcgtaccaaatggacaaaagttccatcaatggaaagtattgcatataacactgttaatcgtcaattaaaaacaatttttgctgttactactcgtgataaagatcaaataacaattaagtatccagactcaagaagtggtgttgttccccgtgggacgttccgcgtatggtatcgtgttagtaatggtaaaacatataacattaaaacttctgaaattcaaaacaaaagcgtaaaatatacatatcgtacaaaaacacagtcaagttatgaatctagtacattggatatacgtttttcattacaatatgagtccgaccgtgcacaaagtgcagagactattgagcagattaaagcacgtgcaccacaaatgtactatacacaaaaccgttttgtcaatggtgaagattataatattgcaccacttagtttaggcaatactgtacttaaatctaaagctattaatagaatttatagtggacaatcaagatttattgatattaatgatcctactggtaagtatcaaaataccgatgtttttagtgatgatggtgcgttatatcaagaaaacacacaatttaataggtcattattgctaccaaccacaaaaacaaatgctagtattgttattgacaatattcaaccattgattggtgaaaatgcggtaatacaacgttaccaagcgtttccttcaaatacaattggtattgaaatacaacaagcatggactccggtatacaattcaaattatacaactaacacatatggtagaattttgggttcatctggtacagtttatggttcatatcaggttggtactctaattaaattttctaattctggaactactatatgggctagtgtagttagtgtattggataatggattttatgtactgagtacatcggttccaagtggaatgcaagccatagagtacattttaccatatagaactagatttaactcggttgaagttcaagcaatttctgctatgctagataaaaaaactgattttgttattgtacatgacaaagaaacgacatcatgggttcctattgaagtaagtaccaatgatgatactattgtatataatggtaatgaagttttaattataattaatgtaaaatatacagcagaaacttgggaatttgatgctaacggtattgaatatatttttgtgggtggagaaaaagtaagattttactttgtatcatctaaaaaaattactgatattagtactggtacagttcaaagtgataagattgaaattttatcatctaacactactagtagtagtaattcaggattgacaagtaatatagattttcaaatttatgacacaattcaacaagagaatggctatctagatggttctcgtgttattgttacatctaggaaagtagatagtaatggtataccattggaaccaaaccaatttaaagaaattgttcctacttggactggaaccgatgcattaaaatatggtggtattttggtatttcaggaaaatagtgatttcactatatcagtactgtcgttaccaaatgataccttcacacttcttgattcatcgtggtcttatacaatggaacaagccttggcagagccgaatgcatataaaagaactgaatttgttagaaataacgcaattcgttcaaccacattgagtggattatatagtaaaggttctggatttttagttggttttaactatgatggtaaatattattttattgaacaaacagttggtaacaacaatgatcgtttaggacagctaattagtaatttaacttattccgatgatactggcactgttagtcctgaattggctttttatcgtgcaattaataacatgggaactaatgctgacgagaatcagaagctagattattatggatacaaagatgttacttcacagtacactgttaaaactaatgcacgtactagtatagacttccattggaaacactatgcacctgacgacaatcgcattgatcctagtagaacaaacttaattgatatgtatgtattaaccaattcatataaaactgaagttgacgtttggttgaaaaataatgctgttggtagtattcctaaaccacctacatcggttgaattgaaagatatgttcaaagatgttgaacaaaaaatagtcattagtgatagtattatttggcatagtgctgagtacttacctttatttggcaacagtgctgctgaagattacaaagctgattttaaagtagtgaaattaccaaacagcacaatgagtgacgatgaaattcgtcaaaatgttatagcattaactaatgaatacttcaatgttgataactgggatttcggtgaaagtttctattatactgatttgtgtacttacatacactcacagttaggtagacatattagtaccattgttatagttgcacaaaatccaaattcaaaatttggctctctatttgaaatcccttcacgttcagaccaaatatttttgagtactgcatctgttgaaaatgttcaaattgttaactcactagctaaaagtaatattaatatcggttcttaatataacgggcgttcttcggaacgccttttttatatcataaataaatcaaatgaatgaacgaattatatggagtccaaaaatgactaataattttaagtttcaacctacacagatggctgaagcagtacagaagaagctttttattaaaagattgcctgagtggatgcaaggcttagaagatattcaaaaagtcagtgatgatgttattcaacaatggtttaatccggctgaaaacgaattagttgacggctatattggtgatatgggttctcctgccgctgctggtaatatcttcttacatgaaagtactgtagcacgtcaactttatcagttgtccactgcttacgtctcaaaaaatgatgattcgacaattcgttcaattcaattttatgatgatctagttggatacatgaatcattatggagcactaaccgataatgaaagccgtttgttcaacggtaagttttatgcatggactccagctattaacccaaataaaatgaacaattttagctcatatctttgggatactaaaaactcttataatattacttcacctgattacattgtaatggaacgtggagcacttaatggtaatacatggtcactacaaaacttttggtatactttaggtgaaacattagaagatggctcaatattaactgaagaattaatgcaagattcacgtttta

SEQ ID NO: 4 - DNA, 170558 bp, Unknown
  Myoviridae; Tevenvirinae; Rb69virus
tattgaaggtgtaggatttgacatctcttattctagctattcattatgtcctatgagccgagcccatggtaaagatgtatcatatctttcaattcggaaacgtgtaaacttcaaacgtagtacagagtatgttggtggactctttgttaaagataataaaataacccgtattagttatcctttaagtgaaggtcaaaaagatgttgatgttgatttagacttaactgaaaataacattaatcatattgcttctgtatattttgatatcgatgaaaaaattgtagtgtgtggatacgaattaccacctgaagaaaaggctgaagcaattgaagtcgaattagaaatttctgtcgatgaccaaatatttaatgcatttatgaatcgaggttaaaatgactactgcaatttgcactggttctaaaattagtgtttttacaagttttgaagattacgaagttgtttcaaaacaccaatgccatattagcgtaaaagctaatgatggtgtaatttggaatattccacagtatgaaggcactacatatgaagtcacggatataaatggtgacaaagcaatctttgtaattgattaaatatactcaggaggtacctatgggtattattaacactgcaatagattctgtttatgcatataagtttattcgactaatgcaaaaaccttttaccgaatggaaagcatacgaagccaaaatcatcgatgaacgtggaagtgttcttaaacgtccttccactcctgaagagaaagcggcttatacaccttttcatgcttcagttcgttcaatgaagcgaatgatgagcactgttccaggtcttaatggaatggcctcaatgatgtctgcctggagtgctgtagcttcacgctataacattacggaagaacaacagaaagaaatatttaaagaactccctttatttgaggatatggttgccggcgattcaggcggtagtcctcaagctattgcatcaggaactacttcaggtgcagtcgtaaataaaggtccagaacaaattccttccaagaaaagaaagcgaattaaagtaaatattaataagttgtgatatgatggccttattaatttaaggcctctggagaatactatggctgaatggatagataatgaatttgcttatcgtgcgttttctcacctacctcgttttagacaaatcaataattcaagcacatttaaattaacatttcgatgtccagtatgtggcgactcccagacagatgcaatgaaagctcgcggatggtattatggcggtactccaggtaatgtgcattgctataactgccaatatcataatacaatttccggatacttaaaagagtatgatgaagagctttatcgcgaatatctaatggaagttcgtaaagaaaaagctagaatggaaccaaagattgaaaaggttcctgaagctaagccggagccagagaaaaagactataaattctttgccgtcttgttctcgtctagacaagttgcctgaagagcatcctattgtgaaatatgttaagtctcggtgtattcctaaagaatcatggaacagattatggttcacattagaatggcccaaattggtcaacaagattcaacctggtacgtataagaaagagattcccgaaccacgtttagtgattcctatttttaataaagatgggaagactgagtcattccaaggacgtgcacttcgtaaagatgctcctcagaaatatatcactattaaagcgtttgagtctgcaacaaaaatttatggtgttgaacgtgttaaggaaggagacgtctgggtaatggaaggtcctattgatagtttattcatacccaatgcaatcgctattacaggcggctcaatagatttagatgtggtaccatttaaagaacgtcgggtatgggtaatggataatgaacctaggcatccggatactatagctcgcatgaagcgattagttgatgcaggcgaacgtgtcatgttctgggaccgagctccatggagatcaaaggatgtgaatgatatggtaatgaaagaaaatgcaacaccacaagaaattttagaatacatgaaacagaatatttcaagtgggttgcatgctaaaatgagattatctcattattcgaagatttaaacaagccctataatagcaaaggccaaatcgactacagtatccaatggaacagaaggaactataataccattagcaactaataatggtgcgataccgaagttccacgaaataatgccacctacaactattgcggcgatagcagttttctttttattgcctttaatagcattgattaacgatggaagtttaaacataatatctccttagttacctattatttattacgctttataaaattaatgttagaattatctctcttactactgaattgaaaggaaaaattatggcgcactttaacgaatgttcacaacttatttctggtgctgataaagcagaagaagcttattttaatgctctaattcacgaagataaagacccactgcaggtaatgcttgatatgcagaaatctttacaggttcgtctggcaaatgacaagcctgaacataacaaacatcctgatgaattggctactgccggtgatgttgttgattggctgcgtaatcagaaagattatattgatgatgaattccgtgaactgctgacttcacttggcggtatgagcaatggtgaaaaagccgctagctctgtatggaagccgtggaaagcacaacatgctgaatatcgaaatcgtcgtatcgatgaactgtctcctgaagatcagcttgaaattaaattcgagatgattgatatcctccactttgttctgaacatgttccaaggtttgggtctttccgctgaagaaatctttaaactgtattacctgaagaatgctgaaaacttcgctcgtcaagaccgaggttattaatggctcgtttaaataaacgtcagcttaagaaagctcataagaaacgtattgaccagctatttaaaaatgataacagtgagattatttgtaagctcctgtctaatcagcttcagcatgttagtcaattatcagaccatctacatatggttgattgggttgcaaatgaaacttgatttttatgcatggcaaaaagccgggaggccggctaataaagcattcggctctgatggatataatactagactccactggaaatttaatactcaagatgattattctccggtaatcattaacggtgatgttgttatattagctaaattcggatattttattgtcccgaagaaattcattataaatacacctgtaattaaacaacaaaggagttaattatgggtggttatgtaaacatcaaaacctttacgcatcctgccggtgaaggtaaagaagttaaaggtatggaagtttctgtgccgtttgagatttattcaaacgaacatcggattgcagattctcattaccaaatctttccgtcggaaaaggcagtttattctgatgtcgtttctgatgcagcaacttggaaaactaagaacgcagcaatgtttacccctacaccagtaagtggttaaataatttaaggaatccttcgggattcctttttttttttgtttctacagtttacaaccactaaaaactgtgttaagatattcttacttactcaagaggagaacaatatgttaaatcgttggattaaacctaataacacattaggtgctttgattgctcaagaagtttcattaaaatacggtcttggatattacgatgatgtagtcgtacactcattcatgatggatggtgaagacgtcaaatttaatgccgaaatccgttgggatgacggtggtgttcgttttgttcgaggaacaattaatgcttacgatgctgaagaagttgtttgctgttaaaccaggcgaaggtatgatgcctattcctgatacacatgaaaaggcttgggaatacattggtgacggcatgatggaagaagttattcgtccaaaaacaaaacaagttaacgcttcaagctcttcaagttataatcattcatacgtatcgtcttggcctggtgattccgggtcaagttattcatcagattgtggttcaagctcagggagctgcgaatgaacaagatagttaaatggtttaaaagctgggacgatggtgtcggtccagaagattggctggatgttcttgaagagaatatggctaaagaattccagaaacatgaagaaaagctcgtcgaagatgaaggcgaacgtattgtaaaactttatatgggtgaaccatcgaggaaattataatggatgctatgctatttaaaatgtatttgcttgaagccaagtcatttaaacatataccagtggaagataagactccactagaaatagctattctcattaacaaaagtctaaataatccgcaatatatcgtagaagaattctgcaaattgcagattcctaaaggttacaaaattcgtgtagagcgagttggagctattactcgttctaaaaattctccgtttagtcttgaagaaggcataaaggacttaggttatgaatctacggaaaatgcagtttatgtgaatcctgaaaagcgtttagacttgtttgaaaagcgagaccataagtattttgccaaaaaatactttattacatcattagcagatttagtccatttgcaacgagctatttggaaattttttaagacaaaaggtgtagcactagaaacattctctgaaccagctagtttttatctaggtgaataatatggaccttatgagtatgtttgacgagcctgaagttgaggctcctaaagtgcatcgtagtgaacttattgatgaactagatagtattatacaacgacacggctttagtttacctgttgaagccctgaaagaccttgcctcttattatgacgacccgccaccatggagtccttggaaatgaaagagaaattgaaagagaaattcttactagaaatcaaggaaaaagactttgagacatggtatcgaatggtgaaagggctgacattgctttttaaagcgtccttattcatgttagaacaacctggccctgatggacctttagtaggaaagcttaaaaagtagtttacattccctcctctcgtgttatgataggcttatctttaaatggaggtctatcatgacatgtcaatctgaacttcaagaacgtgaatacctaacaaatctgattgatagcaaattcacccgccaagaacaaaacattctctgggcttgcaccgattctaaggaagacccggatttccactatgaattagaccatcttgttcgtaagcatatgacttctacagtaccagtagaactctaccgtggtgtaactccagaagaagcagaacgtctttcccttctttctgttggatgccattggtctcctggacgagtaacatcgttcacaactgatttcagtacagctcgtcaattctccgggagatgggaatatcagacgtacactattcttagtctcaggaatgctccattcatttttgattactaccaaaacatggttaatattgtactcgccggaaagaaccctaagcatgttatggaagaaacgcgtgttgacgtcctagatatgattgaatctgaacaagagtacatggtctcaggtatctctagatttgagattgtggaaattgaagacttagaatatgaccctttatctcggttatacaaaatcattcatttgaaaatgttgaatttttagtgtacaaactcttccgatgatgatactatacttttatcaaccataggagaaacctaaatgtttatgccgtataacgagtgtgaaattgaagaaatggttcgtcgtgctcaaaaccccgaatatcaagatgtattgcagtacgaaattgatagtcaattcagcgacattgaacaaagcgtcctttggcagtgtatggaaaacaagccagactgtattcaacaggagttaagttcaatcgttcgtagaaattggacgtcttctgttcctgagacaatgtatcgtggaatctctaagaaaactatggccacactcgatgataaaggtattggtagtattattaaatttgacagagtaatgagctttagcccagtgttcggtgtagcgcgtaactttgcttcgtataatttttacggaacatttaatatgttctgcatcaaagatgcaccatttgctttcaacttccgtgaacatatgcttaacatgattctggctgcgccatcttgcgagttcaatggagctttccctgaagcgacaagacggtctaatgctagacttatatctgacgaatgtgaatttatgctccctatagggactacactgcgtgtagattctattattcaagatggacgttatacaatctggaatctgtctattgtcagttactgactgaattggaataaccggatggaactcagaaccattataacacataaaaaattaaagcattttatgaaaaaagagtgtacactacctgagggcatgatattataagcttatcagctaaatgacctaacgtccgtaagacagaggaaaatattatgttatcaaataataaaattaacaaaatcaatcgtcgtcttgaccacaccagagcttctgcgaagagacgctctaaggattttaacttagactttaattaccttaaaaacattcttgatcaaaaggtctgcgcttactcaggtgaatcttttaataactctgttgaaggtgagaaattatccttagaacgttttaataatgatatcggctacattaaaggtaatgttatcccagttaagaaaaaatataacacggctcgttctgatttaacattagaagaacttattgagaaacgtgatgccattgcaagacgtatcgctaatccttctgcccgtaaagtagagaaacttaatctcgacgagaagaaatgggcccaaattaaaaaggtttatgatactattttaaaaatacgagcaaaacgtgaaaatcgtgttaagcatatggcgaacatgatgaaaaatcaacctttatctaacgaatctaaacttagaattgttgctttgaaagcacgcattaatggctcacatcaagcagaaggccatgaacttactaaactcaacgttcttcttaaaggctctgactggaaaactaaaactaaattaactgacgctgaatcgcttttcgatacatatgataaagttatccaaggtctgcaacgttttgaaaagattggtttcattggtaaattaaaattgaaacgtggcttaccacttagcgcatcattattccaactgattaaaggttaattatggtttatgtatatgcaatagtttatcgagatatggaaggatttactgtcccggttccacttgatgagcatcgtcctgcagtattttttagaaaggatattgcagataaagttttcgatactttgaaaacacagtataaaacagatttaaaaatgggagttctaagaatggtcgaaactccgcgtaagttctggtttaataagcttgaaatgaaacacgttaaactagatgcggagacgcaaagattgtatcaacgaatcctggacacaggccgtattgttagtattccaattgcagggactttacgatgacatttgatgatttgactgaaggccagaaaaatgccttcaacgttgttatggaagctattaaagaaaagaaacatcatgtaactattaatggacctgctggtacaggtaaaacaacccttactagattcatcgttgaagcccttatttcttccggagaatcaggtattattttagcagcccctacacatgctgctaaaaaggttctaagcaaacttgcgggtcaagaagcatcgactattcatagcattcttaaaatcaacccaactacatacgaagaaaacgtattgtttgaacagaaaaaggttcccgacttagccttgtgtcgtgtactgttatttgatgaagcgtcaatgtgtgaccgttctctgtttaaaataatgttagctagtatccctaaatggtgtacagtaattggaatcggcgaccgatgccagattcgtccggtagacccaggcgaatcaactgcgtatctaagtcctttcttcactcacaaagacttcgtgcaatgcaaccttacagaagttaaacgtagcaatgcaccaattattgatgttgcgactgatattcgtaatggcaaatggatttacgataaagtagttgatgggcacggcgttcatggatatacagaccttaaatcgtatatgatgaactattttaacgtcgttaaaactcctgaagaccttttcgaaaatcgaatgatggcattcacaaataagtcggtggacaagttaaattcaattattcgccgaaaacttcttgaaacagaaaaaccatttattaaagacgaagtcattgttctacaagagccatttactaagacatataagctagacggtaaaaatatgaccgaaatgcttttcaataatgggcaattcgttcgtattcgagatgctgtagaaacgtctacattcgttaaagcacgtggtgtttcaggcgaatatatgatacgatactggaatcttacagtagaaacatatggtgatgatgaagaatatatccgcgaagatataaaggttatttcttctgaagaagagctttataaattcaatttgtttttggctaagaccgcagaaacatacaaattctggaataaaggtggtaaagctccatggagcgaattctgggatgctaaacgcatgttcactaaggtgaaggcactacctgtatcaaccttccataaggcccaaggtatgtctgttgacacggcctttgtttatacaccgtgtatccattacgccgattcggaattagccaaacaattactatatgttggcacaactcgtggtcggtttgacgtccattttatttgagagaaaattatgagcactgatgttattatagattttgaaacattcggcaatacatcaaaagcggctgttattgaccttgcggttattgcatataattccgaccctgaagttgttgaatcatttgaagaacttgttcaacgaggtaagcgaattaaatttaatttagcttctcagaaagggaagcgagttttcgctaaatccactatgaaatggtggaaagaacaatcggctgaagcgcgtaaaaacctggctccgtctgaagacgatgtcactacgcttgaaggcattaaaatctttttagattattgccgagctaataaagttgaccaatggaaatcacagatgtggtgtcgtggtatgagctttgacttcccaatcttggtcgatttgattcgtgacctctatcgtgatgaaggtgttcttgaaccagatattgatactgataaattagaacctgttaaattctgggctcaacgcgatattcgtacggcaatcgaagcttactcgttgacacgaggattaagtatgtgtccattaccaatgggtacactaaaaggattcgttgcccatgatagtattcacgattgtgctaaagatattttgatgttaaaatatgctcagcgttatgcgcttggccttgaagatgtccctgagaatcctgacccgttaagtgtaaaacagcgataaaaccagtttacaaccaaggatggttgtagtataatctttctatcttaactaaacaggaaaaacattatgaatatcaatactacggctacttacatcctgaaagacgaaaaacaaattaactggtacggtgcttcagtgcgagcttatgaaaagttttgtgaaattttaggtgccactcaaggtaatagtttcactattgttaacttcatcaaacaaacggaaggcccttggttattcttagaaattaaaaattcatacggtacaatttctactaccgcccttccaagcacagactttgaactgttgattgaagaagcacctgttaaagatggtctccactttgatatggatatcgcttgtatgtacggtactctgattaagcctattgagcctattgagcctactgatttgttgtgtaaagctgtttcaattcgacgtccgttcgcaggaccagtgagtggatgggtaactgaccaatggattgaagacggcgttgaacttctgaacgttgttcatgcaggtgattttagtgtagttccacgtagtgctgtggttaatatccttaattaatgttgtacatccaaggatggatggagtatagtgaattcaatttaaacaaagagagagaaattatgattactattggtgaaatccttcgtgtatctcctgcttctcgttctaaagctgcaggtcgtttggttgaagtagcagggcttcgtactaacggcatgggacgtgttaaagaagttaaagttcgaatcatcccgagttttggcggacaagatgcccagtatgcttacgtaagtcctaaattcctggaaaaacatatacgagtccaatttgcttcaagcgaagaagttgcacctgcacactttgcttcaaacgatatcgttgagcctactacacagttcaaatgggccctttgcaaaggcgttgaatttataaccgataaagaatttgattacatcgacgaatacggttatccaagcaaaactgatactatgtgcggcttcattagtgaccaatgggttgaagatggtgaaaagttatacaatatcgtattcttaggtgacttccgagttgttaaagaatctgaaatcactcgctatgtgtctcctcgtaaagcttaaggaattattatgaatattgcaaatctctctattggtgattatgtacacgtatcagatgcttctcgctctaaagttgctggtaagttggtcgaagttctttctgtgagtgatccggtttttggacgtaacgaagttaaagttcgtgacgctgatggtaacattggttacgttaaaagccaattcatcgagccagaagaacgcgcgttcaaatggaaactgtgcagatcggttttagttgtaaaagaccacgagttcaccattgctgcggcaacagatggaacaccgtggacaacgaatcaagttgctggttttatttcggaccaatgggtagaagatggtgttaagctttataacatcgttttcgctggacagttcatggtagttcctgagttccaaatcaaaaaatattgtccagcatcttttgcataaagttgtttacttctcctccggttttgatattatacccatatcaaccagaggagaataatatgttagtttaccgcgtagaacgtagtttttgtactcaacgtgaatcattaccaggaattgctatcgaagacggcaaagccgtcagaatttgggaaacatcttggaataaagaacctcgctcaccatacggttggtcaggcaccgacaactctgaagaaacatgggagtttcttgataagcatggaatactctcaggtaacttctaccatcacggtgacaactataatgtccctaatcgtcctacagtaaacgaagataaactccttgaacaaaatatcttaagatactatagaattgagcacacatttgaattgagtgaagattgggctcaagggttctattttggatttgaaagtgttgacgcggtttatgcatggtttgatgaccaggtggatgttgaactcttgaaagctaaaggatactacatcgcggtctatgaagcacctgatttcatcctcggaagttgtcaattaatgtttagacgttcattggcagaacaagttgattttattttgctaaaatgatgtacaacaactatagtctatgatactatagacctatcaaaacaagaggagaatattatgaaacgtcaaatcattaaaaacgtaactactgattcaaacatcgatgagtttgaagatgttctgtttaatcctgatttagttgttgtacagaaaaactggactgaatttttatgctacaccgaagtggtttacgtttacgaaaaacttggtgatgaaatgcctatctatggtatcttccgtgaaatcactgaaaacggtacaacttattggaaggaaacttactaatggctaataaattccgcgttaactcatggtatcaatttaaagataaacgtgcccaagaagagtttattaaaaaccacactgataatgggatttatgcatgtcgtcttggcatggaaccatttaaaatattagatgttgaccatcttggtcgtcctactaaaattgtgacatctactggcacggttggatacgcaacaggcggtgatatccttgatgaaaactttatctggctctctactagtgaagcagagttttttgatgaagtgggaaatccgtatcaagcgtctgaagagcaagattctgatgaacttgacgaattgtctgaatttcctgtgatgactattactatcgaaaataatgaccaggcatggtctttgtatcaaatgttgaaagctcactttaaggaacaataatgccgttatacgactataaatgccaatctgaagattgtggtcatgaatatgaaaaaattaaaaggatttctgaacgagaaaacgatgtttgccctgaatgtcatcgtctgtctactcgtcgggtttctgctcctaaacatgtgaatggtggtttttacgacttacttaagaagggttaattatggcttttaatacggcttttaaaggttttaaaggttttgaagttggtaagaaatatcgtattatcaaaggacaagaagataatttcttgagaattcttaatacgactggtaaacgtcttaatactaatctgcatactactttattgtccaaagattttattgtggaagagatgattggttatggcgtttcagtgattgctgtagaagccgtaggcgattatggccgaactattcatagtatgcaaggtgatattctgatttacggtgcagaatttaaattctttgaagaagttccggaaccagatacaactgtcgatttcaaaaaaggctctatagaatttgttgatggttcggtgatcgtatcaggcgatgtggtcattacagttaaaagtgaacaagggcgtttagctgcaattgatacacttcagaaaattaaatttaaataagggcttcggccctttttgctttagatttcggatgatagaataccttcataacgaggagacaacatgattaaaaatgaaattaaggtattgtcagatgtagaacatattaagaaacgtagtggtatgtatattggttcttcagccaaagaagcacatgagcgttttttgtttggtaaatatcaacaagttgaatatgttcctggcctggttaaattaatcgatgagattattgacaactcggttgatgaagctattcgtacatcatttaagtttgcaaataaaattgatgtgcaaattaaaaataatcaagtttctgtggaagataacggacgtggtattcctcaaggtttagttaccgaccaaacaggtgaacaaattcctgggcctgtagcagcctggactattccaaaggctggtggtaactttggtgatgactctgaacgcaagactggtggcatgaatggcgttgggagtagtttaactaatatcttctctacgttgtttacaggcatcacgtcagatggcgaaaatgaaatcactgttaactgttcaaatggaatggaaaacaaatcatggtcttctaagaaatctaaaggtaaaggcactaaagtaatcttcactcctgatttctcttcatttgaagagcataatttatctcaaatttatttagatattactttagaccgacttcaaacattggcagtcgtttatcctgacatcaagttcacatttaatggtaaaaaggttgatggtaattttaaacgatttgctaaacaatttggtgaagataatatcattcaagaaaatgataaagtctctatagcattcacaacatcaccagatggcttccgtcatttaacttatgtgaataacatccatactaaaaatggtggtcatcatgttgaatgtgtaatggatgatatctgcgaacatcttttgcccggtattaaaaagaaatataagggtattgaagtcactaaagctcgtgttaaagaatgtctcacaatgttgatgtttattagagacatgagcaacatgcgttttgattctcagactaaagaacgtttaacgtcaacgtatggtgatattcgtaatcatatccaattagatgctaagaaaattgctcaggcacttcttaaaaacgaagccttgattatgcctattgttgaagcggcattagctcgtaaattggcggcagaaaaggctgcagaaactaaagcagctaaaaaggcaactaaagctaaggttcataagcatattaaagctaaccaatgtggtaaagatgcagatacgacattgttcttaacagaaggtgattcggcaattggttatctcattgatgttcgtgaccgtgaactacacggcggattcccattacgaggtaaggtgatgaacagctggggtatgtcatatgctgatatgatgaagaacaaagagctctttgatatctgtgctatcacaggtcttattcttggtgaaaaggcagagaatacgaactatcgtaatattgcaattatgactgatgcagatcacgacggtcttggaagtatctatccggctttgcttgctttctttagtaattggcctgaattgtttgaacaaggacgtattcgctttgttaaaacgcctgtaattattgcacaaattggcaaaactcaaaaatggttttatactgtagctgagtatgaagaagttaaagatacattgcctaaacatagtattcgatacatcaagggattaggctcccttgaaaagtcagaatatcgtgaaatgattcaaaaccctgtgtatgacgtagttaaacttcctgaaaattggaaagaactctttgaaatgttgatgggtgatgattcagaacttcgtaaagaatggatgtcctaagctccttcgggagcttcattttaattttaataaggcttaattatgaaagttatgtttatcccatctcgcgcagtcccatttaatcctgaccgtgtacaaggtggacttgaagcagtacatttaaatgtgttgaaatatcttgtgtccatcggtgctgatattgattatatcggctttgataatgacacgtttggtgactggaaagttacacaccatcctgttggtcatctgactaaattcagtctaggtatgagttatactatggctcgtaagattgttgaactagccggcatccatgaatacgattttgttgttactatggaaccgactaaactaaccgttcaggcaattaaagacgcaggtctctctaaagttcataagaattttatggctacgccgtttgaaccggtgtctcgtggtattgttcaaatttgggatcagactatccagattcacaagaacggtgggaagagctatgctcctactaaagcattccgtgaatttgaacgtaaatattgtcatatgacttcagctcttactgacaaaattgattatgactactggcgtgaaaatccattatttgaacctgatgactacccggttatttgtttgtctgaaaagccagaagttctcccggcaactgatttgattattagtgctcaacgctatgacactaagatgcgtcgcactgatgttgctcttgaagcaattaaagcactaggcgaaaatggtattggttattgtccaagcaaatgggcaccaccagctaaatatcctgttattattgatgctccacacagtgaaatcatggaacgtcttaaaacagctaaagcacttattaatacatgtcctgacacaggtacggtagagaatagttctattgaagccatctctaaaggtgtccctgtaatccagttagtttttaaggattatcctcatgcgacattcgaatacgacccagatactgtgcgtgtagaaattgattcctctactcctaagaaagaagtagttgcgctttacacaaaagctgtattagaattcactgacacatacgaagctcgagttaaacgtgctgaagcagtatggaagaagtataatcgagatgcagttgttgcgatgtgggataaaatcttcacagcgtaaatcctgaatagcctgaggcactattactaaagaccatataatttatcatcttatgtgtaatagtgccctagcaatctactgaagagaatattatgagaacgtataacgtagacttggaactttttgataaagcagtgctccgggaattccggcttatccaaagattttttgatatcgagtcagcagagtcctttaaagaacgctttaaagaaattcgatataaaatacaaaccgatacagctactaaagaagaacttctcgaagtggcagaaatttttaaacgtaacttgtgatgagagaaaaatatgattattgaaacggctaaagaaacgattattggttctggtggtaaaagcacagcatttactattcaaggcaatagcaaagtttataagattttgtctaatgacctttatacaaacaaagaattggcttgtgtacgtgaattaatcacaaactgtatcgatggacaaattcttaacggttgcactgataagtttattgttcaggctccaggtcgtttagacccacgttttgtagttcgtgactttggtcctggtatgagtgatttcaccattcgaggtaatgacgaagagccaggaatctataactcatattttgcttcaactaaaacatcgagtaacgatttcattggtggattcggacttggctctaaagctccactagcatataccgatacgtttaaccttacgtcttatcacaacggtgaagttcgtggttatgtaatttaccaagatgacagtggtccgcaaattaagccaaccttcgtagataagatgggccctgatgaccgtacgggtgtagaagtagttgtaccggttaacccagaagattttgaaaagttcgcatctgaaattgcatatgttatgcgtcctctaggtgatattgcagaagttcgtggtgttaaagatattaaatactttcctgaatttgacgatgtatatttagccaaggaagctccatggggtgaacgtggtaatatcatggctgtttatggtggtattgtatatccaatcggaagtgttattaaagaacaaacatggatgatgacgcgatgcactacagcttatattaaattccctatgggtgaactagatgtagccccgtctcgtgaagcattgtcatttgataaacgtacagtagcaaatatccataaacgcgttgcagaaatcgatgcaaaattatttgctgaagattctaagaaatggattgattgtgaatatccacgtcatgtattccgtgaaattgattctcttggttataccgctcgtaaatacatggaaaaggctgggtctaatattgaatcgctgaaatactctaaagaacaactaacttattccgagttgtacaaacgttttaaaatggggcctgagtggtgtaatcttggcgtcgtatacgatatcgttgaatcccctcgtcttcgtcgtattcgtgaaagtggtagctcatcggcaactatttcaattaacagtctgattggcattaacattaaaaacgttgaaattgttattgacgacgttaagggacgcgttccgttaatgcgagctcttaattcaattgaaatgtctaaagacgaggttaaattaaccggtaaagttccacgaggttttggtaaaagcgtactattcgttgaccctacagacgaagatgccatgaaacttctggaacgtcttaaagttatctttgatggcgacaacattaacatgtacaagacttcagagcttttacaaatcgttaagccatggattgaagtcaagactcgttctaatgggcctcgtcctaaatctccaagtgctcatcggttctttaagaatgaaaacgatgtttgggtatcagaagatctctttattccagcgagtgaagctgatgaaatccaaggttatgctatagttcgtaatcgttctaatgctgaatgtcttgacgcagataaaggttggttgaactacgattctaatttcttgactcgtattgccgatttgtcaggtattaaagagttcactgtagttcgtccacagattgctaagaaagttcgtaaacttggtgaagtagaatgtttgtttgaaaaatcaattaatgactatattatgctaattgataaagtggattatgatgagtatgtatcaccaagtcgtagagcacagccttatttgaatcatattactcgtaatgaagagcttaacttccttagtaaatattttagctctaaaaacaaagaaatcagtaaagactttgcaaaactctcaacagtaaataatcgttggggatggaatcgattcgcaggtgctactaatacagacctgaacaggaagttagaattgtgtgctaaaattttcgataagcttaaagataatgcttacgataatgatgataaaatggttattgaatttgaaaccaattatcatattgtgtcagaatacatgggacgacgtggtactctttccaaagaacaggtcgctcaaatcgttaaattcatgaaggccgtggaagcggccaaataaggaaacattatgtacaatatcaaatgcttgtcccaagaagaacagttagaagcttacggcctggttgaatcaggcaaatggactcgtaaagaaattgccgattacttcgacatttcaacagatactcttcgtaagattgttaagaattttaaagctgaaggcgttgtccctgaagcaaacgatgcctcttatgtaatcgaagaagttccagaaaatgatgaacctattatcggcggacatcgtcctgaaatcatatggaacgcgtcatctaaatttatttcaatcattgaaggacgcgtagcatacaatgcgaccccatcaagtcatgcaaattttgaagaaattaaagctaatctggtcgcaggaaaccttagtaaagctgtcgaacttattaacatcaagaaagctattagtaagtttgttgacggtaatgttactattgaaggtggtagtttattttatcaaggtatagaaattcgttcaggactggttaatcgtattattgattccatggaaaaaggtgaagactttaaattctatctgccgttccttgaaaacctgttagaaaacccaagcgaaaaagctgtacaacgtttattcgacttcttggttgcaaacgatattgaaataactgaagatgggtatttctatgcatggaaagtagttcgtaaagactatttagattgctatagtggcacatttgataactcgcctggtaaagttgtttcaatgcctcgtactcgtgttaacgatgatgatacacaaacttgttcccgtggtctacatgtttgtgctaaatcatatattcgttactttggttctagctcagataaagttgttaaggttaaagttcatccacgtgatgttgtatccatcccagttgactatggcgatgctaagatgcgtacttgtcgttatgaagtaatttcagacgttactgaattatttgcagaataataatcggggacttcggtcccctttttttctttaggggtaattatgattcatccatttgacgtatcagaatccaaaattgctaatcttcgtggtcatcataagtgtaaatcagtttattgtgctaaattggtaaaacatcctggtgatgcacactacggctggttagaatgcgacgaagttgttattgaaatcccaccggtagatgctaactatcttgaagaaggagaccgcatttattttggcgaactacatatcagaggtatctatggtaaagacgaacttgggactgttgagactgaagaatcttccgacatttatcctgtcgaatgagtttttgactagtgaaatgaaggtgaagattgctgacactgctcggtattccctgagccaaaatcctgaccaaaacaaagaagatgtagttcgacgttgtaaggttgcggtctttgcagagtatgtggtagcaaattggctagatggatatgttaataaaggtattgaagacgtagaagacccatacacgtacgcgtgggacgtgttagcccatcccaagtattgtggaatccgtgtagaagtcaagacacaccagatagattctaaatggatttcggttaccacaggatacagtggtgattatcctggtggtaatggaatcaatatagggcccttcttgaaccatcgagtcgcagattgcattattatattagatgtcaaagaaacctcacctgacgtcttctcttattctataaagtttgtgggagaccatgaagacctaaagaaaatcgtccgcaagagcaactacaacgggtggtatcttcatctttaatttcataaaagtgtttacaactaagtaggactatgatatagtagtcctatctaaaagaggataacatcatgaaatttaaatttttctacgcaaaacataaagtaacaggcgaatttgtttcaatgtacaacaccgccgatgacgaagggatgatttatacccatttggggctatctcattgggactcagacgtgccttatatgtcatctgaagccgaaataactcgtttagttaacgggcatatgaacgaccattttaatgtcattctttctaaagaccttaaagagactatcaacaaaggatatatggaactggcggaagttgagatatgagctctaaaatgtggatcggaatatggttgcttagtatccctatgatttgtataatattttcaattgcattgaggtacttatgaaaaatgcacttcttattgtactaagaacaatttgtgatgcgtggttttacatcgcatgttcgttcactggaacatggttggctttaacatattttaatgtaatttaattgtttacaacaaggtaggattatggtatagtagtcctactgaaacatgaggaacacaaaatggctaagctttttaaagatgttgaaattggtgaaaaatttgttctgaataacggtcagcagcttattcgtgtagcttctatcgccggacaaactcataactgtatcgccccaacgtgttggactcgattctttattgaagatgacactgaatgtttaactgttgaagagctttttgaacgttctgatatggccgaataaaattgtacaaactcttgagagcagagtataatgctctcatggattacaaaaacattaatcaattgaggaaattagtatgaccaaatatttaactcgtaaagaccttctggccgttggtggcgaagttgttgcagtagttcgtaatggtgaatacggttctgaagtttctaaagagtttcgttctcgtgaaggtttttacttctttgttaaaggttcatctgattggcgacaagtagcagcacgattctttgtaggacgtcaacgttctaaacaagggttggatgcaattctttctcacattcgtcaaggccgttcgcaactagcccgtaccatgggtactaacaatattgaatatgatgtaatctttgttgcagctaagaacatgaaacccctgaccactggttatggtaaaggacaattggctctggcattcactcgcaatcatacatcagaatatcaaacactcactgaaatgaaccgtcttctggcagataatttcaaattcattctgcagagttactaatttatatgggcctagattaataggcctttaaatttatttttgaggtaattaaaatggtatcatggattattgcattgctgtgttggtcgtttttattcgttaacactttagttacaggcgaaacaacagtatttcaacaggctgtatcacaaggcaccttagcggtcttagctcttcttaacgtgttaaaaggcgagtaatgattaagaaaatcttagcaggagccttagggctcttgttgttgcttacggttctgtactatggtgtgatgtttggactaatccaagtggtgcttttcatttcagatgttataatggttattcgttcattaatatggtgaaatatgcaattgaattctcgtaatctaaaaagtattattgataacgaagccttagcatatgcgatgtacaccgttgaaaaccgtgcaatcccaaacatgattgatggatttaagccggttcaacgttttgtggttcatcgtgcgttagatttggctcgtggtaataaagaaaaatttcataaacttgcgtcaattgcaggcggtgttgcagatttaggttatcaccatggtgaatcttctgcacaagatgcaggtgcattgatggctaacacatggaacaacaactatccactgttagatggccaaggaaactttggttctagaacagtccaaaaagctgcagcatctcgttatatttttgctcgtataagtaaaaatttctataacgtatataaagatactgaatatgctccagctcatgaagataaagaacacattccaccaaaattctatcttcctattattccgacagttcttttgaacggcgtctccggtattgcaaccggttacgcaacaaatattctgcctcatagttttaaatcagttaaaaaggctgtattacaagctcttcaaggtaaaaatgtcactaagccaaaagttgaattcccggaattccgtggtgaagtacatgaagttgatggacgttatgagattcacggaacatataagttcacatctcgtactcaaatgcagataactgaaatcccatataaattcgaccgtgaaacgtatgtgagtaaggttcttgacccgttggaagataaaggtctaatctcatgggaagatgattgtggtgaacacggctttgggtttaaggtgaagttccgtaaagagtactcgcttcctgatgatgaagagctacgtcatgaaaaaatcatgaaagattttagtctcatcgaacgtcgttcacaaaacatcacagtgattaatgaaaagggtaaattagcggtctacgataacgtagtggacttaatcaaagattttgttgaagtccgtaagacttacgttcagaaacgtattgacaacaaaatccttgaatctgaaaaagcatttaaacttgcttttgctaaggcacacttcatcaaaaaagttattgccggtgaaattgtgattcagggcaagacccgtaaagctttgactgaagagctagcacaaatcgaaatgtataaagaacatgtcgataaactggtaggtcttaacatcttccatatcacttccgacgaagcccgtaaactagcagaagaagctaaagctaagaaagaagaaaacgagtattggaagtctactgatgttgtgacagagtacactaaagacttggaggcactttgagtgccatagccttaggatttctcggtgcaatagctgcactagtgatttggctgtattggttggacaaacatgattagggagcttcggctcccttttgtgcattttttctcacaaaaacagtttacacgtgcttcaagcatgatattatagtcctatcaaaacaaaacaaccaaattggagaaataaaatgtctaaaatgaaattaacccaaaacacaactactcgtttcggtaaagttaaacctggtatgaatgctctccgtaaagcacttgttgaagaattaaatttcttagaagttgaaatcaattctttagtggttcgcggttcaaatggacatcatttagaaaagcttcgttctaaaaaggcaaaacttattggccttattaaagaaatgagtttgtaaattttaccagggcttttgaaaaagagcccaaaataaagtttacttttgcttcaaacatgatattatagacctatcaaaacaaatactaatttggagaaataaaatgtctaaagttacttacatcatcaaagcttctgaaaacgctctgaatgaaaaaactgccgcaataatggtttatatcattaagaacaacttcaccactgctgccaatgtccgtgaagctctggaagcagaatacaatgcgtcagttgttaactctaacattggtgtattgattaagaaaggtttagtcgaaaaatccggtgatggacttatagcaacaggcgaagcaatggatattatccaaaaagctgcagacctctttgctcaagaaaatgctccagaacttcttcagaaacgtaacactagaaaagcacgtggagttactcctgaaatgcatgaattagcaaactttgtttttgaaaatattaaagataaagttgaagttaaagaaattggtgaaaaccgtagtaacttagaagttcgattcgctaaacgagttctaggcattcgccaaattgaaattcgacgagatggcgctcttagaatctttgcatataacatgtcagaaactgaatcaaagctgtttacttctcttgaaaatgatgttaagattaagatcggtggtaaatatacttacattgacttccctaatgtgtcaaaagaaatcattactcttgtaactaacgtactgtgaggaatacataatgaataagctgaatattattaacgaacttcgtaaatgcgcagaacctactcaggaaggatgggatatttggtaccacggggcttatttagggacaattgtaaaggttaaagctgggttatatttaattattcgagaaaattctgaattccctaatggagtagctcctggtggtcttcgtaaaaactatatggccgcgatcagttcatttgttgatgcagcttacgaaatctataaagaagattataaagaatatcagcagtcacaacctgttattcgttcgattggtgtaaataaacaagcacaaaaatctatttggcaacgtattaaggaatggtttaaatgaaatcatttaaagaacgtttagagctattagatttggccttgtctcgtgagactcctgaaagtctagcagaaaaattccagtcctacggttataattattctgctgatgatataatgaatgaagttcctgaaatctgttggcaaacatgttattggaataatgaccaaaaagttcaacgtgttatagtatgtgcggctaataggtttaaattgaagagcggtggaactctggttattcctggagttcgtcattactctaaagatatggctgaagtacttgatatagttggtcctcaattagtctcgcaacaagtttgtggtgacgaccaaggctttatcgaccaatactctaattactggactcgtgaagaagcaatgattattgcaacatatgctggacaggtacgtattgaacgtggcggaagtgagaaagaactttattcagaggacctttattaatgaatattaaacaactccagattgatgctattgaagctcacattaatcatatcaaacgcctgaatgctatgatggaagaaaactatggtatgtatgctaatcagcctggttgggatgctttagaccatccttatttggttaatttatgtaaaggtgataagttagcaattattcgtgacgggttaaaatctttcttgcgtgacatgtatattaaaatgaatgaagaaattattagctcgttgcaatatcaattaaggaaattagatgatgagaataattgattctaaagcagattattttaattctgttaatgataagaataaagctttaattcgccactttattactgagatgggttatactgactctaaagatttgaaagagcacattatcgaatgttctgtggctaaaaagttttcttttaccgataaatgcttaaatgaggttataaatcattatgaacaatcttgtagcaaaacacgatttcaataaggcttctgtccataaggacaagaagaaatcagaacttcaatctaaacgcaaacaaaaacataagggtaaagactatgcttactaaaatcaaagaaaatcctgccactgaacttgttattcgttgtgaagagcttgcagagctttatcaggttaaccgagaagtgtgtcgtagtgttatcgtagatatggcagacgaagtatgttcttgtattccttttagtgtcgatttcaatcacatgaatccaggtgaaatcactatcgtctttggttctgactatactgaagaacgggctcttaatgtcctagaatatgaaatgtcgtttttcgacatacaggactatattgatagttataaggaacgatatgagtcataatcttcagaacgtagtagaggccgaacgtgagcgtgaggctttagtctataatgaactattagctttgttcttagccttaaactcgtacgaacaggaagactacaccaattacgttaaaagcgtagaaaaagctgtttacaatcaacactgataatggtactatatccatatcaactaagtagaatgaataaaacgttatgaataaagatattgaaattgtacgtgaaattattactattgcttctattttgattaaattctctagggaagatattgttgaagaccgagcaagtttcatcggattcttgaatgagattggaattaaaaaagatggtcggcagctaaatcagaattcttttagaaaactaattacaaatttaactgccgaagaaaagaaaacactgattagtgaattcaatgaaggttttgaaaatatttatcgtcatttagcgatgtattctaacaactaattatttagcccttcctagtattcggatcgcttggttgcatatagccgctaagcgatcttcctcaagtatattattattccccttataccaatacatcgtcacagttccagcgtatatgttatccaaattaaagtatggacaactatacatataagaaagttcggcagtcttagattttgtaggcaaaaatgcaaattctgatttagatgagaaatgacggccacttaaatgaattatatattcattggccgttttatccaccgggaatccaccaagggacttttcagaaattgtgctaggtagtttgccttcataagctataaggtcgacaaaataatttaagtttttaggtctgaaagaatacacagcactaaaatctgcaccagatgagatatgaactatttgcagttgttctagagccgcagattcaaaacgtaaagctcgttctttttggattatttcagtataagtatcatacttagctcttacataataatccagcaaaatacttcctttgtaccatattagtgccattaggaacaaaagaataattaccgctactcgggacattaaaacctttccagtagcgttatctttgaaaatacgatctagcaacccaaatagaatatcactaagcgaaaatgatacttttggtgttgccataatacctccttttaaggatatttattcaaattatactcttgcgccatatattgtaccaactttagtccaagttggagcattaccagtaacagctttaccagcagcgccacccgagtgaatagttcctccagtaccgccttgaatatatgaagatttgccagcagctcccaaatctccaccatctcctccgtggtgaaccccagaaacagtgcctttaccaggagcagaaattgtaccagcagatgctgctgctgcgccgcctccagctgcaccagctgaaccaaatggacgacctccgccaccgccaaatatcatatccatttgagggaaaggattgtatctagcacctgcgccgccaccgccgccaccgccaataataccattattgtttattcttaaacgagttccaattccgttatttattgcagttcctcctgctccaccagcagagttacttccgccatttcctccccgacctaatacatgaaccccactattaatatttaaggtaacatacgcattagttaatgagctaggaaaatctaagcatggaacaccagtagattgagaaacaatatttcctgtaatagtaacaacaacaggagtactaccttgagatttgagataatttattagcgtgtctttattataagaattactagcaccaatgctgtaatatacttctttagattgtccagccattgagctcatccaaccgggaactgaaacacgaacagctttcattgcagcatccatccaacgttgtccagtttcattcacggcagattcgccaatccagccaggaacacctacaattgccattaaaaatccttagagggccgaagccctcttttacataagtttagattcaagttcttttacacgagcagaaagtgttttcacagcttcaaccagaagagcaatctgggattgagaagaaacagtgagtattttattacccttaatatcttcaacttcacgaactgcttcaggtaaaacgtcttgcaatgtttgagctataatacctgcttctgtttgaacaggttcaccgcctatatattcagctttatcataaatgacaccattaagtttttcaactttttcaagagcattttcaataggtctgaaattagatttcaaacgaatatcagaacgaatataaacgtttggagcgttaatattcatatcagaataagtgtcacccgtctggaatctcattcggcgtgcggcgttagtaatgatatcgagaattccgtcaccagattgtttaattccagtgtcattatcaccaaacgctatactatttccaccgagtgcgttattgatgttaataccaaatgaattcatttgattaacaccagccacagtagcattatttactacaaagcggttagctccaccaggagctttttcaaagtaagcaatatagttagtttcatcagcaatttcaatacggttaccgcgagaagcatcaccagcatgaaatattctcatatttctcgggttagcgccagacttatcaaagttaatagaaccattatctttgacatttatgctgttatagaataaagcagcgctgcgaacagctatgccattattcattagcacttcgccagttgttaaattaattgcgaaaggacgtttactattccaatcaccattaacagttgctgcgccatcagtagcatttttatctgtaaacagaatataaaaactaccgccatcatttcgtagcattgtagcaacagaaccagttttgtcgctgttgcttctaatacgaataccagtttggctattaatagctatttcagaatcggcttcataacgcttaactttgccgcgatcaaccaagttattaagaacattagcaacttgcccatcaactgctgtatctggaagagcatccacaggtgattgagtcgatgagttaataccaataacgctaacagtagcattttcggtacatgaccattcacaagttaattgattgcaatatgttccggcataaacataaatgtcatatgtatctccagagacgttattaactgcaatatttttaaatgcagctgcaattgttcttgtgtataatacagcatttaagtcagcaggtctttcattactagtacgtaaaacaatttcagcaatattgcattgtgtgaataatccactattaaatccagaaccaccggctattttaaagaagaccgtcgaagtggattgtggcattgttactgttgcaaacttataccatccagcagttgctccataagtaataaatccagaattaactttacgatttagcgtggtgtttaagttagcaaagtttcctgaaccgctagtaatattaccatcagttcctagttgggcatttccaactttaagaggtttagtaatatcgacagaatcagagtttagtgcaataccatgggaataggtgtaactatgcatacgaacgacgtttccgccatcgccaatacctaaataccattttgtaacatctgctttacgtccttgaataaagttagaagactcttgcgttggggcatttattctaatagcatctgacgccgcattaactgtaatacgtttccctgctgttgttccactagtttctactttaaatattccaccaccgatatctacatcatggtccatagaaactttaccagtacttaatgtaatatagaacggacgtaaattagaaataccacctgattcaccagcattctgcggagttggaataatataaagcttatcttcagaacgacggaaaatagccccgtattcagcattccaaattcttaatgcatctgctgttccaccaatttttacttggcctgtaatagaagaaccaccttgaacaaacaaaccattagacatggtaacattaccgactaaagtgcttaatccattaactctaaaacttccgtcagtaataatactgcctctagcattgacagctcccgcaaactgagttacaacaggaccagtagtttctgagccgcttggggctacacgctgggaataaaaataatagccttgcccatcagctacttcgaaaacggtttcacgattacgatcaccagatgcgttaaatgaattaccccatgctttaacggtaacgtagcttttattttgtccagcacgagtaccaccttcccacacgatttgcttagttccatcaacacctgaagctgctttaaaaactagagaagcgttagttccatcaccattaaaatataatccattattaagctttaatgtttgaacagaagcgatggtaccatcagcgcgcaaacttaatgtatttgaaccagttttaatatctaaaattccaggttcaacaataagtccttcagccattccaattgccattcttcctctgcctctaaaataatgataaaatttaccattactattataagcaatatgtgtctgaccatctccgttattattttggtcaacatcggtgcgagctgaaagaagagctgcgttttgaccaggaagaagccatgtaccaccttggtcttctgagcgtccaaatattgctttgcgagtactacggaaactatcaggtgtaatagaagcaacagaatatccgccaccaactaaatcataaacaccttgcttgatgtattttaaaccagttacagtatcaccgagaacaagatacttatctcccattacgccggtattgccataatcgctagacgggaaacctgtagtgaatgtacctaatgcaaggctattacggccagccattctaccatcgttacgaataccatactgttttgactgtggagtattaccggtccaccaagacatttcatcagcttgcccagtctgagcagtacaaagctcatgccacatagttccacctgatttagctctaactttacgaagatagtttactccgttagtttcaccagttccagggtaaacatattgaactaatgattgcgaatcatattgtccaaatgcttttgtgtccaaaacaatggttttcgtattaacttgtggagcagaaactataccattagcggagttaatattgccggacgcagaaatattacctgtgcggacctcaatactaccagaatctacaataaaattaccattacggttaaagacccagtgtttagaattgtctggagctgtagaatcaatataatgaactctaaatgagccttcgcttactaatgtacctactgaaaaagtaccatctttataacgttgcttaatcaaagggtggtattctgaggtagcagtagtagagctcaaatccgtaaagataggggctttattcagatgttggttagcccaagcgccatttccagcagtttttggcaagaattcaatgtattttcctgcataaacaaactggtttccattaagattatacgtaccgttttgtaaataatcaccagtttgagtgatatttccactgatattaccaccagcagaaatgcttaagtcaatgatatttcctgaatcatctttagtaaaaattgttctatcttttaagtttatagccaattcaccttcggctaatactgaagcagcaggacgtgcacctgcgattttgcttcttttaaattgtatttgttttaaagtagccataagtcctcttaataatagccgaaatcttgaacagaatccttaattacgatttggtcaaatcgtggaacatgtgaaggttgagatgccggattctgtgagaaaaagtttggtgctgttaaagtaccggtcatggtatcgcctttacgcaatacacgggaatttgcgttatccgtaacaatatttattcgtccatcaacatagtcctttctagtaaggtcatttgctgctataggagcagccgcatcacttcttacttgacctgatgctgatacaacaccttttgtgctaatatcaccattacgggtattaattacaatagttctacctgctgttccttgtgatgatttaaaaccgataccgtaccatgaaacaatatcgatatttgctgtggcaaaagtagcggcatcaccattacccggataaatgccagattgatttgtattgtttatagcatatggtacttgcacaccattattaaatgttactcgagcggcatacgtaccaccatttgctttagaaacgaaatcgttatcagcagcttgtggtttattatattctgaatagagtttaaacgttttatacaggacgtcatcacctgctggcattaaagggaaattaccttgatgccatataacagcaccgccagttgtactaccagcttttaaatcggccatagttgtctccttatatgtataccatatttatacaaaaatgggagaccgaagtctccctaaatttattctgatgcttctttaaattcttgtccaaataccttaccagtatcagttgaagatcgagtaggtaatgtcattatgtctggggcacttaaagattctgaaacataatttacacgaataccatttacaccaaactcagcaggttttgaaacacttccattacatgatacttcagtgaatataacgtttcttaatccaccttgcccgactggagctgtacgataacaataaatcgtgtacccatcagctccagcaggaatttctatatagtcttcatatatcttccattcacctgcagccccatcaaagtttgtatccttaaatgaaataggtgaagtagaaggagatttaaagaaacgaatagaaagtcgtgtcgtcccttgtgctaacaaatcggcatcagccattagttggaatttcatataaaggaaatctccaggcttcaatttatacccagcgagaggtgtaataagggatgttgtaggcatccttttaatttcattattagtacctccaacggcagataaaaatgtgtctgtcgattcatacgtacgactagggaagccggtagcaccaatatcgtcgatcgtgtcatacacaacatcaagtggtgtactatagtcggttgaagttttcttattactatacttaatatgttctagtgctatagcattcttaccagaaatataaaatgccgaataagaaatgtccactgtatttaaaacttgttgagctaatggaatagcagaacttccggctttattaaaccatgtaagaacttcaggcggaaagtttgttttagcgttagtaacaagagcaaatataaaatttgaagcatatgtgtccatgaaagtaacaaatgcacttgacgttgtgtcgttttcagtagagaaattatatgacttagattcaactactgcacctgttgtaggatttattacacgaacgtttaatccaacagaaaaaacctgggacccaagtggattatcctggaacttaatataagcaggagatgttgatagcggacaagagcccgctatgcttaatttaaatcgtactgaattgctttccgataaaaatggcgtttggacgtatccttgtccaaacttagccataaatttttccataatacctcttattcaatccactcgaatttaacagatttattcacagggtctggaataatgcggacgttaccaatccttaagaaatcccttatcgtcaagtttccgattgttgcattatcagaaggtaaagcaccaatatcagaaggttgaggagggtttccgccatcaaatacctgaacaaaacttgaccaagaatttttagttttctgccatgtacgagtccagcgagtggtacgcgcttccggtgtcgttggataagtaatccaatcttggtaaagagaatcaagtgtattaccaaactgagtcaaagtaccaggggatttaacttcttcaccacgttctaagtacggaagtccagacacttcattagttttttcaaccattttaaaataacccgggaattggttataagtggctgaatcgttaatatcgattgaccagaatccgactgtatcagcagtaggagcacgagtgtataaatcagcagttttagaaccctgagaacgaattctcgagttaacagtcaaaccgccagaatttatagtagcacctttggcaatgattaagccttcaccaatcgttacttggccagatgcattattaatagccaaaggacgtaatccattaaatccgccagtctgatcaccagctgcagtgagcataaaataggtattagcagcatcattacgaataaagaatccgtaatcaccactaattgctctgaaagcatttgcagacttgctaatgaattcaccattggctgtaactgaacgtccgaatgttgcaacgccattcacattcatcaaaccggaagcattaacgtttattggcattacagtaccattaatgctaaacgctatattcccatctttattacgttgagaataaaagtgattagatgtttcatcaccaacttcaaatacagtagaacgcgttgtatctgatccaccaccaaactgatttccccaaactctgatagacatcgtctgcgctgggttagttccagtctgaggtcctttttcaaaaatcagacgagttgccgttccagagttagaaatagtcagtgtactattagcagataccgaaccaccaaacgtagcagtactagatgatacaagaggggcactcagattcgtttgttgggttaaggttagtgaaccattaaccgtctgtgcaatatccctacgaatgaactgagatgaatctagaccatccaataaattactatctacagcttttgcttttaacggtaaataatttgctaatacacggtttaattcatatggtgatactgcatagctatttttctcatatgattctaatggctgtgttgaacctaccgtatcattaccaacaaacgttaatgaaccagaagaagttttaacaaaacctcttatcgcagtagtagcagcccatgttggttcgttctggacaatccattttaaattcttaggagatacagcagtattagcagaagttcctgttacagtttcagcctgagtagcaaccttaattacgccttcagacgtttcagtggacttagtccctaaaagctttttaggagtaataagaacatcatctaaagttcctgcattagattctgcctgggtcgctacgcgaagtgtaccacgttgtgtttcatttgctttagaaatatcaagagtataatggttccacaaggttccttcttcaataagtccggaatcagaattaacactggtacggtcagaagaatcaaaatgagttttaattttcagtggagtcgagatacgagtatcatcagttccagtatcaaattcaacttgcgtagcaatttcggctatgccggataatccttccgtagctttcctatcatttaacgtcttaggcgttactgcacgtgtataatcagtcccagtattagtttctgcttgcgtagcaatttcaattaaaccaatacgtccatcagtagaagttttcttatgtagtgtttcaggagttactacagcgtgagaataacctgcttgagattgtccagcaattacttcactatcaacagctaaaattactgcaccttgttgagcataagttgctttatattggtcaagggctttaggagaaatagttaaattatttacggttttattataaacgttagtgcctgcggccccacgagtttcagcaggagtagcagaagtagttgatacatatttaactataccagatagtgtttcagaaccctgacgggcctgcaatttcttaggtgtaataatcgttgtgtcatcaagaccggcatcggtttcggtctgagtagcaatttcagcaaggccgcgtcgagtttcagttgctgtacgctcatttagttttttaggcgtaacaatagtatcgtcaacaaatgatgctgtggaattctggttaacttgcgctgttgtagcaattttagcgataccacgtcgagcttcagttgctgtacgatttgccaacgtttcaggagtaatagccacttctttagctggagtattctctaaatcaacatttgcttgcgcttgagtagcaagagcaataacacctacacgagctctagttgtatcggatccagcatcaacacgttctaccgtagggacattctgttgcacaacccaataacgtgtaccagcaacggtgtcttcgatatacgctaattctaatacaggaacatatgaagtagtgccattgaattctagttcagtaacagagacccattgagcatcaggtggatattcagaacgtttagggaactgaagcaatgcaacagaagaagcaattgtatcaccttcggcagctttaatttttactgtttggcctttacgcatgtagttcattgaaattttaacagtgtcaccactcaaaattccggaaggcagcgtaagattaatagttccggctgtagcgttatttgtgccaaaaataagaacttcttcatttggacgaatatttgaatccgcacggataatacgaagacgcgatttctggtcgccttcccatatacgccataaactacttgcagcatcaaaaacaaaaaacgcgtcagagtcatttctgccttcggcaatatgagtcccgacttcaccaatagacgttgtatcatcaaatgttttaacaattgtatgatacagtgggtttaatccatctaaatcgactaggctgattatatcaccattgttagcattacgtggaagtgtaatgttgattggtgctgcactagtaaaacgacgaacgataaaatcatttgcttgtgcttgatatggtgtcgcaggtgtaacagtgattgattctttaccataatcggtaatatacatctgccacaaacgattactaaacacaaacaatagttgtgaacgtggacgcgtcattaaaactgtacgaacttgttcacctctaaagtttaaaatactctgcacagacgcgttaatctgtactttaactgtcccggttcttccaccaatatcagccaaaacaacagtatcaccatcaaccggcgtatttggcaatgtgaaaaccatatcattgccggcaccagtgttaaccgaaatcgattcacctgaagaaagttgataagtcccagaagcgacagttatccattgtgcatcggtacgaactgcacgccattgtaaaaggttaaatgccccggaaggagacacgatatcatttattgcttgatataaacggttgtcataaagaacaacaaatcctttgttatatccacgcgtagaatcatatacttgaacggtgttttcttgtaccaggaagtcaacgtttacgccatcagtacctactgtacggtcggctaatgctacgttaacaatcttgtcgccaccggcgtccagaccgtcttcggctctgaacttacgtttgatgtcggccattcgtttttcctttattgtttcaataatacttatttataccagtttacgctttcaaatgagtatgttactatagacaagttgactaactgaacaagaggttcatatggatttagaaatgatgttggatgaagattacaaagaaggtattgcacttgccgactttagtaacattgcattggcagccgcattaaacaacttcgaagacggcgataaaattactgttccgatggttcgccatgtaatcttgaattcaattcgtaaaaacgtagtgatgttccgtaagcaaggctacacaaaatttgtattgtgtatggataatgctacttcaggttattggcgacgtgactttgcttactattacaagaaaaatcgcaaaaccgatcgtgaagcttcaaagtgggattgggaaggatattttactgcactccatcaagttgttgatgagattaagaaatacatgccatacgttgtaatggatattgacaagtatgaagcggatgatcatattggtgtattaactaaatatttgtcattagctggtcataaggtatgtattgttgcatcagatggtgactttacacaattacacaaatatcctaacgttaaacagtggtcgccaccacagaaaaaatgggttaaaattaagaacggttctgctgaaattgattgcatgactaaaattcttaaaggcgaccgtaaagatggtgttgcatctgttcgagttcgtggtgacttctggtttactcgagttgaaggtgaacgaactccaagcatgaaaacatcaattattgaagcaattgctaacgaccgttctcaagctgaagtattattaagtgcagaagaatataaacggtatcaagaaaatttggttctcattgactttgattatatccctgataatattgcttcaaccattatagagtattataactcgtataaacaacaacctaaaggcaagatttattcatactttgtaaaatctggtctttctaaattaacaagtgtaattaatgaattctgaggtaaacatggctaagaaagaagcagttgaatttaatcaagatgtgcatggtgaagaactggctaaactagtcaaggaagcttccgataacaaacttaaaatttctggttataatgaactgattaaagacattcgtactcgtgctaaagaagagcttggcgtcgatggaaaaatgtttaatcgtttgttggctctttatcataaagacgctcgtgaccaatttgaagctgaaaatgaagaggtagtcgagctttatgacacagttttcactaagtgatattaaaccggttgatgaggccggtttatctgaacaagaattagcagtaaaacacgataaagatgatatcgctaaattgcttgaccgacaagaaaatggattcattatcgaatccatggttgaacaatttggtatgtcttatttagaagcaacaactgctttcttggaagaaaattctattccagaaacacaatttgctaaatttattcctacaggaattgttgaaaaaattacaagcgaagcaattgacgaaaacatgcttcgcccatcagttgctcgtggtgaaaaaactaatacgttagatttcttattatgattaaaatacgcatgcctcctgacggagaacgttatattaacggaaaatcggtatacaaactatacttgatgtgcaaaaaccactttggcggtcggtatgatgtaatcaaatataactggtgcatgcgtgtttcggataatgcgtatcaaaaacgccgagataaatatttctttgaaaaactagcagagaaatataaattgaaggaactcaccttgatattcataagtaacttagttgctaaccaagacgcatggattggtgagatatcggacgctgatgcattagttttctatagggaatatattggacgtctcaaacaagctaaagagtcgtttgctgaagacgtacgtaacatctactatttcagtaagaaagttgaagttagtgcgcttcaagaaatatttgattataataacaacgttcagtcaagctacatattcaaattgctacaaagcaatataatctcatttgagactttcttattgttggactcatttttgaatattatagataagcacgacgaactcactgataacttagtctggcaaaattattctaccaaattaaaggcatatcgaaaaatacttcaaatcgatggaaatgctgctaagaaattgttcatagaaacaatcaaatcatgtaagtattaagctttatttcttgtgtgttaaaattactttataaataaatcataccagctacgaggtataagtgtcgtagcaaccaactgtaaataaattaaataatctaaataaaaggtaataatccatgtttaaacgtaaatctactgctgacctcgctgctcaaatggctaaactgaatggtaacaaaggtttctcttcagaagataaaggcgaatggaagctgaagctagatgcgtccggtaatggtcaagcggtaattcgtttcttgccagcaaaaactgatgatgcactaccatttgcaattcttgttaaccacggtttcaagaaaaatggtaaatggtatattgaaaattgctcttccacacatggtgattacgactcttgtcctgtatgtcagtacattagtaaaaatgacctgtacaataccaacaaagctgaatattctcaactgaaacgtaaaacttcttattgggctaatattctggttgttaaagaccctcaagctccagataacgaaggtaaagtatttaaatatcgtttcggtaaaaagatttgggacaaaatcaatgcaatgattgcagttgataccgaaatgggtgaaactccagttgatgttacttgtccgtttgaaggtgctaacttcgttctgaaagctaagcaggtttctggttttagcaactatgacgaatctaaattcttgggtcaatctgaaattcctcgtattaatgacgaagcattccagaaagaactatatgaccagatggtagaccttactactttgacggctaaagaccagttcaaatcctttgaaaaattaaatgaatctttcgctaaggttcttggtactgccgctcttggtggtgcagcagccgcagcagcttctgttgcagataaagttgcttctgaccttgacgattttgataaagacatggaagcctttagttctgcaaaaactgaagatgacttcatgagctctacctcatcctctgatgatggtgacctcgatgacctgttagctggtctataataaatcgggagacttcggtctcccttttgagtatctgtaaattgccgaaaaagttgtttacttcttccctggatgtattagtatagacatatcaacaacatgaggaaatcaaaatggaaatcggaaaatcttatatcattaaccctttatttaaagacgactttgttcaagaagcaccacataataacgctaagatgttaaaactgattgaactccatgggcctagttttgttgtaaacggaatggaacctgattacgatagcgatacgccaaacgtagtaagtgtaactatggaagatggtactgtatgttctgccggtggtgaaattgaaacttattttgagatttatcctgacgagttcaaatactttattgagtactttactgaggtagatttagtaaagcctcaacctactaacgaaggtataactttaggtgtaacaaaaatccattgtatcgtagatgaaaccaacgtcgacgaaatcatcgaacttttgcaaaaaacttttaaaaagtagtttacaatcagatagggttatgttatagtagccctatcaaataaaagtgaagaggagaataaaatgagattgcaacgccagagcatcaaagattctgaagttagaggtaaatggtacttcaacatcgttggtaaagacgctgaactccttgaacaagctgaagaagctttacgtgaaatgggttggaacgaagaatgtgacagatgtccactctacgaagatggtgaaagtgcaggattctggatttatcattctgacgtcgatcagtttaaagctgattggaaagttgttaagaaaaatctgaggaaataattatgaatgttgttgttgaatactctcaaggcgctgatgttggatatgaagtttatacttcagttaatttagaccacccagatttggccgaattcattggtgacgcatttgatttgtctgggcgatacacaacaaaacctcgtgtttgtgttacaacatttgaccaaaccgatggtttggaaattcagacagaactagtttcatctaaatcacaaatccaaaaagttattaaaggacttaaaaatgcttaaattagtattcgcatgcgcgccgtctaaaacagttgatgataaactggaatatgcttttggattaggtgatggacttccatggaagcatatcaaacaagatatgagtaactttgttgctcgcactaaaaacactgtaatggttatgggtgctaagacttttgcatcattacctcgtctactcccggatcgtactcatgtggttgtcactgatatggccagaaaactgcctaggactaaaaccgacgaacttgcacatttctatatcacccaagcagaatttattaccttggtaatgggtagtgaaattaacttgttcagcccttcaaccgacgtaccgtttaaactttctactgaacatgttgatgtatctgttatcggcggccctgctctacttaaacaagcattgccttatgctgatgaaattgtgatgactaaaatcattaagaaatgtcgtgttaattccgatgttcaacttgataaagatttcgtccaagatattatgcttcaacgttctatggtagaatctcattactacagaatcgatgaactcaccgaaattactgagagcgtatataaatgaaacaataccaatacctgattaatgatatcctagaaaatggttatgaaactgacgaccgtacaggcacaggaacaatcgccctgttcggaactaaattacgttgggacctgactaaaggattccctgcagtaacaactaagaaattagcatggaaagcttgtattgccgaactactgtggttcatgtctggttctaccaatgttaatgatttgcgtattcgtactcatggtagtctaattgaaggtaaaactatttgggacgataattacgaaaatcaggcaaaagaccttggatatcatagtggcgaacttggtcctatttatggtaagcaatggcgtgattttggtggtgtagaccaattagttgaaacaatcaaccgtattaaaaaattaccaactgaccgtcgtcaaatagtttctgcatggaaccctgccgaaattgaccaaatggctcttcctccttgtcatatgttctatcaatttaatgtgcgtaatgggcatcttgatttacaatggtatcaacgcagtgtagatgttttcttgggcttgccattcaacattgcctcgtacgctgccttgactcatattgtagctaagatgtgtaatcttatcccgggtgatttggtgttctcaggcggcaacacgcatatctacagcaaccacgtagagcaatgcaaagaagttttacgtcgtgagcctaaagaactgtgtgaattagttattaacggattaccatacaaatttaggcatctatcaaccgaagaacaaatcgaatatgtattaaaacttcgtcctaaagactttattcttaaaaattacgaatcacatccggctatcaaagctaaaatggcggtataaaatgattttacgttttattaattcatatggcaccacaatttttgaaatgaaaaatcctaccgaactggatatcccttcgccgaatagtgaaatcacagttaaaggtgaacgattcatttgctattcacacgaacgaatttatgaatatcgtgaattttgtggtggttacggtatggaaaaagaaccattggtttatttcgatatcacagtcttgactcctaaagaatacaaagaaattattgctaagaataattaacgcttcagtttaaaagtgtataataaattaacgggataaatactatcccgtttggagtaatgtctatcaacctatactgaggaatatatgcaagtaactaagagcagtggtgtatcccaaaattttgatgcacagaaaattattcaagtcttaacttggcaatgtgaaggaacacaaattgacccatatgaattgtacgaagaaattaagacccatcttgtcgatgggatgagcaccaaagatatccaaaagatttgtattaaagttgcagctaactcgatttctgtcgaagaacctgattatcagtatgttgccgccaaagggctaatgtttgcacttcgtaaagatgtgtatggacagtttgaaccgcctgcttttatcgaccatatttcttactgtgttaatgaaggcaaatacgaccccgagttgttgtctagatattctgcagaagaaatcatttatctcgattcacagattaaacatgagcgagattttgacctgacttatgctggtgctatgcagcttaaagaaaaatatctagttaaagataaaacaaccaggaagatttatgaaactccccagtttgctatcatggctattggtatggccttacatcaagacgaaactcatgaccgtttgaaacatattattcgtttttatgatgccgtttctactcatcaagtttcattgcctactccaattatggcaggtgctcgtactccaactcgccagttctctagttgtgtagttattgaagccggtgattcgttaaaatctattaacaaaacttcagcatcaattattgaatatatttctaaacgagctggtataggtatcaacgttggtatgcttcgtgcagaaggttctaagatcggtatgggtgaagttcgacatacgggtgttattccattctggaaacatttccaaactgcagtaaaatcttgttcccaaggtggtattcgtggtggtgctgctacagcgtattatccgatgtggcacttagaagtagagaacctattagttctaaaaaataacaaaggcgtagatgaaaaccgtattcgacatatggactacggaattcagattaatgaccttatgatggaacgccttggtaaaaatgattatattactttatttagccctcacgaaatgtcaggcgaactatactactcgttctttgaagatcaagataaattccgtgagctttatgagaaagctgaaaaagacccaacaatcagaaagaaaagaatcaaagcactagaactctttgaattgttcatgactgaacgttctggtactgctcgaatttatccacagtttgttgataacacgaataactacactccgtttattcgtgaaaaagctccaattcgtcagagtaacttatgttgtgaaatcgctattccaactaatgatgtgaatggtcctgatgctgaaattggtttatgcacgttatctgcttttgtattagataaatttgattggcaagaccaagataaaattaatgaacttgctgaagtacaagtacgtgcacttgataacctgttagactatcaagattatccggttccagaagctttaaaagctaaaaagcgtcgaaacctcggcgtcggtgtgacgaactatgctgcatggttagcttctaactttgcttcatatgaagacgctaacgatttgactcatgaattgtttgagagattgcaatatggccttatcaaagcttcaatcaaactcgccaaagaaaaaggaccttgcgagtattattcagacactaaatggtctagaggcgaattacctatcgactggtacaataaaaagattgaccaaatcgcagccccgaactacgtctgtgactgggaagaacttcgagctgaactcaaagaacatggaattcgtaactcaacgttgtctgcactcatgccttgtgagtcaagcagtcaagtatcgaactctacaaacgggattgagccaccacgtggtccagtaagtattaaagaatctaaagaaggcaacttccgacaggttgttcctaatatcgaacataacatgagtctttacgactatgcgtggaaacttgctaagaaaggtaataaaccttatttgacccaagttgctatcatgttgaaatgggtgtgtcaatctgcttctgctaatacttactatgaccctgcagtatttgagaaaggtaaagtgccaatgtcagtaatgcttgacgatctgctttacttctggtactttggcggaaaaaacctctactatcataacacccgtgatgggtcaggtacagatgactatgaattagaaacacctaaagctgaagattgttctgcttgtaagctttaagacttttgattataatttactcatggatgagttaaaactaagtgagaaatataatgagtacagtttttaacacacaacaagtcgatgttttgaatgaaccgatgttctttggttctggtcttggtattgcgcgttatgatattcaacgccataaagtttttgaagatttgaccgaaaagcaattgtcatttttctggcgccccgaagaggtaaacttgatgttggactctgcgcagttcaataagcttcctcagttccaacaggacatctttacaaacaatcttaagtatcaatcattattagattctatccaaggcagagccccatctgcggtacttatggcactgatttctgacccttcattagatacatgggttgcaacatggacattcagtgaaactattcactctcgttcgtatactcatattatgcgaaatctttatacagacccatctaaggtatttgatgaaattgtattagacgaagcaatcatgaaacgagctgaatcaataggtaaatattacgatgatgttctgattaaaacccgcgaatgggaaaatgctaaagaaatttttaaatgtttttccgaaaatgaatatgatttagatgcatattcaaatagtcttatgcacatggaagaatgtaaacatgacctaatgaagtctctttatctctgtttgcatgttatcaacgccttagaagctattcgtttttatgtatcatttgcatgtactttcaacttccataaaaatatggaaattatggaaggtaatgcaaagattatgaagttcattgctcgtgacgaacaactccacctcaagggtactcagtacattatccgtcaacttcaatctggtactgatggtgatgagtgggttcaaattgctaaagaatgtgaacaagaagcagttgatatttttatggaagtaaatagacaagagaaggaatgggctgcacacctctttaaagacggtacatgtccaggtatcaatacacagagtatgtgtgcttttgttgattacttgactgtgtctcgtatgaaacagtgtggtttgccatgcccaatcactgatgctccgaccaagcatccgtatccttggattcgtgaatatctgaactctgatttagttcaagcagctcctcaggaagttgaaatcagttcttatcttgtcgcacaaattgataatgatgtagaccaaaatgtaatcaattcatacaaaaaatatttctaaggacgggacttcggtcccactttattatgaaagatattgccgccgaatattcctttattaaatatacagaattggagctattagaagatgcaacaattaaaacagttgatgtccctaataagaaaaatgtcatatacgctattgctatagatgacgaacttgtgtatattggtaaaaccaagaatttaaagaaacgcattaactattatcgaacagccataaatcgaaaagaccagacttcagattcaagaaaatcacttatgattttggatgccttaatgcaaggcaaaaaggttgaattctgggcccgccaatgttttgacctttcagtcaccaacgaacttggttcaatgaccatcgcaacaatggaccttgaagaaccgctttttatcaaaaagttcaacccgccttggaatatccaacataagaaaaagtagtttacacaccacaaggattgtggtacaatttaaaaaaaactaactgaggatacaaaatggaaaagctttattataatctgttatctctgtgtaaatcgtcatctgatcgtaaatttttctactcggatgatgtaagtccaatcggtaaaaagtatcgaattttctcatataactttgcttcatattcagattggttattgcctgacgcgctagagtgtcgtggtattatgttcgaaatggatggtgaaactcctgtacgtattgcttctcgtccaatggaaaaattctttaatctaaatgagaacccgtttacattgtcaattgaccttgatgatgtaaaatatctgatgactaaagaagacggttcgttagtctcgacatatcttgatggtgggactgttcgtttcaaatctaaagggtcaatcaaatccgaccaggctgtatcggctacgagtattttgttagacatcgaccataaaaacttggctgatcgtttgttagaactttgtaatgacgggttcactgctaactttgaatacgttgctccaacaaataaaattgttttaacataccctgaaaaacgattgattcttttgaatattcgtgataacaacacaggcgaatacattgagtatgatgacatttatctagaccctgtttttcgtaaatatcttgtggatcgatttgaagtaccagaaggcgactgggcctcagatgttaagtcttctacaaatattgaagggtatgtagccgtaatgaaagacgggtctcatttcaaattgaagactgattggtatgttgctcttcatacgactcgagactcaatctctagcccagaaaagttgtttcttgctatagtgaacggtgcttcagatgaccttaaagcgatgtacgcagatgacgagttttcatttaaaaaggtcgagctcttcgaaaaagcatatcttgatttcttagaccgctcattttatatctgtctagatacatatgacaagcacaaaggaaaagatcgtaaaacgtatgctatagaagctcaggccgtttgtaagggtgcacagacgccttggttatttggcatcattatgaatctttaccaaggtggttcaaaagagcaaattatgactgctctagaatcagtctttattaaaaatcataaaaatttcatccctgaaggatattaatggtttacaaacaccaaggaaggtgttactatggcttttatcaacaacacgaggagaaaattatgaatatgcaattgattactaatgatatggtcgtaaccgcttttggagacacaactgacggaatccgagtctttaagaaaggacgtccagttggttatcttactgacctacgtgttacactggccaaaaatcttaaaaagaaagtaaaacaaaaagagtattccacccgatacgctgaagagaaacgcgaagcgatgccggaagcagttaatgccatggtagaatttcttcaaaacaatttgactaaatatgacgctaatgttttcgttaatattagtcaaccaaacgtacatatcgcaggtataaaattctacattatttgcgaccctcttaccgacaaattcaaccgcctcggaatttcaagtccatatcatacagcagaagagttgtgtgtattgtttgaatcgtacaaaatccagtgtgatggtttgaaaaccgttcttatcaatggactgtcccgagatgaaatcattgagattattaaaacatgcttaaagtaaatccgatttatgctatagtaacagcttttgctctagtttctacggtaacaatagttgtcttaaacaacaaagttgattcgttgaatactgaattagcttctgttaaaaagaccgctaaaaacaatgctaaagtattagacgacttcaaagctcaatatcagtcaatcgaagaaatgacttacaagaatcgtgttttagttgaccaacttaaggccgaaaatgaaaagctccgtaaggattcgaagaagaagaacgtggtggcaagtaaaccaggattggtcgaaaaacaaatcaacaagtccttcgattcctttgcagaagacctcaggaagctctcagaatgattaaattaaccgcagttgtattatctattggtattttggctggatgtgcccaggatgtgcccttaagccctaaagaaactttacatccgccatggcctgaatctattgttgaatataaccagaaatggcaagtaaaggttattgatggtaatccgtgggttggaatgtcatttgaagactctcaagaatttcgtatctggttaaacgacgtaaaaagatatgtacatgaccagaagactatgatatgttattatcgtagtggtttaaaagaggaaaaatgccaatgactaaagaacagcatgaatacattaaagggcttatctatgaatctgaaatggcggctatgatttatgggcgccagattcaacgattagaatctttgcctccgactaatgaccgattgttagttcagtctcgtgctaatctgaaaaatgaatatcagaataagtgggcagtagcgactaaagctcttcatgagtatattgaatctttagtaaaatagtttacaaactctcgggagcagagtataatgctcctatggataattgaggaaatctaaatgaaaacattactagagaattacatcaaacggtctgatgagtatattgatatctgtcgtggaatgtcacttggcaattatgacaaagatgcagcaaaggcactagatgaagcaggtaaagctcttcgtaaagctgctaaagaaaaagggttggatttgcaacaactcaaaagtcatatgattaaatttatttcttcaaacgttagaagtacgtcaattaataaaaacgttgctgaaattaataaagaccggcgcgagcataacattcgtattcttgaaattttcttaggaataaaataatggaccaagccaaaattgataagttaatccatacgcttgtagcagatatcaatacacgggctcttcgtaaatcacagaatggcgattcctggactatgcaagattgcaagaaaggtgctgaactaggacgtgaaattgctaaaattcttggtggacaatttgaatttgctgaagaggtagtaaaactgtgaaaaagattattttgactgtaggttgtcctgggtctggtaaaagcacttgggctcgtgaatttattgctaagaatcctgggttctttaatatcaaccgcgatgattatcgtcaatccatcatgggccacgaagaacgcgacgagtacaaatacacaaagaagaaagaaagtatcgtaacttatatgcaacacgacgcggcacatatgattctctgtcaagacggaactaagggtgttattatttctgacaccaacttaaatcctgaacgtcgtcttgtctgggaagaatacgctaaggagtggggtcatgaagttgtatatcaagtgttcgatgttccatggactgaattggttaaacgtaatgccaaacgtggcacaaaggccgttcctattgatgttctacgttcgatgtattctcgtatgcgtgaatacaaaggacttccggtttataaaggaactccgggtaaacctaaagcggttatcttcgaccttgacgggactttagctctacatgtagctcgtggaccttatgagttggataaactatccacagatgccccgaaccctatggttgtcgaatatgttaagatgcttcatcaggccgggtatacaattattactgtaagtggtcgtgaatctggaactaaagaagattcaatgtgttattacgaagcaactaaaaaatggatggacacggtttctattccatgggaaatgcacattcaacgtaatcaaggtgacactcgtaaggacgatgttgttaaggaagaactcttttggaattgtattgctccttattacgatgtgaaattggccgttgatgaccgtaaccaggttgtggaaatgtggcgtcgtattggtttagagtgttggcaagttaaccatggtgatttttaatgaaacgattatatgaagtgattgaggccgtcgaacatcataaagaatatttgtttgtagcctggcctttagtaaatggacagttcggtattgatgtgctggactatgagcatgaagaacgtttggacggtggtatatttgataacgtcgaccaggcaattgaatggttaaatgaaaaatatgtacgataaacatcatgaaatcgaagatgaagcatacaaaatgcttcgtaaactagttggacttaatatgagtcctacattaataaacaaactcgcaggaattcgtaatgatctgaatactcgttacaaaggcgaatatcatgtagagtttgttcctgtaggtgaaccgaccgagcgatttgttgttcgagttaaagtaaatactgtacactgaggtaattatgttcccaacttattctgaaattgtaaaggtagtcttcagtcagattattgctaataatatgtttgaagtgcttgataatgcagccgaactcagagttcatgctcaactaactcatgtactcaatgctttgctcccagaccaagtagattctattgctattactcttctccctgggtctgcacacgtcatagtggtatttgatcttgacggcgatttagttatccaatgtgatatcaatttcggtacacaaaaaattgaatgcaaagcaatttaatggtttacaacatggtggagttgtgatactataactctaccaacaaatgaggaaatagaaatgctaagtgaaaacccaattacagtacacgaatttcagattaaagtaaaagaatttgctcaagcactcatcaataaagtgtctgaacgtttccaagatgcaacattacgagttattcaagaatctccacgttcttttctcataatcgttaatcctaaagatggtgaccaaattactaatcttaaattaggcagtgatggtcttgttgaagcaactcgagtatatggaacactataatgagagctatctcattactatcgagaatggtcataaatctgagcactaccaacttagcctatctaatccggttaaaggtattgttgaatcagaatctgtttatatctcctaaggattgttatgttacctgtcatcagaaaacttatttctccaaaagaactggctgagattattcctttgtcggaagcttacgcatcacaagtggcttctcatcgcgaacaagttaattcgattatgaacggtgaagacccacgcaaacttattgttgtaggtccttgttcaattcatgaccctattgctgctgttgaatacggcaaacgtctggctgaacttcaaactcgtcttcctaatgttctgttagtgatgcgcgtttattttgaaaagcctcgaactaccgtaggttggaaaggtcttgtaaatgatccatatcttgacggaagttttgatatgaaccacggtcttatagttgcacgaacattgtgtcgtaaacttctacgtatgggacttccattagcaactgaagtattagacccattcacgattaagtatctttctggtattttctcatgggttgctattggcgcccgtacgactgaaagtcagacacatcgtgaaattgcttcaggtctaccgatgtgcgtaggcttcaagaacgcaaccaatggttctattaaagtagctacagacgcgatgtatagtgccgcctggcctcatcggtatatgggtatggacgtcgatggtactgtaggcattgttgaagctgaaggtaatcagaatacgcatatcgtattgcgtggcgggaccaacggcccgaactatcattcttctgatattcaagaagcttctaacaaagcaagggcagtaggtctgaatcattatgtaatggttgactgtagccatgcaaacgctgatgggcattatagcaatcaaattggtattggtaaaaatttagcagctaatgatttggtcaaaggaattatgatagaatcgttcctacatgaaggaaatcaaaaaatttctgataatatgtcctatggcgtttccgttaccgatgcgtgcatcagttgggaacaaactaaagagctgttaacttatattaataaggttcaataatgaaagctagcacataccttcagattgcatatctgatttctcaagaatcaaaatgttgttcatggaaagttggtgccgtcattgaaaaagatggacgtatcatttctactgggtataacggtagcccggctggtggtataaactgttgtgaccatgctactgaacaaggttggttgaagaacaagccgagtcctgtcatcattgccggtcataaagaaggcactacagcatttggacgggtggataattttgttttggctaaagaacatcgggccgctcatagtgcatggtctgctaataatgaaatccatgcggaactgaatgcaattttgtttgcagctcgtaaaggtaattctattgaaggtgctacgttgtatacgacactttccccatgtcctgattgcactaaagctattacacagtcaggtattaaaaaggttgtatatgcagaattatatgacagatctcctgaaaattgggcagacattctaaaacaagccggtattgaagtaattcagtactctcgtaataatcttcgttctctgaattgggaacaaatccgaaacttttgtggtgaataatatgattttaactgaacaagaaactatggttcttcgtgaacgtattaaaactattctgtctgtaggcgttcattgtgttgtatttgaaaaggctaacggtgatgttcgtacgatgtttgcctcccgcgatgaacttgaagtcaaatatgaaaataacaatccggcaacagaagttcgttatgaacctcgtgaatcagttcgagcattcgataccgagttaggtcagtggcgttctttccgccttgataaagtaatttcggttgatggtactccggtagaacgtttgcttcttatgtaatatgctttacgaatagtatggtattattaatctatcgtcaaacaacaaggaaataagatgtctgaagtacaactcccaattcgtgctgttggtgaatatgtcattctggtttctgaacccgctcaagcaggtgatgaagaagttaccgaatcaggacttgtgattggtaaacgtgttcaaggtgaagttcctgatctatgcgtagttcattctgtaggtcctgatgttcctgaaggttttgttgaagtcggtgatttgactccactaccagttggacaaattcgaaatgttccgcatccatttgtggctttgggacttaaacaacctaaagaaattaaacagaaattcgtaacatgccactataaagctattccgtgtctttataagtgatataaataactatatgaagagaacactcttctaagcggtagcctacaactgagagacttgtcgaaagaaggtgaaattcagacgaacgtggctactaaatattatctcgaattgagaatttaaaatgattaaacaattacaacacgctcttgaactgcaacgcaacgcatggaataacggtcacgaaaactacggtgcgtcaattgatgttgaagccgaagcactggaaatcctgcgttatttcaaacacctgaatcctgctcaggctactctggcttctgaactggaagctaaagatgaattgaaatatgctaagcctctggcttctgcagcacgcaaagcagttcgtcattttgttattactttgaaataattgctatcatgcgtcagcaaaaggttagctgtgtaagtcttggtggtatgatgacgggtttatggttatcctgtcgttaaatatccaaaacctatgttccccttgagggcttgcgcaggcaatgtcaataagtcctgcattttcatttaaagagaatttataatggcaaaacaagctaaagcaaagaaagcagttgaaaagaaagttgatggtacctctaaacgcgctggatacaagcgtgggtcgaactctcgtattaatcaaacagttgagaagatcatgcgcagagcacgtgcagttcttcgagatgatgcttctcgttttggaaaggttgttgcataattttagggagacttcggtctcccttttgtgcgtttagggcaaaaaagtttaaaaagatgtttactctcctgtaggatgtgttactatagacttgtaccacctaatcaataaaacaacctggagaacaaaatgaaaatcaatctgaactcatacatcaaatgtaaagaccacgatggttataaagctatcgaaattaaagaattccagtggatgttatacaaagagcaatttgagttcgtaggttgtatgacccctgaaggtccttctgatgatttctcttggaaaattgtgttagcaaactttttcacaggtgacacatacgaattaaaaactattattaccggtaaaattcgttcagaaacatatgttgacgaagaaactggttactctgaagatgttacatggtatcaaaatggacgcattacagcagataacctgatcgaaaaaatgaaagccaaaggtgttttaaatttagacaattggattaaagttgcataaaacagtttactttggtacaggttatgttattatagacctgtaccaataaacaacttaaacatctggagaataaaatgaactacatcaacttcgaacgtaaatatgtttctaacggtatcgctggttcttctgaagttatttgcttatggaaacacgaaaacggtacagtttgtgaaatcgaacagtgcatgactcctaattacgtttatatgcgatttgaaaatggcatcacggtttcaatcacgatggaaggttcaaattttaaaattgcattagatgatgatttccgtcagcgcgatttaggtactcatccttgctggaatggtgttaatcgtaaacttctggttaaaacttggattcgtcatatcctgagtaaccgagctaaacctgaacacctggaagcaatctttgatgtagttctgaacgaattcgatatctaatttaactgggagccgaagctcccactgaggaaattatgtttaaagttaatactttttataaaatgaattttaaaaatggtgatattactccacgccttaaaaacatgttctcatatgaccttatcgagccttttgaagttttagaagttactgatgccggctcggtttgtgaaattagaacttctgaaggtaaaatttatcaggcaggtgttggtaaattcagtaattgttttactttaatattctcgactgatttagatgagcattttattgaatgtcctaaccctaaggtccatgaagttcaacaacaagaaactaagaaaaatggtccacacgaatataccaaggttgaaactcctcacggtgtgatgtggcgtcataactctccttttggaagtaaaggaacatttgctcaactgcctaaaccgtatgacgatgaaaaatacatcgtcgcctttttatctgaacagggtactcaagaccgtggatgccaaagaagtggtttactaagtgaacttgaagctcataaccaagcacgtgaattcgttgagaaaaatcctggttctgaagctctagtcatgaaagcagttactcaatatatcactgctcaacctgttgttcatccggtagaaattaatttcattaagtagtttacatccaaggacggattagagtataatgatttctttagtaagtggaaaaatatgaaatttttaatagcacaaacagtccaattaaaaggtgttggaattcctggggtgatttttaaagttctccctgaatttaaaaccgccgctggaattatcaatgaagcgtatgctgttcaatgggttgattggacttctgacatacgtatgggtaaagagttatctcctattaaagggttgaaacatgttgaataaattaatccagaaattgttaggtacagaaatggttgaagttacgtatcgtgtgactgatgtaagcccatgggcccgaaaagttgaaccatatactaaaacaattaaaatgctgaaatatgacggtggattatctatcaaagaccgtctaccggcttatggtcattgggctgatgttgaaattataagtgttaaagatgtctgagttagagattagaagcaattttagttggccgtcatgtgcattaagtaattttgcccagtggccttttgttatggatggtatccaattcggaggtattgaaggatttctccaaggatgtaaggtgaaaaatgttgaacaacaaagacgtatatttaggctgtcaggactggccgcacagcaagctggaaggtcttatgcaagagctcaggaccatggaactctcttctggttaggagttccattttcaagatactctgaagcgtggaaagaattatacacaaatgcatattttgaagccgcgatccaaaacaaaggctttcgtgatgcattacaggcttcgaaaggaaaaattttgaagcacagcatggccagccacctaacaaaagatgatacaatattaactgaagctgaatttattgatgtgttaaacctattaagagactctttatgaagcctactattttgactgatattgatggtgtatgtttaagctggcaatctggacttccttattttgcccaaaaatataatcttccattagaacatattttaaaaatgattcaggatgaaaaatttatttctcctggtaaactattcaataccgatgataacctcggtaaacaattaatagaaaaatataatcgctctgattttattcgttacttagcgccttattcggatgctcttcgagttatcaataaactaaaagaagactataattttgtagccgtgacggcgctaggtgattcaattgatgctcgattgaatagacaatttaatttgaatgctttgttcccaggcgccttttctgaagtaatgatgtgcggtcatgattcttcaaaggaacaattattcgaactagctaaaacaaaatataacgtgatttgttatgttgacgatttagctcatcactgtgaccatgcggcagaaattcttaatgtaccgatttattggttggctcgtggtgaacgtgatgatattcctcgcactgcacaacgtgtacacacatgggatgatattgaatctcgtttggttccacccgagcataattcagattcagatcgtgaagaccttttaaaacgattggcggatttgcttaaagaatccggtgcaacaagcccaggcgcatggcctaatcaaattggcgctccgtcgaatccgtatacctggcgaactccaggaccaaccgatatgcacccgcggtggacgattcaaaactttcctttagattcgtctaaatggacttggtctataaattgttaagggtcaattatgtttgtagttcatgatattacagatggcaaaaacaccacacgtgactacggccatgttaacatgttctttcgagactggccattgtttcgttcagtaaaagacgcagaaatatttaaagagtgtgttgaacaagggttcatctacatttcagaatattacgttgaagggcttggtaaatggattaccacttatcagaaaacgctgaaatcgcttctagatgaagtggcttataatagaaccgtaaccaaaatcgaggacatcaaatgattttagatattttaaaccaaatagctgcgatcggttctactaaaacaaaacaagaaatccttaagaaaaataaggacaacaaattacttgaacgtgtgtatcgtttaacatatgcacgtggtatccagtattatattaagaaatggccaggaccaggtgaaaggtctcaagcgtatggtcttcttgaattagatgacatgttggattttattgagttcacattagccactcgtaaactcactggtaatgctgcaattaaagagctcatgggttatatcgctgacggtaaacctgacgatgtagaagtccttcgtcgtgtaatgatgcgagaccttgaagtaggtgcttcagtgtctatcgcgaataaggtgtggcctggccttattcaattgcaaccacagatgttagcatctgcatatgacgagaaattgattactaaaaatattaaatggcctgcatttgctcaattaaaggcagatggtgctcgttgtttcgctgaagttcgcgatgatggtgttcaattcttttctcgtgctggtaacgaataccatggtcttactctattagcagatgaactaatggaaatgactaaagaagctcgtgaaagacaccctaatggggttttaatcgacggtgaattagtttatcattcatttgatattaaaaaggctgtgagctcaggaaatgacctgtcgttcttatttggtgataatgaagaatctgaagaagtacaagttgcagaccgtagcacttcaaatggtttagcaaataaatctcttcaagggactatttctcctaaagaagcggaaggtatggttcttcaagcctgggactatgttcctttagatgaagtctattctgatggcaaaattaaaggtcagaaatacgatgttcgttttgctgctcttgaaaatatggctgaaggctttaagcgaattgagccaattgaaaatcagttagttcgtaatcttgacgaagctaaagtgatttataaaaaatatgttgaccaaggtcttgaaggtattatccttaaaaaccgtgattcatattgggaaaacaaacgctctaagaatctaattaaatttaaagaagttattgatatcgctttagaagttgtaggatactatgaacactctaaagaccctaacaaattaggtggtgtcgaactcgtatcacgttgtcgtcgtattacaaccgattgtggttcaggttttaaagatacaactcataaaacagttgacggtgtaaaggttcttattcctttagacgagcgtcatgatttagaccgtgaacgattaatggccgaagctcgtgaaggtaaattaattggacgtatcgctgattgtgaatgtaatggttgggttcattctaaaggccgtgaaggtactgtaggtattttccttccaattattaaagggttccgttttgataaaacagaagcggattcgtttgaagacgtatttggaccgtggtcccagacaggtttataatgaaagcttatttagaaacagttattgtagctaagaaggatggtggagatgtttccacctcttgctctcagattatattagattttcctaataacgattcctatcgtatttttatggacaattttgataagtacgaaaaaggtcctaattttgaagtttatcgtactttgctcccgattgtggattaagagccttcgggctctttttggcataaatataaattattactaaaaggaaaacactatgtctgaacaattaaatgaagtgtttgaatctgaaggcagtcttcctgtcgtcaatttgaaccctaaagctaaagttccacaagtctggaaaattggtgatatcgatacaaacatcgtagttcgcttattctcttacctttctgaaggcgatgctgtaaaacaagttaaacttggcgacaaatacgctcatgttgttattatgagtctgtctgaaaagggtaatctcgctgaattgaaaaatggccttggtcctgctcctattgatgcaatcaacaccattttcaatacggtatatgaacaggttaaagctcttcgtatggatgcagttctgttccgattccctaccaagaaattgaaaggacgtggacaacagcttcaaactcttcttgctcgtttagtttctactaaaaccggcggtcgttttaaagtattgtcggcaatgtatcaattcacaggtaaacacacctatgtgatgatggttcgtaaaaatgccaacattgaagatattaaaggcatccctaacattaacacagagttgtacacgaaagtagattctgatgttggcgaagtttatgtgagtaaaaagaccggtgaaaaggtcaccaaagaaacggctatcgccggttctattgccgcggtagaagaaaaacgtaaagataagcctgttattgctcgcactaaaatttctcgtcgtgctattgcagcaagtcaatctttagaagctgaccgccaagaaggtgagttattccagaaatacgaaaattctgctaaagaagttagtggcccagctacagccgaattacttcctgaagcatatgaaatcgtactagcccaagcatcgtccacagcaaaaggcactttagttgctgatatcgaaaataagatttataatcgtattgatgaatcctttaaatttgctgatgaagtttcttatggtagtgttattaagccgactttagaaaagtttgctaagaaaattaaaaccgaaaaaacaacatctgttaaagcattagctgcttttgttgaagctgcaaatgaaattgcagtctctattaaagacgaatggtttgaagattttagacgtgataatttccaactgcctgacgacgttttagctgaagtatctgaaagaacttggaaacaacgtaaatcagcgttcttgtctaatgtgatgtatacttatgcacgagaatcggctagaggcacctttaatataacaatgaatcgggaccctaaacaatactctgttgctgaaaaacgagctattcgtgaatatgcctcttctgcatatatagatatcaataatatgttgttaggtcgttataaaccagatttttacgatgttgcagatgaagatgaagttaaacgcgctattgatggtcttgattcggcgtttttaaatggagaccgtttacctgaaggactaacgttatatagagctcagtctatcagaatgcctatttacgaagcaatggttaaaaataaggtattctacttcagaaactatgtttccacttcactagctcctattattttcggtgggtttaaagagaacgttgcccttggacttgctcctgaagaagttcgcaaagagcttaacattgacaataatgacgaaggtgttactatttctcctagtcaagtaagaacagctatgcatgcaccagaacaaatccgtgttaacgttggatgggctattgacggcgcccataaagttaacgtgatttatccaggacagttgagtaatcaccctaatgagcaagaaattattttgcctagaggcattctcttgcagataaataaaattacagatgcgtcatctgacaccggtgcaggtttagaatccaaccttaaatttattcaagctgaagtcatgtcctcagaccagttagatgaagctatcatttacgacggtgatgttctcatggaaacaggcgaggtggttgctatgacgggtgaaatcgaatcagatgagccggtatcgttctcctcatttgtagaaaaaactagtgcacctaaaggtttgaaattgttagcatctttaatggatttagaatcagttccgtttaaatttgtccaaggatagtttacaaacacatggatgtgtgatactatcatcccatcaacaacatgaggaaaacgttatgaaatctatgcttcgctttaatggtcaagaactagtagttgaagatgttatcccggcagatgatgtttttaacgaagctgtgattgacgaattgaatcgagtattcccaggtgcattccatattgctatggaacctcttaaaaactttcgtgaccctgagcacactgatcaaatttttgtcggtgtagtgacaggtcatttagaaacagaggtaccaatggtcgtattagttaaatactctaaagatgatactccattccgagcaccagcattcctttcattccgtaaataaacccctaaagggagacgttgtctccccttttttatagtcctaaaactcttgacgcagaattcaccacacctgtcaatgtgtttatattagacacacctccagcggtcccacctaatctagaaagtcttgatactgcacttcctagaccagaatcattctgattatttccaaacattcctgaaacactactaataagtcctgattccaaccattctaaagcagcctgtctatttacagcacctgattgcataacgcgataagcaaatgttacgtcaaaaactgttatttgattatcaccatcatacgttaactcaggagaagagacactaacaggaatacaaccagtgaacatgacagcggtatgtggtaaaccatttcgcgcatgtaaattaacctgaatatctgcttcgacgtcttgtggtaaagcgcgaagacctgttacagggtcttggaccgagtttacccagtcttgcattgctctaaagttagatgcttcagaatccattctaaagcttattactaacgggtccatttctcggccggtaattcggatgttcggggagttatagttgaaatccgtttcataagataatcggttctcaggcatttttacagaataaatcattaaacctgtattattatatgccatattgaagaagtctatcagataagatcctactgtgaactcacctaacaagctttgtaccgtacgttgactcattgctccaatcagatatttacttatacctgattttcgaattaatttctgtgttcctgctgtaatcagggttgttacgccctgattgatatcaccttgagttaatcctaaccaatcagaatccaaccctaagttattataagcaaaactaccaattgacgaaattagtgaagatgatttagtcgatggtgtagtagcaaatacacaactaaacatattgtttcgttggaaatctgcatttatagcttggttattaaattcttctaaagagtacattagaaagtccccgcataaagtgaagaacggtttaatgtaataatttctcgcattgttatctctaacgtaaatgttgatggtaagttaggagcaacagcgagaccattaaattgtccatttggagttttatcaaaacgtacgctttgaatttgacacggaccaaatacatcagttaatccatcaaatttagacgtataaccaaagtttttaaccatccaaattgtagggttgcttacaactaatacgtttgttaatgacgcagtaatcttttcaaacaatgtcttattttttactgcatcatctggcgtcataggctcaataaacgttgaacggtaccattcgtctaaataacttttaatctcttgggcatactgtgatttaccagtctcaccataagagaaatagttaaaatactggtaaatgtttataatagccataaggtcttcagttgaacgtggagttaaatcccatgtaaagactttagtacggttctcagcaccgccatacatactacgagaagtcgtataaatctgttcgttattatcagccataagcccttgggtaatagaatctaatgcgccaaaaactgccgtagaggcaatgttacttaaaacacccgtagcagtacctccacctttagtaataaggctatcaccgatatcattaaaacgatgtgaagttgtatcaacgtcagatttggaacgcggcaaaagtatattagcaacaggagttttatttatggtagatttattagctccagcaggaagcaacccattagagaatttagtcactgcatctttcacattatcagttaaatctgatatgataccgttagatgaagtcccggcgtatgctggacgtaaattcctgagggatcctgaatcgcgtgcagacatattgtacgcggtaaataataatccattcttataaaggtctgttacctggaagtctcctgtggagtcatttccggctgctcttcctgtaggaaattgagcaacataagttttagtagttgtttcggttttagtgctttgcccagcactttctgtgactggtatcgctttatttaaatcctttgcatctactactatttcttttacactaatcataataatccttaattaacaccggtggcatggaaaattccaggagccgttgtacttgttacaggggtcatattctggactacggtattctttttgacgacgttatttgtgttactaatcgccgctaccggttgctgttgtttagattcagaagcacgtcctttctctattgactgaacttgttttgcttccggagatttagtcgaagattcaggcttaactgttgtctgagcctttttggcttcagccattttattatttagcttttcaaatctagcatctatttcctttttaacaacaggagttttattaagttcagggtctttaataagtttacttaaatcagcataagacttctcgacgtttttagcattttccggattagtcatatcgattttatcgatataatcctcaaatctaaccagtgccgcacgagtttcattagcttttatatacgcctctttacgctcctcttcaggtaactcttttaattttgctgattccgcagcacgctcatcgcttgtactaaactcttctttattgtcattaccacgaacccagttagtaacgaatgttttgccgcgttgtaacatatcaagacctttagaaacggttcctaattccccatcgtcacgcttcatttgatatttagcgactttctcttggtcttctttctttaatttgttcccggtagtttcttggaatccttctaaagcacgtccttctatttcgtccgcggtatcgccaaaacctatagcacgcaatatagacgcagagagtttagccattcctaattgaattagttcacctaagttcattaatgctgttcctacacctttgacaatagcaacggttaaaccgccccagtctccagcttcccacaattgttttatcgagtcaatagaagtgaatatatcacttaagaatttaccccactcttgagcttcatcagagaatttagtaaagttttcatcaaataaatcccaggcagaagtgaacttgtctgtccaatatttgaaatggactatcaataaatcaataccgataacaataccaagaataagcgcagccatttttgctgcttcaatagcagccgttatagtgtatttgaaaagcattccagcaattctgtctgaaattgatattgatttattaaacccggtttgaactgttttggtgagcattgcaattttatcgctcaatttaaagctaattccgcctttagaatcggaagtagaattagcactttcttgaaccggggttgggaagaaatcttcgtctgacttattatcaatcttttcaggtgtaggtaatgctttaaacaactcatcagaagtttcattctcaaccactttaacaggtattgcattctcaattacttcaagagaggtgcctcctgtattttgaatagcggtagatgcttgtaatttttgctctaataatgtagctaatcggtctaacttagagcttattgcactagaaacttcgtttatacttttagtgacttcagtttgtttttcaataacttctgcgataagctctgtgccttcagcagtattatctgtcgaattctttaagtctccaattgattcaataattccattgcctttatcttctacactttgagatgtgagttcagacgcggcttggacatcgtctagttttgatgaaatgttattcaatgcttctaatgaatcggtagctgcatcagcagctactttttgtggtttattatcggcaatgaccttatttctacgcatggatttcatttcttcaggtttcattcaagcaatccaataatttctgctatacccttaatagggccattagggcctggaatagcaatggttgtcgaaaggtcttctgcccatttgattacaaaagcaggcatctcaaggaaagaaatttctttctcttcgtcattaacttttattaagcaatttgatagcatttcactgattgtagcgaattgttcaaatttgcctggtggtctaaaataaaaagtattaccttgaaattggaattctgttcgttggcatacatagacgtcatctagtttataagtgaatccatctttttcaacttcagacttaagtttgttattaaattccaatatgtgtaaacatgcaaaatcaaaatctgcaggactcatatttttacaaatagaatcagctaagattttcatgttttcgtcaggacctttaacgtcctttaaaagattataatgtttgagccccaatttgggaatcattacctttttattagactgcggtagaattattttctttagaggtagaatcagatttaagttcatttttaaccttaactgggttaacaggttctaacaccattgagttggtaaacatgtacagatgagtttgtgagttgttatttgataactcatgaataacttcatctacgtaaaattcggatttgaattggttcttttgatcgacaaatataattttagtagcaggcgttatgttaaaattacctgtagtagtgcatttagcatatccgtcatattgagccattgtctgaagacgacttgcttcttcaaatccattacgataggtcatttcggaatatccaccggatcttgacacaacaatagcattatcgccatcgcctgtaacaataaccggaatagatgtatctaaaaatgaatgagcgaatatcgtggcgtttttaatagggtctcttgtaaattggttagctttagtcatccaggtgaaatcccatactaatggatactcaagctcttgaatatactggcctacggtatttggctcgcctacaatcatcttaatgccttcctgaccaataagagtatcgtagtcaatcatgtttacgcctaaaatatcttgccatacgaatacgaacttatcactcgctgtagcaagtcctaattctctgacatatgccaaataatcatcaaatgtgcttgtccaaggaatatcaggaacataagcattaatggtgtttattggcggagtaattaatgtacggtctttatatatgacacctaacatttcacgtatagattctcctgcgtctgggaagaatggtcgcccaaatttaaggttctctatagaatgtattgttccaagctcaattgcaataatattgtcaccttttgagtccacagacacagaataatgtctacatccataaattcgagttctaacttggagaggtgtgtttgaatttgaaacagagatttggactatctgtctaccatccattttagtgtggatgtttttagtgtcgtaaaattgaagaatcccttcatttcttccatatagcgaatctcgcatggttaaagttgttattgttgctgcgagttcaacgtatctattttcttgccaagccgaataatcttggtataatttaacgcttaagttaggatatcctggacgttggaatactgtcattttttatggtccttttctactaatgttaaagcaataccacgttcaacaggaatcatttgcataatagaatccaatgtgtattgactctttactagtgaatggtttatctgatagaatgtaaaaatctcatcagggttaactaacaatttaaaaacctctaagatatcagtatatgttttaacatgacgttcacaacaacctaatctaagggtcaaattaatagggttcatagaagcaataaccttctcgagcgagtcaatgtctattgcttctattacttggatttggttctcttcagtcaaatcattccatgggtaccattcatcattataatatatttcttttatgttttcacttatcattaatgctttattgtcataaaacttttcagggaaagaaaaacgtatttttataccagcaacatcaagttcaggttcgactagttctttttgatatatctcaaatggtgcagttttttctttagagcatttaggacaagtgaaaataacgggaacttttgttttgcctatagagcctgcaaaaacttgcaggaatataaatggttgccatgttttagggtactcgccaaaataatcatcaatcagatcggcaattatttctttttgttcttgtggtgaacgatgttcgatatcatttctaactagtaaaaagtctctataatccgctacggtgaacggcttgaaacgatgaacaccatccggtaatttacaacgaattatattagccataattactccttttctattatttataaatacacaataaaggagttaacatgtacaaatatacatttaccgtacgtttaggcgataaagaagtgaattgtagagcctttactttaaaagaatatttaggactcataggtgcgcgggctaccggtactattgaatcagcagtgaacaatattatcactaattgctctaatgctaaaaacttgactaaacaagaagccgagctattgttggtaaatctgtgggcacattcgttaggtgaagtgaatcaagaacacacctggaattgttcctgtgggcattcatttcaagtctatatgaatttattgcacactcaattggatgaacaggccgatccctggtattcgtttagtggtattaaaattaagttccgccaacctaaattatttgacgataaaaatatcgcattaatgattgcttcatgtattgaggccgtttttgtcaatggagagtccatccctgttgaagatttaactgaagcagaaataaatgacctttacggccttataacagaagatgacatgatcaatattaaaaatcttttggtatcgccatcaatttatctggcaacccctattaaatgtcccaaatgtggggcatcacacgttcacacaatacgaggcctcaaagaattctttgagttactataatgtctaatatcaataaactttattcagatatcgacccagaaatgcgtatggattggaacaaggacgttgctcgttccgtaggacttcgttctattaaaaatagtcttcttggtatagtgacaactagaaaaggctcacgccccttcgaccctgaatttggatgcgatttggttgatgaacttttcgagaacatgacaccacttacagccgatacgattgagcgtaatatccaggcagccgtccgtaactatgagccgcgcatcgacaaactttctgtaagtgtaacgccagtatatgatgactatacagttatagtagagattagattttcggtcgtagataaccctgatgatatcgaacaaatcaaacttcagttagcatcaagcaatagagtgtaatgcttcaaggcaacctatgtataatggttttaggtccttccgatacagccgggagattattagttaaaagagagaacattatgaagctggaagatttacaggaagagttagacgcagacttagctattgatacaacaaagttgcaatatgagacggcgaataatgttaagttatacagcaaatggctacgtaagcactcatttattcgtaaagaaatgttgcgtatagagactcagaagaaaactgctctaaaagcaagattagactactactcgggacgaggtgatggtgatgaattcagtatggaccgatacgagaaatctgaaatgaaaactgtcctggctgctgataaagatgtgcttaaaatagagactactttacaatactggggaattttacttgagttctgtagtggtgcacttgacgcagttaagtctcgtagttttgcacttaaacatatccaggacatgcgagaatttgaagcggggcaataatgcgttattcaattgaagatgcctttaataatgatgaagaatttgaaactgaaattaaattcttaatggaaaagtatcgtctacgtcgccaggatattcgtattctagcagaccacccttgtggcgaagacgtcctttatattaaagggaagtttgctgggtatatcgacgagtatttttatacaaaagatatgggtatcgatatgtgcatgcgagtggtataaatagatatgtaatttcaacttaggaggcaatcatgtcagataagatttgtgttgtctgtaaaactccaatcgattctgcattggttgttgaaacagacaaaggtccagcacatcctggtccttgttataattatgtccaacaattgccggtttcagaaagttcagaagagcaattgaacgaaacccaacttttactatagtgttaccttttttgcctatggtttttggcccttccaaaaaggtcgggcctttttttaattagaagtcttcttcctcatcctcatcatcgtcgccttcaagttcggcacgcttacctgctaaggcatccctaacagaaatatcatctgtatcttttaattccgtttcttttatacgtttcttataataagcttccaattcttcaagcccttctaaggtatgacaactagcaattttacccatgaattcgtcaatagatgcttcgtataaaaattgtttaaattcaagtaccatttttatctcctaagggccgaagcccttataaattaattgttttcattacatagttaaatttctcatcagcgtaacgttggatacgatcaataccgtgttttaacaagtaattaagatgagtatacttctttttagtatttaatgatttaggttttacgcctgcgtcatcgatgagatcccaaactgtagcaacagctttagaaccatgcttacgaagcacgcgacctacggtttgaagtacgataatttttgatttaacaccatgggcaaaaataacatgatgaagattcttgactgaaataccagtagagaatactccatatgatgcgacaataataatgcctttaccattttctgccatgactttaagcgcgttacgtgtttcggtatcaacttcgcctgatacgtaataaactttttcgtatccaagctctttaatagcttcaaatatttctttaccgtgtgtaacgtgtttaaacattacaaaggcgttctcgtctttcttagccaatttgactgaaagttgagcaatccactttgtacgtcgttttagtccggtaataattttaacttcttcttggtatgttttaccttttaatttaatggcgaattcgtccggataacgaaggaaaatactattaatcttaagctcagttacctgtccgtcttccattaatttagacgtgctaacaggacggaagatttcgccgaacatacctacgtactgcattacattggcttttccgtctcttaatgagccagataaaccgaatttaaacatgcaattatttaatcctgagatgattgaagaaatacttttgcctgttgctaagtggcattcatcattcatcatcataccgaactgagagaaccattctttaggctgcttaactaccgtttgccatgtgccaacaataattggagcgtcgtttttagatttgtccgctttatcagcaccaccgccaattttcttaatcatcgaatgactaaacaagcgataatcaacaaaatcattagccatctgggttgtcaacgctgttgtagggacgataatgagaattttaccttcatagttctctagataatatcgagctaaaagtgcttggattagtgatttacctgctgatgtcggaaggtttaaaattcgacgacgattaactagtccttcatatactgcatctttttgataccaatgtggttcgattttggcgttgcctgaataaatttcttgtttagaaagccatgcgtcaaaatcttccctggtaaggtcttcggtctcaaagattttagggtcaatccatacagaataactcatattgttacagaacttttttatttgtcctacaagtccatatggtaacaaacggttgtaatctaaaagacgaattctaccatcccattgcccatagcgatattttgggttaaatttatacccgtcagcttcaaagctaaaaaagtcacgaagttcgtaaaacgtactttcgtcgcattcaatgcgcacgtgactaaaatcataaaaatgtactttaatgtcagtcatgtcaaattaccatgtaataaatatagttatatttataatgaggaaataccatgatcgataaagactatattgaagagttacgtgctctttctgataaaaaggaagccaaagctaaactgtttgaatatgcggaacagtttggtattagtgttaagaaaacaaaatcattcgataatattgttattgatatcgaagaagctcttaacgcactggctgatgaaccattacctgaaactgatggattatctatcaccgatttaattactgccgcagatgatgtagacggtgttaatttcaccaacgaagaagttaaagaagaagctattctgttgtttgattctccaacagaacaagttgaagtattagaagttgtcgaacaagaaatagaattcgaccatgataaatttgaagaagcaattactcaggttgttgaatctgaaaaagagccccagccagaagtaaataaagaagtaaaatttgttctgcctgaaaattttagtcctacactcattaaattaggcaaaggcccagggtatgttactgttccttggtggatttatcaatggatagccgaaaccccagattggaaatctcgtccaaccagttttgtgcatgcttctgctcaccaaacattatttagcttaatttattatattaatcgcgacggatcagttctaattcgtgaaactcgtaattcttctttcataacattaaaataaggataacttatggcttttacagttgatataactcctaaaacgcctactggagttatagatcagactaagcagtttactgctacacccagcggtcaaactggagatggtcctattacatatgcttggactgtagacggtgctccacaggaagaaacatcagcaacttttagttatgtattaaagggtcctgctggacaaaaaactattaaagtagttgcaacaaatccagttcctgacagtgaagctgaaacagctgaaattagtacaactattacagtcaaaaacaaaacccagacgactacattagccgtaactcccaatagtcctccggcaggagtaattggaacagccgttaaatttactgctgctttggcttcgcagccatcaggtgcatctgctacatatcaatggtacgttgacgattctcctgtgagcgaagcgactagcgctacattcaattacactcctgccacaagcggagttaaaaaaatcaagtgtgtagctcaagtaactgcagcaaattatgatgcgctgagcgttacttctaatgaagtatcactaactgttaataaaaagacacaaacaactacattggcagtaactcctgctagtccttcagctggagtaattggaaccccagttcaatttactgcggccttagcttctcaacctgctggagcgtctgctacgtatcaatggtatgtagacggttctcaagttggtggagaaactaactctacatttaattatactccaactacaaatggagtcaaaagaattaaatgcgtagcccaagtaactgctgatgattataatgcaaaagaagttacttcaaatgaagtatcattaacggttaataagaagacaatgaatccacaggttacattgactcctccttctattaatgtccagcaagatgcttcggctacatttactgctaatgtgactggtgctccagaagaagcacaaattacctattcatggaagaaagattcttctcctgtagaaggatcgactaatgtgtatacagttgatacttctactattggaagtcaaactattgaagtgactgcaactgttactgcaactgattatgatagcaaaactattacagcagaaggtcaagttcaggtaactgataaagttgctccggaaccagaaggtgaactaccttatgttcatcctcttccacatcgtacttcagcttacatctggtgcggttggtgggttatggatgaaatccaaaaaatgactgaagaaggtaaagattggaaaactgaagatccggatagtaagtattacttgcatcgttatacgcttcagaagatgattaaagactacccagaagttgatgttcaagaatcacgtaatggatacatcatccataaaactgctttagaaactggtatcatctatacatatccataatcgtaaggggcttcggcccctttcttcgtttttaaagcataaaaacacgacttgagattgatgtatataatggcaccaactcgataacatgagattgattatgagaactgaagttgaagtttatacattacatgaggcgggattttcattcgtagaaattgctcaaaaaatcggtttacaacctaaagaagttggattactatggactaaagccgagacagctcggtcaaagtttaaagcaaaagaaaaagttgtataccgtaaacgtttgattaacaaaaaggtgaagaaatgagttttgcacaggaattaagagaaagggctctggccactaaagctaatttgttgagtgattttattgctaacttctctgtgatggcagagaaagccgctgataaaggtcagacacaattcacgtactacccgtcaaagaatgatttaactatcactgagcaagtcgggcagtggttacgtgataatggctttcagtataaaattaatcacgaccagcgtgatgggcactggatagaaatcaagttctaatatgctttacattttttgatggtataatgaatctaggttctatccattcaaattaaacatctggtcggagacagagtctctgctaattattttgatattattatttataatggtgatttatgtttaagaaatacagcagtcttgaaaaccactacaactctaagtttattgaaaaactctacactaatggtttgactactggtgtttgggtagcacgtgagaaaatccatgggaccaacttctcgttaataattgaacgtgacaacgtcacatgcgccaagcgcacaggccctattcttccagcagaagatttttatggctatgaaatcgtactcaagaagtatgataaagctattaaagccgttcaggaattcatgtacacagctcgagccgtatcatatcaagtattcggtgaattcgctggtggtggaatccagaaaggtgttgactacggtgaaaaagatttttacgtgttcgatatccttatcaatacagaaagtggtgataatacatatttgaccgattacgaaatgcaagatttctgtaatgaattcggttttaaaatggcaccaatgcttggacgtggaacatttgattctcttatcatgattccaaacgaccttgattctgtcttagccgcttataatgctactgcgtcagaagaccttgtcgaagcaaataattgtgtatttgatgctaatgttattggtaataatactgcggaaggttatgttctgaaaccttgtttccctaaatggctgccaaacggtactcgtgtagctattaagtgcaagaactctaaattcagtgaaaagaaaaagtctgataagcctattaaaactcaggttccattaaccgaaactgacaaaaacttgcttgatgttctagcttgttatgttacattaaatcgtgttaataatgtgatttctaagattggtgctgtaacgccaaaagattttggcaaagtgatgggattgactgttcaagatattctggaagaaacttctcgtgaaggtattgtattaacatcatctgataatccgaatcttgttaagaaagaattggtccgaatggtgcaagatgttctgcgtcctgcatggattgaattagtatcataacaaaaaagggaccgtaaggtccctttttttattcatcaatgataatttttggtagtttaacaccgagtaaaacagacaagtctgaacgtcctgccattttatccatgtccccgccatcaattattctcgcttctttttcatcttttgctactgtgtaaggatttgctgataaggcatatctaaccaataatccgatagacggttgcaagctttctggatcaactacaactttaaatgcaccaacatgttctgggtcatctaaatctactccttcagtgtatggagcataaaagatggaccctacaatttctttttcgccgagattttctacaacacccacaataacataatctaacgggctgttggtatcgcagtaaagaggtaatccatttgccaagaatccataagcattttgtgaaagatacttgtcatcttctggcttatgttttaaccaaccggaagcagcaagaatagcagctgcacgagctgaggctacacaaaacgttgcagtataagttgtctctttttgaatgtgtgataccatttcacacaccattcgatataatgaacgacctgcttctggagctgatgcatagctcaagtcaataaatccggtgtcagtaattccagtaactttataacgtttcgatacagtaattaaagactgaagaatatctttattaatttcatctgccatttcagtagcaagcaaatcttctaagaagttaggggcatcaaatccattcgcttccaaatcttgcgctaattcgaccgtgaggccagttttaagtttacgagatttgactgaagtttgccatttattaatctggaatcttgcatcagaaatttcgctatcagagctttcaaatttgcttgttaccgctgcatctgaaaataaccgtacctttaaatgaacgactgcaatctgaagagctaattctagatcactttcttgaatatctgcaaatggtgtatcttctaacactttatagacgatattattatatttgaaaaaatcacctttatttagtgtgacttttgattcttctgtgagctcagtaattttttctctgtctacatatccagcttcgcctgcataagtagcacctgttttaaatgtgaattcattatctgggttaagatatttgataccataaaaagcagcaacaggttgattagttctttgtgttgctacaatgtcagaatatattaatttagtcgtagcgcgagtcaaagcaacgagatttgggcgaccaattgagttgctagtagacgttgtagattcacgcaataatttttggattttactcattgcattttttccttatgtgatatagattatttataaagattgtttacaacgtatttggtatgtgatactatagacttatcaactacagaggagtaaacaaaatgactaaagcacgtttcttacgagatactttaaaagttctggaagctgaagcagctaagttagtagaaaaatatggtgcaaaagttaatggtaatgccttcaacaaagtatggatgaaagttgattctgaagctcgagctaaaggttattgggccactgataaacttgcatcattcaaaaacaaagacggatctccggcatatgtccaagaaggtatgcctaattggcaaaatattttgaaaacttacatcgaaattgcacagaaataaaaccaaaaatgggagaccgaagtctcccaaaataagatttaatcaattaagattagatgccttttacatatacacggcggaagtaagcgttcttaccaaggctgttcaggatagacggcataccggactggatgcgagcacctggagcctgcagggaactttcagcaaacgggttaacaccgataccgtaacgagttttaaagcccattaccggctggaagttcttaggatcggaaccacgcagtggggtaagtgcaacgtaaggagcatagtaaatacctgcatccatttcgttagcgcctttgtaaccaacggtgaagtaatcctgtttagcatactggtcgatgtatacgcggtatttaccaccaagtacaccggcaaatacagacttagtagtgtcggtattaaaaccagaagccagaccctgtgcagcgtaagaaataccagtatcaactgaagccagtacgttaactacgttacgggaagcgataatgaagttaccttcaccacgaccggtttgacgagcaatttcaactgcttctttatcaatctggaacaacagagatttaaagctttcaccggcccaacgagcaccacggatatcaatcgggtcctggaagtcaaatacaccagctttagaacccggagtcagagtcataccagatttaccaacctgtgcagagtagttaatccaatcaacaacttcacggttgatttctagcataatttctgtagccagaataccgctcagttcagcatcagcatccataccgtgtactgcacggaggtcttgtgccaattcgatggagtaagcagctttcagctggcgagatttagcttcgataacttgtttatcgatacggaagcccatttcattccacgggttatcggtagaaccgttgaaaccttcctggagttcagcgatagaagtagccataccttcagcgatttctaccagtgcgccagcttccatttgtttcttaacttctgcatctaatttagctgcatcagttgcactagaatcaagtgttacgatagcagaagcttgcagatatacggtaccagtttcttggaagaagtgagtatagatatcacctacaacagtagtagtgtcagcagccagagctgggaatttcttagcagcaccctgaccagagaacatcgcgtccggggcatacatcggatggaaagcttctttagcgccagcagcgatagggtctttaccatatactgcacggagagcaaatacctgaccggtcgggctgttcataggctgaacaccacaaatatcaaaagcgatcagattaggaatagcacgacgaaccatacccataactgctggcccaatctgggttactgcaccagaggtttgacctgctgcaatattctgagcattataaccgtggtcaccaccaatttcagcttcggtcaagaaagaaccaaatgcctgagcgattttctcgtctttatattcaggggatacttcgaaatctttttcctggttttcgaagattttagcgataatagcctgcttgctattagcgatttccggcaggccttcaccttccagcagttctttccatttgtctacgagctgagctttagttttgatagtagtcatttgtgttaacctttaaattagaaacgagatgcgactttcgcatataaacttacattagaattctgttctacctgagttgtggtagtgtcaactgcttcggcaacaaaattaagaccggcagcgtcattgtcaactgtatttatactttcggtaatagcggcttcttctttagtagaacctttaaccatttctacaatagcagttaacttagtaccaaatgcgtcagaataatccataccttcaaccaggccaataactttttctttctgagattcagtcaggtcttttacgctttcattaatagcggtttcacgctgaacgtaattgatatatgcatcacgtttggtaacttcttcgaacaaacgagcggtttcttctttatgttcggccagctcttcttccatttctgctacaacatctacagattcttctggaacaacaacgttatgttcaacaaacagttctttcagaccaccaagcatggattcgaacaaatcagctttaatgcctttatcaactgcgatttggttttctgcgagccattcttttgcaagatggtctaggaatttagaagcttgttcagccaattttttatcagctttctcttcagcatcttctttggccttttcaacttcttcttcagccttttcggcgatggctttgatatgagattcagccagtttgactgcttcctgcttaacggtggcttcgaatacagtgctgaaattagctttaacgtccggagacagttctactgattcgaaaacactattaagagcaactgaagtctcgatgttctgagcttctttcaaaagttgttctttgatcattttagtgtcctgtggtttagattacattattatttataatgcttttaaactctctgcgagagctttaaatgcttcatcagcactgtttttggtggtttccaccgaattttctgattctgattctgatatttgtttaggagtaacccaagcatctggagcagaaggtccccatacggcatctacgccgacggttaatttaaatccttcgttcacgatacggtaccctttattggtgtcggttaaagaaccaagaccacgagaggaaacacctggaatccaaccagctcgtatattagcagctaatttatcaccgggaccatggtcgccttcaataattctagcacgtccatatacatcgtttcctttccaccacatatcttcaataatgatagcggcttgcatagggtcaacatttgcacgaggtggatggtttaattctccaagggcttgtttggttgcgacttgttctttaatatagtcacttactgctttttccaaaacgcgtttaggatataaacgtttatttcggttaacaacctctgcctgaagaaaaataccttctatataaagccctggttttaagccagaatcttttccatcatgagattccaacattggaacgccatcaataatctcaccgggttgaccccaagtttcaataagtaactcgggtttattcattagcttaatcctaatgctttacgacgtttaagagcctttttacgcttacgcaagcctttaacttggcctgaagggttagcttttttagctttaacgaccttacgagcgatttgtctacgttttgctttagaaagaccggtggtttggaacgcgttacgttcacgagttttacggtctttagtgcgggtgacttcaccacgagaagaaacatgtttaacgataaactcatttaactgttcttcattaataatggaagccattgcaacagctaaatccgtttcagtttcaagcatgttctcgataatagtatttatatcgtcaatatcgagagcagaagacaatgcatcgattcggccctgtgcttcaggaataagtgcttcgacattttcgagtaccaattcataagattcagggataagatacattattcatcgtcctcatcatcttcgtcttcgtcgtcatcgccttcatcagcgtcgtcttccgaagctttagctttcttttcttcttcaggttcttcgccttcaatcaaaaattgagaagcgatttctgctttgcgtgcttcaatcaaacgaaccgctttttctgccattgcactttcaaaaaactttcgagtagcaacgaggtcgtttgatttaatagcttgaattaaatcgtccattaaaaatcctcttgttcttggtcggggtcttggaaacgagcctctttcgactcttcttcaatttgcttagcctcttgttcaatttcctcgtcagacatctgaagaatatctttcatagctgttctgtgagaaatatatttaccaataaatggttcggccatctgaagcatattaatacgacgctccagaatctcagcatcctttaattccgagaaataactatcccgatgaaattttatcttaatattatttatttcatcattccactcatcttctgtaataattcctttaagaattaaattagttttaagcgggtctaggaatatctcttcaaatttatgttgcagctcacgaataaatttaccaaacgacaattcatctcgtgtaatagaagtaccagcatcaaactgtataccaccttggtcacttggaatacgggtaataggaatacgtaaagccatataaagcgcattacggaaccaacgtacatcttccatgtttccagtattatctgcacctggtaatgtgtcaacttctgttactgctttaccatcacgtcgttgtaaccaataatcttcggtcatcgacataatatgctgctggtttttaatcttgcctgtagtagcatcatacgcaatacggtttttcatcgtattcataacatgttgcatatgttctgctgcttttcttgaaggcatattacctgtatcaacgtaccatacgcgacgatcgggagcacgagtaatacgataaattacgacggcatcttcaagaagttttaattggttcgctggcttaatagcccgatgcaaataaccgatgatatttttaccacaacaatcaactaaaccagaatgggcataaacaatcgcggctttagggatttttatttttgtgccagcttcatatatgcggccatcacaagcataagattcgtgtgatgtgtcataaatgaaatattctttataacccttgactattttaacaccggcttcagtggttgtaataacttcacggacatattgaacttgacgtgggtctaaacgacgaagctctttaataccttctttagggcgtttagggtcaataattttatggaagaaaattcgagaatctacataccaacgtctaaaatggtctgaacctttacgttggaaagataaatgattcaacacttcgttaaattcatccaacatcattgattttatatttggactaaattttgtgttgtctaaatttatagaaacgacttctgtatcatcttcatatacgatagcatcggaaactatttcagagactgcattatccacttcatagttcgtcgtcaaatttctatacgtatcgattaattcacgggttgatttgagccccggttcttgactaccaaacattctctgaaacatagcattatatgtttgctgtgcttcattttcagatacttcgtattctttagcaccgtcgtctaattttggtgcggtgatagattctaaattttctttttcttggtctttgtaatcacgttcgtccatttttgcccatggagcaaacaaacttaagatattaaatttcattgtattctccgaatgggaattatagttatatttatatggacttctccgtcatcacgggaagctggggatttctccccaaccagattattcccaccaatcaagagcaagagttacttcgaatgtttcaatctcgttattcgaatcccaatcaagagatacttcaccaacgttagtaggccacaagccgacaatttcaacttctttagtgaccgttttagcatcacgagcaaattgacgaacgatagcagtctttttatattcagcaggtttaccaccggtaatttcattaccttgtcctgccgcaataccttgccaatcaacaaatttctgacgaatgctatgagcatcatcgttcattactgtaatagtccaatcatcgaatgtacgatcaccggccacgttaattttacggttcatataagaaacaggaaccttttcaacgatcgcagccggaagagccgtagcacgacactggaagctaaagttttgcccaagataagagatttctacttcgaacaggttagggcgagcgaaatcacctgattcgaaggcacgagttacgtcatctacaaacatattagcctctgtagtaatatgggcttaggattaaccagatgcccatagaattaattttaaacggtatagttatatttatatgggctaccgaaatagcccatcaggcgtcttattagccacctacagcaccaattagttcgtcgaaatcagcacccgttgctgttgctacaaagttcaacgtaatataatttatcgatcttgcaggttgtaagtagaaagtagctacaaattcattacggtcgataactgctggtgtgttattggtagtatcacaaacaactttaaagttatatacaccacctagagctttaataccctgtagatactgagaagtctctgtacggaaagaagaacgggtaaatgcgttgttcaattcaaacaggcgatatttagatgctgaaccaatgttcgttttaaccatattgaacaaacgacgaacgttaatacggtcaaatggtgaaggaacggaagtagcagttttatcaccatacagaacatacccatcaccaccggtaccagtaacagggttaatagcttcctgatacaaacgatcacgctgtggttggcgagtttcaattgcaagcttaataacgttaagaatttgtccacggttataaccagcaggagacatccaaggctgagaaatattgtctgtacgagcacaaagaccagcgatatcagcggctaatggaacccaacgattcacatcattatatttgtcgtattgatatttatagttgccgtcaatagcagcataagtagaacttacattaaagttattatcagtgtaagttcctgacgcagtacgccaatcaaccagattatcaactgcacgattaacaggaataccgactatagttgcacgcggcggtgaacaaagaaccaagcaatcttggcgagaatcaccaattgctacaacatgtttctgaactgtagaagcaacttctaaagattcgcctgcacaagaaccggcaataaacaactgcgcattaacagattcgcggtcggcaaacaaatcccaagcttccattaaatcaccagcgtcaaccgtttcattggatgataagccaccacccagtttgattacgccagagaaaccttttggccaaccttgtgcagtagcgaaaatataattgcttgcgcctttagcaaagaaatcatcaataaagatattactaccataaatatcgcgttcaccgcgtttagtagaaagaattacactctggactacagcatcgttacgacgaacgataattgcatattggtcatcagattgtgggccatatccaaagattgctttagcagtagatgcacgagtaccaccatcaggataaatttttaactgggctgaagcacctttgtcatagtctgctttagatactatttcaatttcgagctggtcgccaagttcaccaggataaagagcaactacgcctgggacaccatattttttaatagattcttggaaagttacagaagtaatagcttcttcagaagtttcaacttcagttaacagaataccagaatcagttacgatagaaccaattgtaataacgccagagagcccagaagaagaactggcaacttcggcggtccagttagaacccaatgccggatattcattaatttcttttgcacgagcaataattttaccggttgggatataaacgttaagaattttaccatcaacatcaactgaagtgacataaccatctgcttcaacagtttcggtcaaatacttaacgataattttatcaccaaccgcatagttactaccagcggcagagattgtgaattcaatattgcctgctacaggagatgagttcttagcagtatcacgatcaactgcacgtacaacacgaaggtcattaccatattgaaggaagttcatagcagacatgaaataatctgctgtatccgtattaggagtaccaaacatatcaactaatgcaacttcatcagtgatttgtttaatctggaatgcaggtccccattggaattttccagccagggcagcagtaccagtggagttattaactacagtactctgtacggtagtttctttgagctcaacgcccggagagagaagtgacattttaattcctcttaatttgctttattttatttataccattgacaggccatgtgctgatggattatattcggctgggttacttgcacagtcaacaaatataaccggggcgtagtcgtcattcatatcctgtaattctcttgagaatacttctgatgcaagacgcatatcatctttatccgcatagtctgcaaatttctgttgcgttgtcaaccatccgaaaataacaaggctcatcactaagtcgtcatggtaaccttcttcagccgcccaagatacgcccttttcactaaacgttctgaattcttgaatagtagccctatggtttattttgagcttgtctttttcaataaggtcctttaatgtagagcaacctacaggcttagttctacggctttgcttcatgcctaaatcattcattgaatcacaaataacgttttcatattcaaggtccatataaagtgatttagcgacagaaacacctgttgagttcaattcaatataaattggacattcgttatattccattagatatttaaacacaatatcagggagtataaggtgcgaaatagtattagagtgtagaacaccaacttgttcccatttatctgtcgtaacatcaataatatgcattgcgtgatagtcctgaccacgaccttcagaacagtctagcgtcgcaatatatttatgtccttcctcaggctttttgaactggtgaaatccatgactatcaggtgtaacttcaatgtaatccaatatagccaatttcataccggaaataagtgtgcctgacgtcccctcgaaagctgcagtatgttcttgacgaaactgtgataatgaagaggctgaaatagtctgtttagaccactgccatccgtcatcaaaaatatcttcatcgttgtatagtcgttctttaactgagttccaaattgcagtataaggttcaaatcctgatttaccttcaacagctgcagtccaaatatcataaaagtgatttaatccatttggtgtggttgtaataataatttttgaacgacgacctgaagaaataacaggttgaatagcaagccatgaatcaatgaagtttgggataaacgcgcactcatcaatataaatcatagcgaatgagttaccacgaaccgcatccggtgatgaagcgtaagcaccgattgaagaaccgttgtctaactgaatagaccctttgttccattcaacaatacctggttgtaaaaaatcagggagtaattcaattgcttgttttgtacggtctaatacttctgccgacattgagcctttatgtgcaagaatacctaccgctttatctttgttaaagcaaacaaaatgagcaagaaaaatagctactacagtcgttttgcctagctgacgtgataagttacaaacagtcatacgcttagaagacattattttaagcatatcacgttgatagtcacgaagttgtactttaattgtaccgtagtcgatatgggtaatagcacaataggtctcagcaaaatatacaatgtcatcacggcattttttccactcagcgaccatttcataggtccattgagtttttatatttgctcttttaaggtttggtaaacccatataccgtgtgcgcttattattcttatctttgtatgtttgaaataattcaggcttatctgagttattaggaattttaactattttgtttatacgtagataatcactaaatttttccggataccatttaccgtcccattgggatttaatccaatggataccatcttcttctttacgttcagctaaatgaggtggtagaataacaactttgtcgccttcatttaacgggtgattatcattcaatgcgttaactggctgttccattaatcaccttctcacgagcttcttgagcctcgtaagcatctcctacttcttccattaattctgttggagagcccatgaacactgtagcgttttggatattcatctggctggacggagcagcacttttagtgccaacctgttcagatgtgatttctttcatatctttatgaagcttcagtatttctttgttcgtcgtagtcatttgccccataagagttgcaaatacttccatgtgacgaggagaatcggcatttttagccgtctcaagaaaaatcttggcagcgtccattaacatttgttgttggaagtgcatattcttacgaacaacactatagtcatcttccaaatccggggtgcggttttgaggattactttgaacttccaccaattgtaaaggagcatatacctctacttcctccccagatattccagggaggtcagagatatctaaaagcttattaatatctagaccttccatatttacctcttattgttttctaggaccaggaggggttggtggagtcgggattggaatatcatgagtataagtttgttcaacttcaccattccaatcttgtgcttcaacgtctctcggtttaatttctgtatcaactgattcaaaaacgctggcggctgtttgaaggtctcgttcgttagcatgaaaatcaagataagtcgttttaataaggccttctgctgcgcctaccggaggatacatccatccatttacttcaaatgttaatgaccactctaaacgtcgacgggataaattatcaccgtctatttgttcatccattgctgctgccatccatacgactttaatatccctttcaaatggaatatcctgcccatattgctcaatcatagtcgtattaaaatgcggctgaaaatatggaataatttgctcaacgatttggaacatatcatcttcataacgagtaaagatgctcagttcaaaaatcattttaattggtgatgggttgtattggtctacaatatccttagtcgatttactcaaaagagagttattcaatatattcgttttaaacgttgggttataaacgaaatctaccatttgaagatttatacgcggtagaatagtttcgactttagccacatcttcttgtgagtttatagaggtccatttattaagtttcatcataaagtgctctttagatgcgtacgtaataggaactctaattaatttattgcctgtagacaattgacggttaacttggatatttgaaaacaaatcgcccatcattgtgatatatcgcctgaacgacgagttgtaaaaatagccaaacatcatttctcctaaccggtctttcgaccggtgtttgctttatcttatctatttattaattcataaacccgtcgtcaaacggtgaattttgtctaccacggttgttaactactacatacggctcaacgtattcacttgcctctgaattgatttgctcaacttcagaatattcatcgatattaatgtcatggataccgtcaagatttctaacagggttaagttccaagtcactaaattcaggtatattgataccttcatttttctgaagcaccggattgatttcttcgccagagtaaataaacttgcctgcagtaattttacgaatcgcatttttacctacttgatagaatgggtcatacggttcaacccagttaatctcaaacaaactgttatccattgggaagtatattaaatcaccttccttgggctcctgattgttgacctggtgtttgaaaagacccgggttaatagataatgtaacttcgtcttgaacttgcattccgaagttgctgaagaacgatttcgctccttcataaccttcaaaagagttcagatatgcagcaaatttccatgctttagtaaatttatttttaaggtcctcaccaaagataaggtccacggcaacatattcacgtggaacataaaaacattcaataccgcgcatctgtatgctttctgccactagaacatcggctaatgtctgactgttctcatagttattaaaattgacaaatggattgaggatttcggtctcatttgtctgagaatacccaccacgattttctagcttggcgaaaagatttttatcataagttgccatattaacctaccaaaatacctgcaggagggtccagtaaatataactcttctcgtaaagcttctttctctaaacgagcttcttcaattaatcgaacaccatcaacagtgacgccacccggtaacatcataccttgatgtttagcaagaatttgcccattaagctctttagctaatgcagttgcataatctttaacccagcggttgttatatgcgccttgtttagttgcaggatcttcaccaactcgacgtccgaccaaattatggtctggattatcataacgttcagaaatagaccatgaatcacgaggacctacctgaccataccctactgtatttcctaccatcttatgggtctcgatataagagcgaacatacgattcaacgataatgacatctttctgtctaaagttacccattacttttaattgctcgtttgcagagttaaaccaaaaatctggaagaggagcaatcatatcttgaagcatacccatataagatactaattgagaataatacccgagatcagcgccaaaagcgttagggccgtagaatttaccacaattactacccataccacctgaaacacctgccattcctaaaaggaaatcagtgaaccatggataagttgcattaccatccattgaagtaatagagccaacatttgttcttataattcttgttacagcaaatacattagaaccacgcatatcaaatacgccgtgacggtatttttcttcgtcatcaacaaaaaatacatggaaacctttattcaacccgtcaaaatggtattcgccgtaaagttctaacgctcgtgaaatacaatcataaatttggtctgtagttaattcaacatttacaataggagcgcctaaacgacgtaatattacgtcctttaattctttagggttttgtgcattataacctgacatataaatcctttagggcccgaaggcccttttcattaagctgtaggaagttcaacccatgcaccatctttgcgaacatagaatttaccgtctgaaggagcatcttcaatatatccagcgtccttaagagtttggatttcagcttctgcagcggccaaatcagtttcaagagtagcaattctagaagttaaactattaattgtcgtatcgtgacttttaactgtaggcaatataccgcgttcttcaacagtcgaaccatttgggttggtgccatttataagagtatttaatgtgtttacagaacccttaattcctgtggtattagtcccaacatcagtttgaatgttctgaatgtcattactcatcccactgatagttccttcaagctctcgagtacgataaagcaaagagccggctggttccggtttcccacctgaagcgtcaacaccaactacgttatttaaccatgacacattaaaacgcaatcctgacgaagaatcagagccgacaacagtgttcaatgctccgatagcatcagtattgagtttaatacgaccttggattgtagtgggcaaatcatcggcgccaatggcagtttctactgtagtcaaacgaggtttaataccacctgattgattgagctcaagattaatgtcatttattgctgaactatttgcattagttgtagtaataatagaagtcgtattaggatacccaatagactgtttaatgccgtccaagtcagcattttgacgcgacaaagttaaatcaatactggaaagacgactaaacactggggtagtgaaagaagtacgaggtcccatttcttcgcgcaagcgttcgacttcaatagttaaagagccaacatcagaatcagcaaatttagtttctaaatcagttaatcgaacgccgtggtcaacaattacggagctattagtcataatacggcgtttcataccagtgctatcatttcctggagtaggaaccccattaatatcttgacctgtatattgccctaattcatttttaatccaaagcaggtcattacgaaccgttctataaactgaatctgtttcctgattataaacaccaatatcatcagtattcgcatcaatatgttcattcaaatcattcaattcactggcatgggtttgaactgtgactttaatgacatcgatatcttgggtgttctggcctatctgtgcaagagcatcaacatccccagaaacatctaaaataccttgaataactttgatatcttcattggccgtattcaaagaagatgctatagttttaatattaacatctaacgcttctacgttacgttgaacttcaacaataggacggttcattacaccttcagaaccgtattttgtgtcagcacctgttatttcttcatcgtttttaatccattcaatacgactctgacccgcgtctggcgggccgtcaacatatggtaaatctaccagagatatatcagccattattttaccttaatgatatagtttaaagaaatgttccatgggcgtgtttcatttccaattaattcaggacgatttaatgtatatttggaatttcgttgtgatgccgggtcaatttcatatccgtcattggtgaagtatgaacggttatcccagtcaagtcctttacgtgtaccaacaaaatttgatctacgggtattaccgaatgctccagaatcatcatgctcaccaaatccgccagcgtgtttatgataagacatctgttgtttctgtacttcaccaacatatccaccagtacaacctacacctaatctaggcttaccaaactggtcattaccattaacatttggatttgttaagtgagagccacgacctgagccacgaacaaataatccacgcatatcaggcaagcctgggttagaagaactaccaccatatcgggtcccaattctggaagcatataccggacattctgaagcagaaacggtcccaccatgacagaagcgccagtcagaactcggtaaactatctgcagcccacattgtaatagcgccaactggaagaattcggtctaattcattttgagtcacaatacgattgccttgaatataaccaccggacatattgacattgcccgttatattagcgccaccagaaccaaccgtcaacgtattattaatgcgaagtgtgccattaatagtttgtccgcctcgttggtggataacatcagcattccaagcaagggcagaagaaccatcaccgcctgattggctacccgcttgtgtagttaaacgaacaactccacgtaaagaagttgtagccccacgcccgtttaatgttgcgccggtcactacagctgaagagttgttactatttacttcagtctgtgtccctagtttaacgacacctttattagtttctgatgctactgaattcataaaggtataaggtgaaattgcatagccttcacgcagggtgccttgttgtgcttgagcaactgtagccaaacgaacaacaccggtaatagattcggtggcgtcactattatttggagcaatttgtgaaataagtttaattgctaattgttgcgtttttaacggagtcattgccgttgtatcgtcagaaccagctaatgccgcagcagaagttgaaattttaattacaccatttgttgcttctgttgacacttttgtctgaaatacattgtctattttttgattcaatttaagcggagtaattgatgcatcgtcaatagttccggttactgcttcatcttcagtagcataacgagttaagccatattgagtttcggttgcattaggatattgtagacgagcattcagtgatgccggagtaacagctttattattatctaatccatcaataacttcttgtggagtagctatttgaataattcctggtgtagtagttgttgcttccggtacaccattaacacctgaaggagaaatagcagctaatgcggcttggacattagtgactgtatctggaaaattcgtccccgtagggtcgaattcaacgtaaatggattcgtttgaaacgtgttggtatgtattgttattactcatgaggctctcacaaagtggtagaaaacggtaggagtatcatggttatcaagagtaaccgtttgggcacccaataaattccatgttccgtatccggattttgcttcagacaaaatttcttgcgaaattgttacaccaaacgaagcatatgttggcaacacatgacgttggttatctaaatatgtcacctgaagtttattaccttcagttggatggtctttataagaagaaatagcgatttgattagcaatggcctcttgtaaagctatacgaacttgtgccgttaattcgttatcagtcataccgattgttgctttaacggcaagtccaaatacgttaataacgactggcgttccagtgtccaaagtatcgtcgagaacatcaccggaaaaagtccaataatcaacttgtgctgcaccttcaggcgatacgcctgaagtgtttgtgacaacagtaccaatatcagctcgtgccatattatggacatcatttattgcagattctacgttagcatcataaaaaccgcgagctaactgagaaatagtcacggaacctacagcttggttgtttaaaacatcaatttgagctggattttttctgtaattcaaaaaatcagcatgacgggaaataactcccgcctttgtattaagtacagtcattatgcaatccttacccaacggtatacagttatagatggctgaatattagttatagaacgtgctggaacatgagatccattagtctttgcatggtcttcacgatatttagtgtaaataggaccttctgcatccgggtcatattgacaaccgcctataattactgtaccattatcatcagaaataagaaccttttcatcggtttgtgtagctggtaaatcagcattttctaatgtgatagttgttacaccaacggtaccacctgcggtatgagtagggttaccattgatgtcaaggtcattattatttaatgcaaaattaggatctgacgcgtcgtcattccaaccggctaatactttgccttgtccccaaattttccacgaaccaaaacctaaataagtggccggattattagggttaaccgcattttcgtaaatagtcccgacaggataaattgtatcaaatattgctgagatagtcgagaattcacgttcatacttaggaacaggttctacattaggccatccaattttatcgaaatcggttaatgcaacgtcaccagtaatttcaatgttagacccttgagaaacatatttctcatcagcgacatcaaggatttcttccatttcaagaagagttcctaaatcgttattaaaccatgtgatggtaataatgtcttggtcttcaaattgacggtcaaacagaattgcgctagggatattatcagtatattcgatcgcataatctgtatacgattgagtccatgtcccgccgagattagcgcatgactcttcagaatcagcatccacaccttcacaacggaaaataggagttccaacagtaccagctaattcttggagaataccattgaagcgaacttctaatgaattcgggttaggtggttctgtaggattaataccaaatgctgtaaatggaatagaccggaacgtactcaaatcagtgacgtaaatacttccatcaatagactttttagcagtcaatttactatctaaaatgcgaacttggcgacgagtatatgaactacgccactgagaaacaccatctaggaatgtctcaatttgtacagtgtccccaacattacatggttggcgtaatctaatattaaatccatcaagtgcaaccagttcacctggattatcgcctggagaaccaaaatcactattatcactgaacacgtcaccataatacaattcgttgccacgatgttttacgcgaatgttgttaacgttataagaggtcccgttaaaaacatccatgaaatcggtctgaccttgggtttcaaccagatattctctacgagcaacattactaatgtcagagctaactattttatcaatttgtttgttcttgatgtattcccaacgtccaggagcacaataaactaattctaaatcagagaactgaacgttaatttctactggagatgaagaacctttaatcgtgtctccgtttgccggaattaaagtaacagggttaatgttccaagttgcaaatacgtcacgagcacgaataactttattatagtctgcaattgtccctttaggaagatttaccgaaactcgtccagaagtagtattaattgcataagatttaccccaagcagccttaagattaagaccatcagccgcatcataagtcttccatgcgccagcggcataaggaacttcaccatcacctaattcataatagatttcgtcgaagttctcatttattttttcgccacctcgacgaaggtaatcgccttgtccgtcatcaacgacgttaccaattttaatattttgtttcattattgagcgaccccaattttctgtgttgagataattttaactgctgaacgtaatccaataatatcggatgtaatcgtcatagtagcaaagttgttaataatactaaagctaatattagcaatctcgtctgtttcatctacgttaccaactcgcattactgcaaattcggtagaaagaacttctgagttaattgtatctattagaatatttatttcgcatgtttttatttttctaccgtcggcggattggcatgtaacaagcaatttagccatattataatctgtgcgataaaacagaggaatagaaactgtgtttcctgtaagactccaagtcccatcgacaggagattctttctgcccaaacatgctatcagtagaataattccataccgaagttggcccattaagttcaatacaacgaagaacaacatgggtataaggggtggaaataacaagattattaagaacacctttaattgaaccatcagttacttggatacttaaaggattgttaacagaaatagacccattagagtttatgaattctacagagtcacctaattcaggacggtcaataataacaatcacaccaccatcagaagcatcaatatcatgcatagtgcctggtttaataggagtttgataatcggctgcctttcctttttgataataacctgtggcatgaatagtttgacctgtaggtccggttccatctgctacagccattttacgttgatcgccaaatgcattgtaaatagcgttgatatcgtcatttattttattaccaccgtcgaataagatatcacctgttgaggcattaccaatttcgccggtatcgattaattgtttaggagtttgcttaaaaaatgccataattctgccttttgttgtccgatattatattctatttatagatacaaaaatgggagcccgaaggctccctaattaaaacataaacaaaatgttaatttcttctgtttggtccattgccataataacaggtgggcggttttccatataaatcatttcaccagaatgacgttgtaggtctctagggtcgtaataatccttttctgctttaacattagggtcatttggatttttcttagcttctaatgggtttgtgataattgatatctgtctaaaccccttgttaccaggcaaagctgcctcagggaaataaacggaatcaaaatatgctttaaagcgcatcgtattagctttaacacggtaaatcaagccgtagtcatcttgttgccaagttaagttattttcatatccccaacgggtggggtcttctttaatttcttccggccatggaactacaagatattcgttagtgcaacggttaattgacacatcggcaggaatctcataaagatattcccaaatatatccatcaccggtttcgataaccccattagcatcgcctctgccttcaggaggagacatagaacgaacagacggggtccatttaccacctaatttaagacattcatctttattatctaaagattctattgaacagagccctacgtcagggacatctaaacaacggtaaattaaccaaccagctccaacttctgtcgcgttgtacggagcagtattacatgcgactatatcgttaattctaaacgtgtaagggtctggatatcgcacatctccccaatcacgtctaggaataacagaatctaacattgaaggtaaaactttaacggtgcccatcatatgggtccacatatcagtaacaccaagaacagaatctgtaggataaggtggggcgaagcccacctcattttcatttgacgcccaaggttctgaacgtccaaacgtaatataaatggagttcttatcatctccatcaccaactgaattataaaaattcagcattttctctgttctaaattttgatgtaactattgcacgatagataacacttgaatcattcatctaatttaacctgtggtggattcacggggtctcttggatttcctacattatcgattaaccgttgttcaaccaaatctctaaatctagagaatgttgttccggacgcatcaaataatgggctcatcagtttacgacgttccgatggaagttgaccttgaaatatggagttattgttttcagcgttataatcttcaggcaatggataatcttgaccagccatagggcctatttcatatatcgctttacctgtaatagggtcaaactcaacatttccttgtgggtctaatttagccactcggtctgcatatttagtcggtaatccagaatcccacttatagtttttatatttattaataatggtttcaacatgtttaagtgttaatccggtgttaataaacattgtgagaagggtaattgcgataaatccaaatccaaccggatgaacaaaacgtaatacgtctgatttccaacgagatgatggaagtttagatttaatcttcattacgtagtatgctctaccacgatttatgtaatcgatgttgttctgagaaagctctttacctttaataccacgaacaatttcaccttcaaaaccagggagtctttcagctttaacttcctgtccttggattaaacgacctaagaggttgtgaattgttacagtccattgtaatttacctttagagtaacttctctcgatatacgtcacattacaacgtcctgtagcggtgtatatggtttgtccgaccaaatcttctgtcaaagaatcagattcaatgatgatatcatattcggtcccggaactagattcaatttcaatttcaacatcttcgttataaagcactttaaacaagaatttatatgatgcttcagttcctttagttgaatagaagtcataacttcttgattcaaagaaacgagacactaaatcacgtttttcagcgtttaagtaaatgtttcgtttataaatctctgaccataaatattcccacgcatgttcttcgcgtggatattgatttttaataagatttaaaaggttgttataatgtgtcccatagccatcagaaagatactgaatataagcctcgcagaatgcttcgaagtttgtattatctaaaagataagactccggcatcattgtagtgagcaatggtcgtaaatctgggtccgcgataccattctcttccacaggagtccatgtggtatctttttcttggttttgtaacgatgctgttaagaatatattagtaggcttccaaattatagaaacattatctctaacacgataactaaaatcataataagaaataatctcacccgatgctttatagaaaatcatgccagatgcatattttttaaatccggtgaaatctacgttaggcatcactattgtacagtcaccgtcattccaatattcatgaacttcacggtctgaagaactaagtggatgattctcaataaccttagtgtaaagtaaatcagaataaattacaacggccttgtctgagttattaatccaacaacgagtaccagactttctagaataactaaagaacggctcagcatagtattccatcggttgaggagtgaacgattcccattgagagtcttcagttgaaataaatgccatcatatgataatgtttatcagccaaccattctcgaggatactcatatttaacagcaccgattaaaccgtacttgacttgtgtttttgggtcatcaacaatatctgattctaaaaatttaaaattactagatgaaatagataactcaacaccatcagtagacatactggtgtacccaggttcaatacgacggcgttcttcttcagtattaccaaacacacgtttaaatgtgccagcatcatggtctagaacgtaaacacccttatcagcggaatcaacaataggagtggtcctcgggtcgtcgttaagattaacaacttcaccgataatcagtgcaaatattttaccaccgacagaatccattttatagcaaactgctttagggttacctgtgatgttaaatgtttcttgttcaaacaaacgttcggaatatgtcggagataacgggtctgaatcaataggggcattactagttttaataaaacgaactttatctcgagcagcaacatatacataatcgtcattgcaaacgatagcttctgcaatacgtgatacgttagcaggtaatgatgcatagttaccaaatatttctacatcaaatcctaaatttaactggtcgccaattttagcaaatgttatatcttgagaactaaatctcacatcatcagcagaccaacgaacgtctgttgatttacgaccgtaaaataatttatcgtacccaagaacatacgtggtgtaatctgtctggtaatacaccgttcttgatacagggtaccctacacggtcattaaacaatttaaccgatttccaggtttgtcccttatcgttagagactttaaccacaggctgataccgttcaaacaaataaagaattccttcggattccatcaaataaacacggtttatatcatgacacacctgttgaatcgaaccttgaatttcatgatactcattttcaccaataatgaaatttttaatagatgaaatatccgcataggcagggctaaattggaacgattcattcattagagctgccattatagtgtcgttattaaaatcgacataagccatgttgttatttgtaaatttttctctaataaaagtgttagccaattgcatttcaatcatatgttgaaatgtatacgcgttagtctgaaatgattcaaatatttcggtatatacccaatcagatctctcaaagccttcggcggcagttgatacacgaataatataagaagttaatgggtctaagctattttcgaaccagttgctattaggagtatatcctaaatttatccatctgtagctggcagggggaattattccaccgtctgccgttttagtctcagcgatttctacgaaatagtagaaattagcaccaacgtcatcccagcgtatttgaacttggttagcggacaacttggatattctgagacttgtgactgctggcgcttttactgtcattgtgaaataggctccaaatctatagttaagtactgaggacgcaagtcattttcgaatacgattaaagaaccatcctttgtaaaaataatatcatctgcagggtcggaataaagttcaattgtttgaacttcaaaacggtctgaagtgaggtcaattttagcaatgttccaataaatcgaatcggcaggataattcacttcgccaattgaatagtatttgtttcgtccgtcagtaacagtaagtttattaaaatcattacctgtataaggttgtatattttcgttttcaacaacatccccgtctgcaaatggtccaataataacttgacctatgccacggtcattacggtcagaagatactatgcgaacaccatatttaatagtttcgtttgcattttctggattaggtctgtgcgaatcaaacgagaatatattagattccatcgatctatctttaatctgattattgtatttaataccggcctcaggcgttttatagaagttttgtacttcgcgaaccatttgaatagtagctgaagaaccaataatagaaatatctgcatcatcgacataagttagcattttagattttgcaaacgacgagttaaaaatttctacatcttcaatataataacggtcaattttattaataatttgcccttcaaggtattgctctgattcttgaagcttattcaaagcatatgtaactttgatattcattttgataaacaaataatcaggcgaaataacaacaggtgtaatagtccctaagttataatcattcaaatagtttttgatatcatcacgttggacagaagtcaaatacaatccagatttaggcttagccgcaatatatgcgtaccctggtttagatgaatctgtaaatgtttgaaccgcttgaataatagaaccaaaccgctcagagacgaatgtgtcataatcggaagcggttacacaacgttgttgagtttcgcgtttaattgtgcctaattcgcggatacgttcaatatcttcagggtcaccaccaccgtcagccccaacaaagtctgggttattgctagggttctcgttaatatcgattaccgtgatattagctaatgtatcagcataagaaaatcctacagcaccgttagcatctgcgccattagtagaaatatactcaattacgattttagaaccctgaacaggtttaaggccaccaatatagttagatgttaacgcgccttctgatgtgttaatagagatttcgccttcaccaaaataaaattcggtgttcccatcaaccgtttcacgcatataatagattgttgacgtagaaccagcgtgaaccatcgacttacgagtccagttaatccattctgctccgtcaacatacaacttaaccaaattacggtcaatattcttatcacgaataatgataggttttaatttatcaaaggttaattcagtgcgaacaatacgtccttgagctaatcgaagacgtggaaaatattggttatttttgtctttaactacaatgacatcttcagtagaaacaaagttatacgggttaacagaagtatctttagcgtatgctaagaaacgagtgccacgtggaatggtgatatagtttctatttaacgcatccgtacatgtgagcataatttctgtttgtgctgctgatttagatgaaggcagatatccattatcttgagccgcttgtacaacagaactacgcaagtttgcagtacgcataaaactttcatacactgcactattactgaactgttggatgtaaagagtgttatatgctaaaaggtcgcacaatacgtttaagcgtgaaccttcaaaatcataatcaagaaattcattctgtccatggagccattcgataatgttttgtttgatttcggcaaatgtgcccccgataaaaatctcgggaatagcattcgctgttcgggttaattgataatttacaggagtgtttgccattttaattcctattttataaagacttttgacgaggcctgagaaacagtatccccgcatgaaattgggtcagccatttgaacggcctttttaccggtgacgtatactttagatgtacgaggttcagtaacacctccatgagtctcgtatggttttttaatttctgtatgaggtgttatttggtctcctgctacaagaacaggaataccaccggtgaacactttagattgggaagcatttattacagtaggaggccatgcttcatgacctgttgtaacgcacttgtcgtaacttaagccagacattttcacggcctcacataaacatagtttcgtaattgatgagcccatttgctccaatttcctactatagtttttgtataaaccttagtaagagttttttgtactggagccggtggaggttctgtaccagagtcacttctagaaccgcctgatgaactttcttcttggtagttataaatcatttcaaccgtataactaaacactttacgaagattctgaggagctctccacaaatataactgtgttgattcatcttttggtaaatcatcccatgaagatgcggtttcaaaatcatcatttaatcggtatttcaatgcatccgaagaaaagctaaacacactttcatatgtcccatataaacgattaccatctaccgtaatgccttgtgtcggttcataatctgttatatttattgacactaaagtttcggttgtttctaactgtggagtaaaaaggacgtcaatagacgccccttccatgtcttctcctaagtcggtatttaaaggaagtatttgtgccatatgttacccaatatcaatacgagatccgtcaacagtgtattgtcctgaagctactgagctcattgtagacattgtttctgcccaatcccctgcaacagtcatatcaacattaccattaacagtccatttaacgtttccgttgacggtgtaatcatggttcccttcaacctgagttttagcatcacctttaacaagaatatctgcatttccgtcaacaactattttgatattccccttaacgtaaagagttccatcgccttcaacagttttagattggttaccacgaataaagattgtgtcattgccgtctatttgatggaggcggtctgccatgttataatatatttcattagcgccaacgttaacaagcttatcgccagaaatcaagaagttcccatcaccattagtgatgtcaaaaaggtcttctacagttttacgagtacgacgcccagatggagaaacttcctcatatgaccctgttggatgaactaagcgataacgttcattacctggagtatcgtcaaattcttggatatgaccactttctgtttccatagcatgaacatatgggtactcgccacgataacttgattccggttctttaaaaaggatgcgtgaatctaatggaacaggaggaccagctgggtcttctggatcggtatttctagtaactaaatcggcaccaactcccggtgaaggcggtgttttaacaggaacaccgtatgattccatgttacctgttaaaataattgttgttacacgtgaagcacgccctttagtctgttggaaccataatgaatcgcgtccagatttgtatgcagttttccaatcacctgcggccattgctttaagcatagtattgaattttgctacaccaccaacgcccatttggaagcacatgttttctaatgccatttggcgagatcggttcattttagcataaacaggacctactttagaattagaacgaatgtctttctgcatcttagcaaggtccttctcaaataacgctgttgcttcttctaatgtaatagttcccggatttcctgttacttcacgccctacttgatcggataacaatttattaattcgagacatgtctcgggtcttttccattacgataaggtgtccaatacctactgtaggataccctagatggtcccaatacactttatcacgaagaccttcgtcacgacgtaacatttctgttattgtaaaattagggtcatcatcttccggaatatttgctaaatctgtatcatccgggtttataccataatccaagttgttatcttgaattacgttagagttcgaataataaccagcttcaccaccttggtttaatacgttcgtatcattacctaaacgtcgtggatattgacctgtcgggtctgaaaaaccttcaagtctattaggcttttcgcgtacaattccaccgtatgtaccgagtacaataccgtttgttttccatttgtctaagaaatgaccatatactcgagttccttcaacaggacctgtaacagaaccaccaatacctgacattgacgcagacgtaataggttgaataacagtcatccatggaagtttttctgtaggaataccttgtacatcaccttgtgccctctgtgccggatgaagaccaacgactcgaactcgaactcgcccttgttttaatgggtccattctgtcctcgacaacacccacgaaccaattaaggctactgctaatcatttccattatgcaatctccatctcacgaatcaaatctgtgataaacgagtttatatcttcttttgcaacaatttttattttacgaagtttttcattatctaatactgccgcttcataagtatctactgcagctaaaggtcctttatattgcggatacttacgagcttcatcacctttatcgtaccacactaaaggctcgtctggatatgaaaccaaattgtaaaatttctcacgattttcattaatatggtaaagaacttggtcaccgccggcatttgcatatttctgaatagaagcttgatacgctgcttcctgagatgtaatccagccataatacggatcatagttatcattacacatcaaaagaacccagtataattgagggtttccataaattatgtttgctagttcttcaggacgtggagagcctttaatataataagaacgtaatctataattggcagccacacgcttaaagtactctttatagttacgaaatatgtctgtcataggaatagtaggtgcattcttattaactgttttagcactatatcctattgggtcgaagaatgtaaataacaagatagtctccttccaatatgaaattggtataaataataatactatttataaggaggacaacatggcctactctggtaaatgggtcccaaaaaatttaaaaaaataccgtggagaccataccaaaataacgtatcgttcaaactgggaaaaattctttttcgaatggttggataaaaatccagaaattattgcatggggcagcgaaacggcagtaattccatatttctgtaatgcagaaggtaagaaacgtcgatactatatggacatatggatgaaagatgcatcaggtcaagagttctttgtagaaataaaaccaaagaaagaaactcaaccacctattaagcccgtaaatcttacgactgcagcaaagaaacgttatatgaatgaaatatatacctggtctgtgaactgtgacaaatggaaagctgcctcagctgttgctgaaaagagaaatataaaatttcgagttctaaccgaagacggacttaggaaactcggatacaaggggtaattatgagcatattccaaattatatctgaaggcgtacaagcccctaagattgctcagtctatgaatgaaagaaaatggattgagataggattagaatacaagaaagctaaagagaaaggaatcactgcaaaagcatttgcagaatcaaaaggaataaaatactcgtcgtttacatctgcaatgtctagatatgcatcatctattaagactgcacagaaaattgaaacgcttgaatctaaacctaaaaataaactcaataagcaagaacgtcaacttctgatgataaactcgtttcgcagttcaatacgagaaaagattagaaatgaaggcgcagcagtaaacaacaaatcatctaagtggtttgttgaaacaattaagaaaagtgtaaaaggtcataaagtagtcaagcctacgccaggcaaaatttatacttacgtttatgatgctaaacataaagatactctgccatactgggaccgatatcctttaattatttatttaggattaggtaaacataatttgatgtatgggttaaacttgcactatatcccacctaaagcacgacaacagtttcttgaagaattgctgaagcaatatgctagcacaactactattactaataacacaaagttgaagatagattggagtaaggtgaaaggatttcaaggtgctgacaaaatgattaaagcatacctgccaggccacattagaggaacaataacagaaatagctcctaaagactgggctaacataatcatgttacctactcagcagtttatgtcaaaaggaaaacgtttctctgcaaatactgtttggaaatcttaattctattctcttccgttcttctgatattctgttgaaccagattaatggaagagacctaaaaccattatactgcatttttattaaagcgtttttgaggtgcttatgactcgtccagcgagacagatttttaaccaaacaaatataacaaactttgttgtggatatcccagatagtacacgaacttcaggttttgtgctcaatgcccaaacagctccattgccaggtgtgagaattcctgttgttgaaactgtgacaggcacaatggggttaggacgtgcaatgcgtgcaggcaccacatttgaatatgacccttttattgtacgatttatagttgatgaagacatgacgtcctggatgaacatgtataaatggatgctcagcactaataactatataaccgggcataatactgcacactctgatggtcctgagtttgttactttgcacattttaaacaacaataagaccgaagtagttttgacggcaaatttctataaaccatggatttctgatttgagtgaaattgaatttagttacactgaagactctgaccctgccgttacttgcgtagcaactattcattacgcgtatatgacgatagaaaaagatggcgaagtcattgtatctcaacaaccacgtcaagcggtcgaatctaaatccatttctagacacccttctttgcgttaatcgcttctagctccgtatgttataatcactcataaattatatgaggaaaacttatggagctaatctttttaagcggcatcaaacgtagtggtaaagacaccactgctgattacatcaattcaaactttaaatccgtaaaataccaattggcatatccaattaaagacgctctagcaatagcctggggacgtaggcatgctgaaaaccctgatgtattcaccgagttgaaatatgaatactttgaaggtgttggatacgaccgtgaaacaccattaaatctcaataagttggatgttattgaattattggaagaagcgctaatttatttgcaaagtcaatatttaccaattaataatgttaaagtattatcatcgttagaaggtggatattcgtatctagatattaaaccatatgaagccctgcgtgaagctataaataatatcaacgacacatggtcaatccgccgtcttatgcaagccctcggtacggatgttgtcgttaatttatttgaccgtatgtattgggttaaactttttgcattaaactatatggattatattggaagcgatttcgattactatgtcgtaaccgatacacgccaagtccatgaaatggaaaccgctagagcgatgggtgctacagttattcatgtggttcgctctggtacggaatccaccgataaacatattacagaagctgggttgcctattgaagaaggcgatttagttattacaaacgacggctctttagaagagctttattctaaaattgaaacaatcttaaggtaataaaatgtctactgaaactatcgaaaaactgcagtctgaaatcgttactctgaaatcccgcattcttgatactcaagaccaagcagctgctattcagcaagaatctcagcaacttggtagtgctcttgctaaaatcgctaatctggttggtatcactggcgaatcagttaagattgatgacctggtagaagcagtacgtgaacttgttaaagctgaaaccacagaagaagaataatgaaatttgaggacttttcacaaggcctctacgtcgcagctaagttttcagaattaacacttgatgcgctggaagacctccagcgcaaattaagaattcctaatccagtaccacgtgaaaagcttcattcaacaatttgttattcacgtgtaaacataccatatactacgtctagtggtagttattctattgccgaatcaggacactttgaggtatggaaaactgacgacggcgctgtactggttttagttcttgattccgaatatcttagatgtcgtcatcagtatgcacgagctttaggtgctactcatgatttcgacgactacactccacatataacgttatcatataacgttggccaactatcattcagtggtgatgtagctattccggttattctcgaccgtgaatacaaagaacccttaaaactagattgggccgaagatctaaaataattttcacaaaacagtttacataaggatggtggtgtgttactatcatcctatcaaataaacagcctcaaggaaataaaatgaaaacctataaagaatttatatcacctgttgctaacgtttctactctgaccgaagcatcccttacttctgaagttattaaaacaaataaaggacgtgagggtaaaccaatgattagtctggttgacggtgaagaagtaaaaggtactgtttacttaggagacgggtggtccgctaagaaagacggcgctactattgttatctctcctgctgaagagactgcactgtttaaagctaagcacatttctgtagctcagcttaaaattattgcaaaaactcttctgtaagtagtttacatgctgataggactatgttatagtagtcctatcaaatcaaacgagtaaatggagaaataaaatgaaacgcgctgaactgattcgtaatgttgctgtagtaattgcttcaatggcttttagtttttcgatgtttgtaggattcatttgtggactactgacaacaacagaaaattctatctcattggtagtagcatttctaatcggcttaatcgctatcgttatggataaaattgcaaaaggtgagtaaaatgaaatatcacgtatatgctgattttgaagcaaatccttctaaagacccggattgtcgtttattccgtaatccgtttgattcagcagctcaagcatgggcctggattaaaacttgtactccttcttacactttctttgaagtggtagacgataacggagttctgcatccagaacctacagaaactattaatttccttctgtttgctggttacgactgttatcctcttggtggtattgacgaccttgttgctacaggaaaaactgttgaggttcttcgcgaaatttataaaaacgcagaagaaaattttgactggtatcatattgttgatgctcatacctttgaaatggtggaacattcatgattctttatgctaaggtaaaatccgttgagaatggatatgaaagcgaccgagctgcagctaaagcactagtcgattactatggtattttgacccactttgaagttgaaaaggtttacgtcgaccgttcatcttcacaggttaaattactttgggaagaccgcaaatttaatagtgtgaactttgatttctttattgaaacagaaaaaggtcctcttgaatatgatattttcaagaatcctttgaaattacgttgcattgaatataattacattaatatggtacggtgattaaatgaatattcgtttaggcagtacaattcctaagggctacgtaattgatgtcactacctatgaaaatgatggtgacaactataaaaccaaaacattgtttgaagtggaagagcatgagctccaacagtttaaatatctcttgaagaaatttaagagccgtcattctagcaccaaagctgaacgttattgtggtaatacaccattcagtgattgctcgcttttaatctatgaatacttggttgaagggctgttctcagaccagctttatccagaattcattaaaaaggtctttggtattgaagtcgacctcggtaataaatctgaagaagatgaatcacgtgtattcgacctgttctttgtgaaaggcgatgagatatctcaaggtcttattgatattcttggctatgcttctgaatactatgattacgatttcttgcgtgtagttgaacgtgtcgaatttgcttatattgaagaagaaatcgttttgccaaccgttaaaatggttgatttgctttaagaattatgtgttattattaattcataccctctattaccaaaggtgctctaaagtgcctttcataatagaaagttatttaggccctgtagctcaacggttagcagcagtcccctcataagggaaaggttaccagttcgaatctggtctgggtcatatattcgaggcatagctcaattgtatagagcaacggacttctaatccgtaggttgaaggttagaatccttctgtctcgaccaactttaagtgaggaaaatatgaaaggcaatgtttatctggtagttcatgatttaacgttttattttaacgaacgtgaaacagttatttccgataggttaattaattcgctgtatcagcatgccgattacgtctatgttcaaaatgaatttggtcattggaagttccttaaaaaccgttctgggataactagttttgaatactttgaccgtaaagaccttttaaacgaaatcccattgcaacatcgattccagaaacgcgaatcattatattattgccgtcatatatcaaacgccgaatgtgttgatgaagtaattaatctatggcgtagacgtagagaacaaattgatgatatgtcaaaataagaagccgggtcgctaccggcaagtcgtcggactgatgttccctgagtaaggactggtcttaataaatctttacgatttgttaatatccccttacatcacagcagaaacggcgcacagaattatcgattcgaggaaatatctttgccgtaagccgagtagcgtttttgacggaacgttcggatatggtcgagatatggccttttaaaaatattgagtagcgtcaactgcttaataaccgggttcgaatcccggcgtttcgtacaaacacttgccttagtaggtggaaaccccgacaaggtatatagccccttccgaaaggttggggcttttttgtataaatatagtaaacaataaacctactttctaaggaccatcaatgtatacttttaatgaatttttagccgaaacggaagtaatcaccgaagccggtgtacgtatgacaaaagagaaatggcaagctgcttacgatgctatttctggtacaaaaactagtacagagtttttcaaaaacgttcaagccatgtacggtatcgacacttccagccaaaaagaatattacagagcttctaaagcattcaaagatattgttagtggtggtgtttctgctaaatctggctcgcctaaagtaaaacctgctcctaccgttcctaaacctgcgacccctaaagcaatagcaaaacctgagcctaagccagaagtaaaagcaactcctaaagctcctgctcttaagtttgatacttctagcctggaaaaaaaatataaacaactatcttcgcttgttcgtgatattgaatccgatacatcttcactcgttcgtgaattcaacagtcttcgtaatggccaacatatcaacaaccttgataccccagacctttatcgtctttatttgactatcgaaggtttgaagtatactcaaccacttcacgatgcgattaaagaaaaacttcgtcaggcaggtcgtttggctgctgacgccgctcagtatgcaaaaacccgtaagtaaagaatggggaccttcgggtccctttagggggtctataacttactgaaaaagttgtttacttcttccctagatgtgttactatagtcctattaaaacatgaggagaatagtatgagtctttacactgaactgaataaaaaatctgaagaatctgctgaaactatttttaaaaacgtgcaaaagcgtattttagaaaagatgtataacactgcagctaaaggtgaaaaatcttgccggttcccgatgaggtgttcttccgatttatgcgcaaatactattgaatggctggaaagtgaaggtcttacggtagagaaaaacccggcgatttctattgacagtgaatcatatattagtatttcttgggataaaccacgtatgaatgaaggatactacaagttgttaagttggaaaaattaaaaataatgatgtacaagcaccaaggatggtgatactatagacttatcaactacagaggagtaaacaaaatgactactttaattatttggttcgatgaaaatgaagaaacatactgtgtgaatattggtgaaagtccaatgcctgaatttgaatcctcagataaaaactctgttgtatcttgggctgaaggttataaagccgctaaaggtgacgttgaaataatttacatctaagtaagtttatgttatagtaatcacatcaaatcaagaggaaaacaaaatggctaaagttagtattgatgtcgttgattatgaatataccgaagaagttattcgcaaccgtcaccctgaagttcgtatcgattcagtccaagattccaagttctggacaactgagcttaatctgagtggtccttatgaagctgttaagaagttcatggttgaagaatactgcgaaggcatgcaccctgaagatgcagaattttatgtcaacttgattaaaaaataatgtacaaacgccaaggatggtgatatgattactccaccaacaaatgaggaaaacaaaatgtttaagtctgatatcgaacaagctaaagaaatcgccgcagaatactttggttcattcttacgtctttttggagaaattcctgaatttaattctgcatcagaatctgcggaagctttaaaggccattgaaaatattattttggaagaccttaaatctttcgacggttctaatctttcggcacttcctcgtataatcgatatccatgttctggataaaatggaagagattattaattcgtacaaataagtgtacaaactcttgagagatgagtataattctctcgttggataataaaccaccaattgaaaggtaataatatgaacacactgaagaaacttgttgaattcatccgcactaaactgggtactgctatggctaaaaatctgactgtcgaagaacagtataacgcagctgcagataagttgattacccaaatcaaagaactaaaaacggcttctgttaaatctattaatgaagaaaaacgtattcgcgaacttgttattgaaaagaataagcaagccgcttctaaggaacgtgaaattcgtaagctcctggctgaaggacaagatgttaccatgcatgctaagcttggtcttctgtatcgtcgaactgccgaacaacttaatacaaaagctgacgggtatgccgctatgcgaattgaaattgctcgtaaggtggttgaacttgatgatgctcgtcagaatctggcaatcaaactcgaatacattcgtgaaactcgagcagccaatgcccttggtatctctacggccgatgatgtaattgaaatcgctgcactgactaaggttgatatcgaagacactctgactcgtgttgaaacgttcaatggtactccagccggtgtcgaaaccacttctgctgatgtacaagaatatattaactctttgaaataaaataatacggaggactccggtcctccttttggataataaaggagttaacatgcgaaaccaaaataatgatattgactcaatgttcgaagagttccgagataaggtaaatccacctacgtctttagttgattcattacgatatgttgcaactggacgtaaatggtactggtcagcttcttatgagacaactgaatacgcaaatcgccgaaaatctttattagccccaggtattatgattcatgatatcggagctattgctaaactagttgcagaccatgatattagattcactgatttcgttgctcctacgtggtctgtttgttgtttaaacactgaatgggaatatatcagtggacgttcagaagattattacggttttagagataagcttctgaggtctaatatgttttatattgacacagaagttctagtcgataataaaaaatattactttacgttaatcatcgattctgaaactatgtatgaaggcaagcctttgcttaaaagagttgatgctttaagtgctattgatgcgctttatgaaactatggttgttagtcctaatttcactaacaatttaatccttgagcaatttattatggaatgtagagaatatgtcaaagccaaccctgtacatgccaattaaaccctgggcatacgaatacaaacgtaaattaatcccaaacgaagtactatttggccctattttagctttagcatttttaatctttatgattataggagctattttagattccaataaagttatatcgtctgatgcagtgtttttacttattatagccgggtcgtttattgtgccatttttattaatgcctattaactgggtgggttattggtatcaaggacgtcattatagagctcgagtacgcgaatggaaaattcaatgtgcaaaagcaagagctcaatatgaccaggctgttaaaaaatatgaatatgacgaagccatggaattcgttaaggagataagatgcaaaagcctcaactcttaaccgtatggccttctcttggtgagaatattttaatttttatcatgagcgccggcatgggatttgcctttggattagttggatttcttattgacggcgttgtgttaggatttatagggaacactggtggattcacagaccaatggcaggacttacggtatacccaagcctttgcatccatcgcatccttttgtactgtagtctatttttactacgattttataaaccataacaagaaaaataaaaaggtttacgcttctcaaatgattagttataatgaactcttagctagacgtgaaaatgaaacaatcgaaaactttattaaggaatgtagaaaatgagtaagattattgaaattaaagtaccagagtttaatgatgccaaatccgcttcagatgcaatttataaacttctgaatcaagctgaacgtatcgaagaagaagcaacaaagatcgcagaccaatatgccgtatcattttctgtaggtgattatggtagcggtcgtacttattatcctaagggcgaaatcgtatcccagtggatgaaaaatgaaattgaaaataatggtggtgatgttaagcgtgaaggtaatggttacgttattactgaaggtgcttggatttcgtcttctgcgttgtgctaaggaaacattatgtctaaagaacaaaccgaactggctgaagctgtagcaaaaatatatgcagctattgaggctgccaaagaaattgctgataaacaaaacacaacattcgacttgtatccagcttatggtatgggtggaacctatcattcaccaggacatcttaaagccgatcttgaacgttgtacaaaaaacggttatgctgaatgggctgacgtttatcaatacgactacaacctgagccttgaagatggtggttgggttgcatcttcacacacttgctaaggaaaccatatgtctcgtgaattagattgtgctgtacgtaccgcggtagctgctctagaaaacctgttccaaattgcaacagaagaacgcgaagaagttacattatggattgaagataacgcaggtctgaatctccaggacgcgatctcattatctaataatagcattactgttcaaggctgggtatcgtctagttattcttgctaaaacagtttacaataagataggactatgttatagtagtcctatcaaattaaatggagtccgcaatgatttattacgaaagtatcggaaccaaagtggttggtaaaaccattactcgtgaaaagtttgcaaagatattcgatatgcgttataaaaaatctgaacacaaaggcatccgattcgaagatgcgcactgtacaatttgcccttataatgaagacataaacggtacaatcgttccattggtagaggcttcacatgatgacctctgggatgaatataatatcgcatgtcgtgaaatttaagttaatgaattaatccgaggaaaatattatgatgttagttattggttctcgtgcacttcactatcatggtcttattgattctagcgctatcaaaaatagtgattgggactttattgcggaccaaggttcttggaatgcattcaaaaatcaaatgatgggtgtatatgttcaccaagataaccctgatgtccaagttttcaaatgcttccataatggacgcgaaactcattttgaagcatatattgttccggcaatcactaatgttcgtgaattagtcggtgaactcactcctgaagatttcacatcttcttatgaccttttaaaatacgccaagaaaaatttgactaaagatcgtttgaccgggttttactgggcaactcctgagatatgtcttgcaattaagatgtctcatcgtttcaagaaaaataatccattctttttaaagactatgaaccatattcagtatcttcgtggtaaaggtgttacactgaacgatgaacttactgaaattatgctgaaacgccagaaagaaactttgaactatgctcacccagttcttgacacttctaaaagtgcgttctttaaagatgacatctatacatatgaccatgatactattcacgaagccattgcactaacagaccgtccggcttatacgttttacatgaaagacggttctgaagtcatgacctcacgcgagaagttcgaatcgttaccagaaatgattaagctggccggtgtatacgaagaatcatgtgtactagcattagaacgttctcaaattcctaataactttgaaattaaccctgaagccagtttcatgatggcattagaaaaggtctgtacaagcatcacctccggttggttccgtgaatacgcctgggaaaactacagcaaagtagtaagtatgtaccaacgcttaggacatgacgattacgtcaagcgtttcaaacaaaatttccatatggtaaaacctttcaaataatttcgcaaaaactgtttacacaattataggactatgttatagtagtcctatcaacttgaggagaatattatgaaattaacagaaaccaaccgaattggtcttttaacaatacttgcatcacctttttacgtaactctttctgttgcagtattacaaaaggcttacgatatggatggtgttcctggttttgtattcttatcgccgtttttgctattcgttggagcattgttattatatgccacgactagtttcgaccataatgtctgggtcaattataaatgtaaattgtctgaagaagaacacgcagaagctcgtaaaaaagctattgaatctaccaatctagaaaatttcattaaagaatgtcgaggaaaataatatgaatagttctaaagtgtttaatagtcaagctcgtgcagtaggtggttttgccggtggcatttctaatgataaaatcaagaacgagcctatgttcttcaactgtagtttagaatttgcttataataacggcggccctattactcgcagcttcatcatgaacttgccggatgattggaacaccgaccaagttgtatttgattcacgagtccacatgctgatgcctggttggtatcctgctattcctgggtaccaccatgatgacgtaccacgcccagatattccagttggtcaacactttattactgcaggacaacctgactatgacaaccctcgttaccattctgaacatattcttggtcttgttaacgctgatgtgtgtcctactcattttgcaacaggaactgcagagttcagtcagattcctgatggcgaacttatctatcgccagtggcacaaagaagtcctcgaaaaaatcgaaaaaggcgaactagagaaatgggaagctccagatcgtactcttcttcagtttgattggcaaacatggcacactggttctcgtgcaattagtaatggatggcgttggttcggacgtgtatctcgtaatacagaccgagttaaaaagattaccaatgaaattcgtgtcaatgcccaagtttatctggaattccctatggaaggctggtaatgatacataaaattcactggacaaacatggatgatggcgacgaaggtatttcatattattctatagattggacaggatgtccatcctacttagtgaaacgtcattgtcaagcatttaaaatcgaccagccagcaggtattatcgtgaacagatacattaacggatatcaacctatcgatgaagtaatacgaacaactcaagctgagcttgaaaagtttttcaataagtgccaatggataacaggatggattatatttgtaccgtcagtgtggttttttagtactaaggtgagttctttcggttttgttgatattattgctatcttattagcatctagtatcataagtgttgttggtggcatcattggcggcggtaccgccgccatcattattaatcttattaaaagtagtttacaagaacataaagacaagataaaagccaagaataatgaagttgaacgttttattaccgaatgcaggaatttgagatgagtatagcaatttacattaaatcagaatcatgtgatagttatctgtacacatatgataaagatgtgtcagaagaaaaaatcaaagacgatcttaatatggaccttgatttgttccgtcctattgcagattacaaacttgcggtctctaatagtgaaagtccgtctaaagaaacgcgcattgaagaatttatgtccgaattaatgaccaaatcatgggaccgagatgatgagtaagaaaaataaagtgaaagaactatcagccggtattatcttcatgacaaaagataaagagttattcatgggccgtgtaactggttctcgtcctaaaggtgcattagctcatcggtgggatattcctaaaggccgtgtcgaacccggcgaatctcctattgaagccgctattcgtgaatgcgaagaagaaactgggtttacacaatatgaccctgccttcctgaaagacctaggtgaacataattactcagacaataagaatattcatctgttcctatataccatccctgtagagcacgagcaattcagaaacagtgtttgcaattcctatcatacattcccagacggacaacagattcctgaatttgatgcattcgctttaattaaaccttctcaatgggaatatgtaatgggcaaatcattatataaggtgctcactaccctcctataagtaataaatacctcctataaacgcgggaggtattatgaatatatttgaaatgcttcgtaatgacgaaggtcttagactgtctttatacaaagacactgaaggcttttggacgattggcataggccatttagtaacaaagaacccgtctttagccgtagctaaagctgaacttgacagaatgatcggtcgtaaatgcaacggtacaattacccttgatgaggctgaaaagctatttaatgaagacgttgataaagccgttcgcgggatcttgggtaatgctaaacttaaaccggtatatgattctttagatgcggttcgtcgatgtgcattgatcaatatggtcttccaaatgggcgtagcaggcgtcgccggttttactaattctcttcgtatgcttcaacagaaacgttgggatgaagcggcagtaaatctagcccaatctaaatggtatcgtcagacacctaatcgcgcgaaacgcgtaatctcaacatttaaaacaggaacttggaaagcgtatatatgaaaacatatagtgaatttttatcagaatctattcttaacgaagctactgacacatttgcgactaagctaggtgcagctttggttgaagctgaaagcctattagcacgtatttctgaacttgctagtaagatagatactcgcaaatttgaacgtactagcgatatcgttaagcttgaagccttgttgcgtatgtgcgataagccagaagaaatcgctaagaacggctcgctgatgaaacaacgtcttgaaaaatatatttcaggcgcttcagaaaaatagtgtttacttcctccaagagttttgatactatacattcatcaactacttggaggaaattatgacccgtatcaatttaacacttgtttctgaactgaccgaccaacatcttatggccgagtatcgtgaattacctcgtgtattcagtgcagtccgtaaacatgtccaaaacggtaaacgtgtaaaagattttaaaatctctccaacatttatcttaggcacaggtcacgtaacattcttttacgacaaactcgaatttttacgtttacgacaaatcgagctaatcgctgaatgtttgaaacgtggtttcaaaatcaaggacacgacagtccaggatatttccgacatccctgccgaatttcgtaataattatgtcccgtccgaagcgtccattgcgataagtcaagcacgcttagatgaaaaaattgctcaacgtccgacttggtacaaatactatggtaaatcaatttactaaggaaaaatgaaaatgtatcaagaatttatcattgaagcagatgccaaaggtcctaaagtagatgttgacgatattggatacgattttaacaacttcggaattatttctggcggtaaagcttaaattgtttacgcttaagtattaatatggtataattactctatcaaaacaaacaaggaaacaaaaatgaaaacgtataaagaatttattgcagaatccgccaaccaacgcgttgaaggcggttatatttggattgaacaagttgaaccaccgagccgcacttctacaggtaaatggaaaattactgttgatggtcctggcggtaaacgtaggacccttaaagaaattaatgggtactatgaagaagctctttcggatgcaggaacttacatgatgcaaatcatgattaaaaaccctgaaaaccgttttgcagctaaagtcttccgtcgcattggtaataaactttatgatgcatactctaaaaacttccctaaagaataacataaattaaaacaataggaaaaaaaaatgaaaacatatcaagaatttattactgaagcgcgagtgagtgcaggtaaattagaagccgctataaataaaaaggcccattcatttcatgatttgtccgataaagaccgtaagaaacttgtaagcctttatattgacaaagagcgtattctcgctcttcctggcgctaatgaaggtaaacaggccaagcctttgaatgctgtcgaaaagaaaattgataactttgcttctaaattcggtatgtctatggatgaccttcagcaagcggctatcgaagcagctaaagtaattaaaggtaaataacagtttactttctcctagaattgtgatagtatattcataattacttggatgggtaaaatgacttatattaatttgactttagtatctaaatttgctgatcaacatttaatcgccgaatactgtgaattgccacgtgtttttttttggtataattcgtaaacacgtggcaaaaatatttacattcaaataaaatgggaacaacctggacctcatgattctatgagggattcccgccaacctgtaataaggtcgagcccaagtgcggtaatgggtaaatacagaaatggacaattcatgcgccatggaatggcccccaaccttaagagaaataatatgagaacatttttaactggaccttatctatccctgatgaatgcttttacacaccattctgatgctagagtagaagaaatttgtaagaacggttatgccccaccatttgaagacgtactcaagcagtactgtacacttcgtttagacggcggcagacaatcaggtaaatcaaccgcagtaactaattttgctgttaattggctgtatgatggtggaacagttattgttctttctaatacttcagcttattctaaaatttctgctggcaacattaaaaaagaattttctcgttattctagcgacgatattcgattccgtttatttactgattctgttcgtagttttattggcaatgaaggttctaaattccgtggattaacgctttctcgtattctgtatataattgacgagcctattaaagctcctgatatggataagatttacgacatccatattaaaacagtccaacactgctgcaaaagcaaatattgcattggcggtaatgctcgtcctcaattttttgtgattggaatgcaatgatgacaactattgaagtttttgagtattgttataacagcccagtatgcaataaaagggctcttgtagaaaattatgagatttatcattttaaacctaaacgatatcgtttgactaaaggtccgttcgcagggcagcaggttctttgtactgctcctaatgcacggttgatgactagtattccgcatttcaaaatggaatttattgatggtccatttaagggattaatcactcaaagtttaatggcgtttaattccgacccatttttgattaaagaaaaatcttggataaatttattttctaattgaggttatatgaaagcatatcaaattcttgaaggtgaacataaaggcactatttattttgaagacggtactcaagcccggattattgtctctaagacttttaaagaagacgctattgtagatccagaaattttctacggtttgaatgctcgtgaaattgaaattgaatatcaacctaaagttaaaattgaaggtggtcaacacctgaacgttaacgttctgcgtcgtgaaactctggaagatgcagttaagcatccggaaaaatatccgcagctgaccatccgtgtatccggttatgcagttcgctttaactctctgactccggaacagcagcgcgacgttatcgctcgtacctttaccgagagtctataatggctaaattgattatagaagggtctgaagatgttttaaaatgttttgccgcctggtttagttgctcaggcgagcaatcattcattgaagcatttagaatgggtgatattactggaaactatccgacaactgatatcactgtacgtggatatggtattaatgagcctatccaattggtcgaatatgaccttgccacagatgaggaaattccttatgtcgattgaagacatcaaaggctacaagccgcataccgatgataaaatcggtaaagtgaacgctattaaagatgccgaagttcgtttaggacttattctagacgccctggcagaagaagcattatcagcaaatactcctgaagctctgactgctttgtcccaattgaactgtgctaaagaacgcctaaaggaagctagtatgtgggcttgtcgtgcggtatttcaaccagaggaaaaatactaatggctcaaatcctatcaggctttggaactcattatgaagcatctcgacgcataactgaaagcaatccttttggccttgttccgaagcacaagaaaattcaaagccttgatgactttgagaatcgcctatgggccctctttaatgagtacaaggcatatctgaaagaagacgctgacgattgtcttgaagaagatgagattgcgtattacgaacaacgccttgaacagctcaagaacttccaccaggttcgtgacgaagtatctaaagcagttaaaaagctaattcctttcaaagagtagtttacttctcctctagttgtgttactatagacctgtcaactagaggagaaatcaaaatgactatcaattcagacgtttttatccgccgtaataaactccgtcgaatctttgaaacggagttccgcaaaataaatgccagtataaaagatgctgcaaagtctcttggactaccaggctttcatatcaagtattctcaacatctcttagatcgtgccatccagagagaaatagatgagaattacgtttttgaattatttcgtaaagtaaaaaatcatgttaaagaagttgcagaatttttatcaatgccggcacgtccagatgttgatgaagattttgtcgaaggtgtcgaatatcgcccaggccgtttagaaataactgatggaaatctttggttaggacttacagtttgtcgcgaaaatccggcattcaaaatgaagactcttcaatgcagaatggctattattaacaataaacgactaccaggaaaagcttctaaagcagtgattaaaatctagaggtaaacatgagaaaagcactactcgctggtctatttgctctttcattatcagcacatagctccgagcatacttttagtaatgtccaactcgataacttgaattatgcttatcagtttggggaacagttttctaaggacggaaaatttaaaacgcatgaaaatatgcataagaaaggacttggatacataatggccgcaatactatggcaggaatcatctgccggtattaatcttaaagataagaaaggtcaccatgcgtatggaatgttccaaaattatctaccaacaatgagggcaagaattaaccagcttggttataatatgactgatgcccaaattaagaaaatgctatctaagcggtctaattcagccagatgggcttatatcgaattttcttattggttaaatatacataatggggatataagaaaagctatatcctcatataatgcgggatggaagacaagtgctggaagtaaatatgcttctgaagtcctagaaaaggctaattaccttaaatcaaataaactactggaaataaaagaatgaccaaaatgttggctttaatagttggcttggtttcatttaacgctcttgctaatactacatatactgatgtaacggagtatacaaacagaacggcgtctgattattgtggtaaaagtcaagaatgtaaagtagatttttcacaaaaattgttatatgcgtataaagacggagaaaaagatggggcgtctagtaggttcaaggcgtctaccttaattaaaagatactataaaaaatggcaaatattagaatgctcggtggcggaacctaaagataaggcagcatgcaattctatggtggaccgtctagttgactcttatactagaggacttgcagcaagtgattaaaaactatatcaagggcgatattgtcgccctgttttctaaaggtaataatattgctcatgggtgtaattgttttcatacaatgggcgctggtgtggcaggacaattagcaaaggcttatccaaaaattctggaagccgataaacttcaaaccgaattcggagacgaatctaaactcgggtcttattctgtttatgaaaaatattttaagacccataaagcttattgctttaatctttatacacagtttgagccgggacctaattttgagtactctgctttaatgaattgtataatagaattaaataaattcggaaagaataagataacaaagcctttaatttatatgccaagaattggtgctggtatcggtggcggaaactgggatatcatcgaagagattttagatacgtattccactaaactagaaattgtgattgttgattgggaaccattattatgaatatacattatccacatccatacgacccaaagaataaggcagtaattattcgtcaatgggaacgcatttgccgtactaaatgtccaattaatagtccacatgatgtagataaagactacattggaacattcgttgaatatacctttattgataagaaaggtcgtaaacagcatgtagaagaatactgcttaaaggtgacatggttatgagccaaacaaaaattcttacaggtgctaaatgcgaaaaatgcgaatggcctgtagtttttgctttatgcaatgacgaaatggcttgtgattttgattattggtgttactgttcgaacaaaggttgtagcaatcataaaggtgaagggttttactcaggattttacccttacccagatttcgttaaagaaggtgaacctaaatgaaattgactaaagaagagaaaactaaactgttcgaacttatccatgacctattggatgaacaagcagccaccaatgcgtacgatgaatatgctcctttgacggacgaagaatataacgcattgatggaatcatttgacaggaaagaacaagaactcattgactacgtgaattcactataagggactcttatggctagtttaatttttacatatgccgctatgaacgctggtaagtctgcttcattacttactgccgcacataactataaagaacgtggcatgggtgtattagttcttaaaccggctattgatactcgtgattcaaaaggtgaaatagtctctcgtattggtattcgtcaggatgccaatataattacaaaagacatggacatctttgaattctataaatgggctgcagcacaaaaggatattcattgtgtatttgttgacgaagctcagttcttaactactgaaaaggtgtatcaacttagtcgtattgttgacgtatacaatgtgccagtaatggcatatgggctacgaacagattttaaaggtaatctatttgaaggttctcaagcattaatggctattgccgataagcttgttgaacttaaaggtgtctgtcattgtggtaaaaaggccacaatggtagctagagtcacggaagacggacttccaattacagatggcagtcaaattgaaattggtgataccgatagatatgtgtcattatgccggaagcattggaatgatttgacagggttgttataaatactaatatctaaccaagaggtatatatgcagcaattaaacgaaagacaacttcgtaatcttactgtaacccaattggatgaaatccgaagagaattaggacattctatttctcatttaaacgaggatatccgtcaaactggttctaaagctgattatacacgcaagcgcaagctggaaaaatacctcacagatgttaaggccgtccaaaggcgaaaaataaatactggccaaaattaacaggaggcctatatggccttaagagcgatagctgtcatagcgatgctggggttttttgcagcaacaactcctatcgttggtactgcatatatcgacccatattttgataactttatggaatcagggattaaaaacgtatatactttgtttgaaattcaaaatgtcgagaattctgaaaaattctataagtatatggcaaagcattacaaaaatagcccctgtgatgatgcatttgaatgtcatgaacaaggcataaaaaccgccaggcaatttgctgagttcatgaaaataaaattagagcctacatctatctaatttactagccccttccttatggttggggctttttggcatctatcagtttacttttcctcaggttgtgttatagtagaccttacttactagaggagaacattatgacacgtaaagaaaaaatttctaagttaatgtttttgattgaagagtacgctaatgcggtatctgattgggaaaatgctcatggttgcgaagatggagacatcgacattaacagagctatgaaaaagatggccgacgcccacaccgaattacaaatgtatgttaacgagattatgtgaggatattatgctttacgattatactggaaaatctgaagacggtgtacttgaacttttacctgaaagcgctgaagatgatatggtagtgatgttttgtgttggttgtcaatcaatgcgtgatgaaatttttaaacgtgaaccaagaaactgttggcacaggagcatgagatgatttattatcttgaaccttgggcttggttaacaatggctgtaggacctgttttaattggtttattcttttcatggttagcgaggaaactgtaatgttatatgacccaagcggttgttctgaagatggtgtgattgttctggagcctgagcatccagttggtgatgtatatcgcaccgttgaagtatgcgaatgtaatttcgttgaaggtaatactggcggaatttccattgagcaagatgatgatgttatttacctggatgcaagccaagtagaagctctttatagcattttaaaacacaatcggtagtttacaacttggtaggactatgttatagtagtcctatcaaaacgaacggagaacaaaatgaaacttttgcttatcgtatatgttgtgatacaatacaattatccgatgtttacttataacatggtaaacggcatagtgaatcttattgaaatgagtatggtaaaatgacccgtgaacaagctaataaattgatggaccttatccgtgacttacgtgaagccgattcagatttgaatgatgtagcttatcatgcggtaaatgataacggagacttttatgaaaatcaggttgacgcttgccagaatgctttggtgaattttgttgaaactttaattggtgaataatatgaaaactgtaattgaaacaactgaattgtttggtgatttatgtattgaaaaacgcggttatgcttacgttctgacgcaagaagatgatgctgttactattcttcctatggaactggacaagattttgaaactcaatccaccaggccatgcatctgtaattaacattgatgaagaccttcaagttcgtttttatcacggactttatagtggggttaatatcgaaacagaagacgaatgtttttctattaataattggaaaacattcgtcactaaagtgaaagaattcatggaatctgaaacagctaaaaaggccaaacttcaatgggctaaatgtcgtaatgcttttattacaaatcaggacaaccctgactatacaacagtcctgagcgttaatccttcttatgaagacggtgatgttgtagttattcgccaaattgacgaccttcgtcaacatatcattacattagacaaagatgaagcagttgctcttaaagcttatctcgattctattatcccgactttgaaataaggaattattatgattatcaatgaaaactcttggcactttaaaatttatgccacgttcaatagtacatggaatcgtccgaaaacattatgtgcttatttttggaaaacgtttattccggtattggctgtttcaattgttggatttgcaactttagcaggtgccgcaatcattggccaagaaattttaactaaattctttgtttttagcagtctatggacattagttcctgcttcaattggtataggcattttaacaatatcagtaatggttcttattgctgtcggggcggtaattggtccatcttggttgttagacaaatataacgacagaaaatattataaagaaattgagctcattgcacaaaaccaagaacgaattaaaaatggacttgagcctattgaacgtaagaaatcattaataggtgaataccttaaagctcgtaaagaaaaagtctgtcctactcttgaatataaggctaaatgatgaaaacgattgttaaggcttactttggtagccacctttatggaacgtctactcctgaatctgacgtcgattttaaagaaatttatgtccctcatgctcgtgatatcttgaccggtaacgttaaagaacacatgagcaagaacactaacaacacggcttctaagaacacaaaagacgacgtggaccatgagttgtatagtctcaaatatttctttaaactagctgcggatggtgaaaccgtcgcattagatatgcttcacactccacaaagtctagtagttaaatctgatttgcctgatgtatggaagtatattcaagataacaggtctcgtttctataccactaacatgaaatcttatttagggtatgtccgtaagcaagcttctaaatatggtgtcaagggttctcgactggctgttcttcgtcaagcccttaaacattctaatgaatggggacaatacttttataatggtgcagtaattcgtttatcacatatgaagaatgttctgcctgtaggtgaatttgcttcatgggttgaaaccgaaaacgagaaaacaggtaagcaaacattctatagtctgttggaccgtaaattccaagatacgttaactaacaaagagttcaatgccatcctggttaaactggaagagaactatggtgaacgtgctcgtaaggcggaagccaacgaaggtattgactggaaagcattgagtcatgcatgtcgtggtggacttcaattattggaaatttacaaaaccggtgacctggtttacccgcttcaggatgctccatttattctcgatgttaagcttggtaaacatacatttaaaactgtacaagaattcctagaagatatcgttgaccaagttgaacatgcggcagaacaagctgctaagaacggtatgcagcaaaaagtagatatgagtttctgggatgacttccttgagcaagtctacttagaaaaccacaattcatactataaatgataagggccttcgggccctttagggggttaaaatatttttaaaaagtagtgtacatgcttttaggatatgttattatagacctatcgaaacgaaatgagtaaattggagaataaaatgttcaacgttcaaatcaaaaaaggtatctatcgtaataacgaaatctctggttcttatgtcgccacaaagacctggttcccagcaaagcttaatcctgaatgttcccacttaggtgatggtaaaattttcgttatgattgatggttctgaacgtggagtatgggtcttcaaatcagacatcataatggaaggagctgagacatcaccagttgcagttgttgaaagcactgaagatatgaaaactcgtatcaacaaacgctttaaagtaatgaacatgatgacgaatggcattatcgatggcaaaattcgttcactcattatttcaggtgcagccggtattggtaagacgtattctctggatagagcgcttaataatgctaatgataacggtttcatcaaatacaaaagcattaatggtaaaatctctggtattggcctttacgaacaactttggctcaaccgtgatgcagacagcgttctcttaatcgacgatgttgatgtattctcggatatggatatcttgaaccttcttaaagcagcattagatactggtgataaacgcaaagtctgttggagcactgcgtcatcttatcttgatgataagggtatcgataaagaatttgagtttgaaggtactatcgttttcattacaaacgttgatatcgataaagagttagaacgtggttcgaaacttgctccacaccttcaagctttagtatctcgttcagtgtatttagaccttggagtacactctaatgaagagattatggttcgagttgaagatgtaatattatctactgacatgatgcagaaacgtggtctgacggacgcagaaacgtataaagcattgtcctggatgaaggctaacgtatctcgtcttcgcaatgtatcattacgtacggctctttatgtagcagattttatttcaactgataaagatggttgggaggaaatctctgaagtaactttactgaaataagcttataggaagttctgaggtaacaaaagccataaagatgaataatcatatggcttacctcaaagaaggacaccaggaacctactgagggcatagaaatatttaaaaataatgatgtacaaatcaaagaggatatgttatggattttatgcaaaaaattaaagccgcaatcgaactctatgctcatcgtatggttagttctacaatgcaatatagcgaggaggttcgtcaggactcttccttgaaaggaaaaactaaagccttaattaccttagatcatttgcaaaagaatgccatagagatgctccagtacgacaagggtgtatataagaaagaacaggaagagaaacttaaatccgaaaaattacaaaaaatcccgaagtctgtttggttcagtggaaaaaataccgaaaaaagtttcttttagttgtttacaaggtctatgattatgttattatagacctatcaactactggaggtaaaacatgaacgctaaagatattttcaacctggtaaattataacgacggtaaatttaaatctgaagcacaaagcaagttctttaatgacgttgcttatggtaacgagattaccgtagacggaggtcagattttcaaatctcgctggaattggattgttatcatcgattcagttggaattgtggaagtctacaaaaacactaacaaaaaacgtacattattctggtctcgtgaaactaacgagcagtacaaaaaggataaagcatctcgtttatccaaagtaacccaggaagatatcgacttcattaagaaagatatcgagatgtacgaaaatttaatcgctgaagaccaggcagtactcgataagtttgatgaaattaaagcttctcgtgaaatccctgacttcatgaaagaaacagtaaacgaacgatacgctctcacttcagaacgtattgcaaactatacaaaacagaaagcagaacgtattagtactcttcggaaatttgaagaacgtttaaagacggttcacgcataaacgctttacccaaggacgggttataatggttttgagttccaattcaatctgaggaaatagttatgagcattacatctgatgcggtaaaacatgaaattaacggtttatgtgcttcacagattaaagtgtggtttaaagaccataatgatcgcagagcacttaattatgaacgaattgctatccaagttcatcaattactggttagtaaatttgattttcatatgccgtccgaaatctatactaatctaccgcgagcgcttattaaagcgtgtaaaggctacggaaaatcaatggctgatggaatcttcagcgcgctgaataaacttaacgttctgtcgatgattaactctaacaatatcctgcgtaatttaggacgtaccgatttgttcggtcgtgaacagtgtaaaatgcctttgaaacagattgttgctcatcttaacgagaaccaaacacgttttatggccgtaacagcacgtttacaaatgggcctagatcgtcagatgaactttaaaactcatccacgttattcaggttcaactgacttttataaatgcgagcttcaaaaggttgcaggcaaaactgtcttagtagttcgtgtaacgtttgaaggacgacgtcaaggatattttgacctaatcggctctggtctcaaacattgtggatttatcgacgaagttgatatcaagcgagacggcactggataccgtattgggtatgtttgcactcttaaagaagagatttcgggaccagcaccaggactaaaagatgttagatataaagacgagctcgttgaagaaataaaagaagttgaatatgatatcaaccaagaagatgctcttaaagaccttattgacgaactaaaccaagacgttattccggttcagaaatttgaatcaaaacatgctgagcaaatcaaatactttgaagctttgattaacgaacttaatgtaactattcaacagactgatgatgaaatctcacgattagcaggcttaaatggtaaaaataaaacagaacgagctaatcttattcaagtagtaaaacttcttaaggaatgatgtacaaccaaggatggttggagtataataaatttttcaacatgaggaatataaaatggcttttattacacgtagagaacttatcaaagaatttacctcgaacgcatacactccaggacctaatcctatccgtatgcctgtaaagactcctgaagagattgaggaaatctgttcatattatgggattaattctcgtatgtttactcaatttgaatgcattactaacacacccgttaaagagttcattaaaaatggtgagttcagccgtttattagccaaacagaaacttcgtaatttttgtatcggcggtgaaggacaatatttcgctaagcagttccgaaataaccttaacaacctgatggccattgcttctcgtattcgtcctcaagcaattaacatgaaacatttgaaatatacttacgataagttagaaatcatggttatcagtgagaacgagttcactcttacatataatcctaagaatgataacgttgctcgtgtattccaccaagcactggaagttttaggcgataatatccaccagattaaagcgatttattctcgtgagcttaatattattgaccctatcaagaataagggcaatatcgctatccaggctcgtgtatctattggtaaaaaggttcctgcgccatggtggcacaaagactctgaatactatcaaaatcttaaaaaggaaaatgcattgtttgaagcatcgcttactgggaccccaattgaacaggccgaagtcctaagtgcttattctacttcgggtaaatcaatgtttaaaggtttgccaaatgtgtgcaaactgtctgcagtaaaactaaatgtttctaatgaccttcttccggccgaagattaccattacaatcaaatcaaggccactatggaccaactgtctgttgaacttgacaaagcacaagctaagcttcgtgatgctcaaagtgttgtaacgaatctccagttgcagtactctaaactttttaacgcaatgaatgcattaaaatcataaatcagtttacaaccaaggatggttggagtataatgaatctatcttaacgagaggaaaatattatgacacgttcacattacattgattattttgcaggtcttatcgctaatgttcatgcccaacgtgcttctggttcattaggatttgatgttccacaccgagatgtagtaagtggtattcttcgcgattttggtacatataccggccaagaaaatcatatctgtaaagatactcaaaatgcgtattctcattcattagggacactgcttcaatggttcaaacgttctcgtttattatcttctactgtagctcgcgataacattaaaaactttatgaaaccgagctttattaaatctgtgacatctaaaaccgatttggttgaattcactattgttaatgatgttaaaaagactcatttagctgattggttatctaccattcctgaaactaaatttgctgataaatttgcttgtgaattcaataaccaagtgaatatgctttttaaacattcacgtaaattattcacaggcggcgatggtcgtacaaataaagttcatgttaaagattgggttactgcagtattcaaaccaaccggtaatggtaacgcatcattgacaattgatatccaggttccttattactactcacgtaatctcggcaccatgaaagctgaagaaattaagaagcacaacaaaaccgttcgttcgctgtcttataaacttcgtatgatgttacagactatggatgttgttgaaatgttcgacgaaaccgaagataacggttcaatgttattcagttctcgaattaaaattaaattgaagaaccctaatgtgtttaagcctattaaagaacctaaagcagaaaaggttgatatcatggctgaagaacgtgagtacctcaaatctcgtctgaaagaagtcgaagcccagattgcagaacaaactaaatcgttaaaagctctgaatgcgaaagcggacggtttacgaaatgccattgaggtgttataatgaaactacgtcttttagaggatattgacatgagcactaatcatggcttggttaagtttattgacgatagttcaaagattgaatttgttcagcgagataaaatccacggtgaagaagagttcgttcctccggcatggaacgaaataatgaaaatggttgaacgacgtgaaaatgctgccaaatcggcagcaaaacatccatgcccggaatgtggaactatccaagtccaactggttaactggaccactgataacttgaaattgaaatgccgtaaatgcttccacaaatttgagagaacattataatgagatatagccttcgttgttttatcgcagctttagtttttgctgttattccattcatttggaacagccagaatacttacatggaaactaaagtaattcctgtggaggtagtggaattaatctcaggacaatctacaggaaaatattctaaattagaatttattgcagtttataaagatgaacaaggacgagtttttgacaggcgtgtatcaccatcgttttatacgcttctgaataaaggtgatacgatagctatagaaattcgtgagatggatatcaaacaaactactaaagataacttgatttggttctttggtacagtgttgttggtttctacctgtatcacaggttttattacatgtattgtatttggcgttgcatatttaatcgatgaaaggaaaaataatgtttaaagtgtacgggtatgactctactattcataaatgcatttattgtgataatgcgaaacgattgctgactgttaagaaacagccgttcgaattcattaatgttatgccagaaaaaggcgtgttcgatgatgagaaaattgctgagcttctggttaagcttggtcgtgaatcacaagtcggattgactatgcctcaagtgtttgctcctaacggaagtcacatcggtggctttgaccaactacgagaatattttaaatgacatattcattaaatcttaaagatttccaagatgtatacgaagtttgtgccaatgaacttggtcctgatgctccaactattattgaagttttaaatgtgctcccttcatcactagcttacgaagccaaatcatggggttggagcgacactgtcgttcgtgatgacctttacgtcctgatgaacgatatgatggttaaaaaggcagaaccggttgcaccaatggttaccattaccgttgaagaatataatcgcctgcaagccattgaagagcttctgtggaacattgaatgtgacctgccgtcagggctagaatcctggattgattatgaagagctcaataaactccggggttaaaccgtggtattctgctcgatgggagactgtcgagccagacgtcgaaacagtttacaacgacgaagaaacgtgttatgatgaacctacagtaaacgatatgattgatttagaaatgggaagagattattatgcaagttaaattgttataccgtttattaaaaagtggcgaacatgattggtatgtgttgattaaaactgaaccaaattttttctccggacaaccatttacggttcgtcctactaaacgtcagcttcgcaaagctaaacgttctcatcgtaacttttatagagaatattgatatgaatatttctgaaactcgcggtaaatggttcaagattgttaaagaagatgaagaactacaagacaagtttcctgaattaaagaaagatacgatcatcaaggtaattggtactactaccgaagatggttatggcgaccatggcattatcgaagtgatgttgaacacaggtgagaaactttgcatctatgaccgtgatacttctctttggtgcttctgggaatcccattcaatagatgaactcgaagaaattgattcggctgatattgcagatgtgctaggtagtaaacttggtgaattcgaaggtgaacgaatttcttatgcattagctaaattagccggacaagaaaataacgacggctatgaaggtaacctgatgcaagcagccgcagaatacattgaatatttagaaagacgtttaagttaataaatacccttatctatttaaggtaagggtttatcatgttattatcaggcgcaaaatataaagaagaaaaacaaaaattttatgatgcacagaacggtaagtgtcctatttgccaccgtgaattagaccctgatgttcaaggtaaccatcttgaccacgaccacgaattaaacgggccaaaagccggtagagttcgtggattactctgtaatctgtgcaacgcagcagaaggtcaaatgaagcataagttcaaccgttccggtttgaaaggtcaaaacgttgactacttagaatggcttgaagctcttcttgcttatttgaaacaagattattctgataataatatccatcctaattttgttccagacaaaactaaagagttctcaagactaggtaaagatgaaatgatggctgagatgcttcaaagaggatttgaatataatgaatctgacactaaaacacaattaatagcttcattcaaaaagcagcttagaaagagtttaaaatgacaattgaaaaagaaattgaaggattgattcataaaactaataaagatcttttgaacgagaatgctaataaagattctcgtgtttttccaactcaacgggaccttatggctggtattgtgtctaagcacattgccaaaaatatggtcccgtcttttattatgaaagcgcatgaaagtggaattatccattttcatgatattgattattctcctgctcttccatttactaattgctgtttagtagatttaaaaggaatgcttgagaacgggtttaagcttggtaatgcgcagattgaaacacctaaatcaatcggtgttgctactgcaattatggcgcaaattactgcacaagttgcttctcatcaatacggcggaacgacttttgcgaatgtagataaagtactttctccttatgttaaacgcacctatgcaaaacatatcgaggacgcggaaaaatggcaaatcgctgatgcactgaattatgctcaatctaaaacagaaaaagatgtatatgatgcattccaagcttatgaatatgaagtaaatactctctttagttcaaacgggcaaacgccttttgtaacaattacatttggtacaggaactgactggactgaacgaatgattcagaaagcaattctgaaaaatcgtattaaaggtcttggtcgtgatgggataactcctattttccctaagcttgttatgttcgttgaagaaggcgttaatctttacaaagacgatccgaactatgatattaaacagcttgctctagagtgtgcaagtaaaaggatgtatcctgatattatttcagttaagaataataaagctatcaccggttcatctattcctgtttctccgatgggttgccgtagtttcttgagcgtatggaaagattcgactggtaatgaaattcttgatggacgtaataatcttggtgttgtaacactgaatcttcctagaattgcgttagattcttatattggaacacaatttaacgaacagaaatttattgaattattcaatgaacgaatggacctgtgttttgaagctttgatgtgtagaattagttctttaaaaggagttaaagcaactgttgctcctattctttaccaagaaggtgcattcggggttcgtcttaaacccgatgatgatataattgagttatttaaaaacggtagaagttcagtgtccttaggatacattggtattcacgaattgaatattcttgtcggtcgtgatattggtcaagaaattttatctaaaatgaatgctcgtcttaagcagtggactgaaagaaccggttttgcttttagtttatattctactcctgctgaaaacctttgttatcgtttctgtaaacttgatactgaaaaatatggaagtgtaaaggatgttactgataaaggatggtacactaacagtttccacgtttcagtagaagaaaatatcactccgtttgaaaaaatttctcgcgaagctccatatcatttcattgcgacgggtggtcacatttcttatgttgaacttcctgatatgaaaaataacctaaaaggacttgaggctgtatgggattatgctgcacagcatttagattattttggtgttaatatgccggtagataaatgttttacatgtggaagtacccatgaaatgactcctactgaaaatggatttgtttgttcagtttgtggagaaactgatcctaaaaagatgaacacaataagaagaacatgcggctatttggggaatccgaacgaacgcggatttaatctcggtaaaaataaagaaataatgcatagggttaaacaccaatgaattatgatagattttatccttgcgattttgtgaatggccctggttgcagggtcgttcttttcgttacaggttgtttgcataaatgcgaagggtgttataataaatcaacatggaatgctagaaacggtattccattcactggtgaaacactagaacaattaattgaatgtttgaataatgattatatagaaggattaactataaccggaggagaccctctttatcctgataacagagacgttattcactccgtggttcaaactattaaaaatctttatcccaataaaagcatttggttgtggacaggatataagtttgaagatattaaacaactagaaatgcttaaatatgttgatgttattattgatggtaagtatgagaaaaatcttccgaccaaaaagttgtggcgaggatcagataatcagcgactttggtcaaataccgatggggtgtggaaacatgattaaattgaattatattatggatactataaatgatatgatttttcattttggtccagaattttattcacagtgtagtttagtgcttatcaatgcttggttaaccaattaagggtaaatatgtataaatttcgtaaaggtttagctgattttcttacaactgtaacgttctttttgtttatggcagttggagctatttttcttattccttttactgctgtatttttcgtgattagtttaatttctccggaaaagggtttatcctccagcgaattcaatgaacgtttggacaaaattactaataaactgaattctgttcttgataaaaaggcttaattatgattagatttgagcggtatgtggtagagagttggaaggggtttgatatgttcggtaatgactattatttttacgaatgtagtctaaatcctagtttttgggctggacgtgaacgagatctcgaagaaattaatgctcgtgccgaattgttaggtgaacttcctacggtttattttacctttgatgcatctggatttgttatccaggtttattttcctgaagaaaactctggtgaggattctgttaatcctccttattgggcttaccaaggaattatttctcgtggaacaaaactcgaacttaaagaacaagattgaaatctatggcatccctgaagaagttggacgttgtcccggatgttatactgttacaaaacttttaaaggagctcaatgctccttatacattttataaagtcctcactaataatggtaagattgaatatgaccgtcctttaatcgtatctcttgctaaacgtgcaggattcacttcacttaatattcgttatcctgtcatatttttaaatggtaagaaacaaaagaatattgcagagtttaaaaagtccttgatttcattaggatacgactctgatatcatagaagattgaccaggtgccgcctggtcttctttatcccatttctaatataatctattggaatcctcacttcactatctccttgtgcccctctcaaatcaaaaatattttcataaaacagtttacatcctcaatagatgtgttaagattaaaccatctactatagaggaaaataaaatgacaattgaagataaagaaattaaggtcgaccagtactattctgtcaacggtaatgcagtacagataaccagaatttcaagcctggatgtttggtaccgttcaatcaaatatccagaaattggtgaaatgctttgtgaccgtggtatcttctgttcaattgcaaaggaaattaagccatgattagtttagactcaaagaaagttgttctaacccttaaagttaatgacgagcgactggtattcattaccatttccgatttgcatgttgaaattgctaatggcgtccgtacttatcaaacgtctaaaacacaatgggactatatcccaatgttgacgcttactcagcgtttagaatcaatcggtcttaaagacctttcagtaagtgaagttaattttatcaaacgtgtcgtatcaatcaacctctgaggtacttatgggtaaaacatatcgtcgtaaagatttgaaagttcgcgattatgactattttggtaagcgtaaagctcctgacggtgttagccacaaagacatggttgaaaacattttccgctcagataaatggaaacgtatgaaaggcgttgattctgaagtcaagaatgaaatgaatcgacaactccgcaaagaagttcgtaagttgaaaaaagatgtttacagtaaagaagattatgattataatacttctcatactgaagccaaacgtaaagctaacgaatgttatcgttacagttgaggaaattatgaatatcaaacgaatgctttttaagcagggattatatactttaaatgttaatccaaagggtgatacaactaaatggtctgtaaatgactggattaagttcatcgatgaaaatggggcgtggaacacaaaatgaatcctgaaaatattgtgtcatggcaacttcgtgaagaacgtgccgaattctttgccaatatgaaactcaacggtgttgaggatgaagactttttacgctggttctggatttacaaatacaaagaatgccaacatgctgtgctattgacttgcgcaattatgtacgaaggctggaaaggcgctaaaaagttcggttaatagtttatgatggtaggaagataacacttcttcctaccaatttgaggagaatatcatggaacaagaattagacattattacatcgaaaaaacgtcttgaagttgtagtgaatggctcaactattaagtttgtatatgacactttaactgatgctattaccgttagttgtggtggaaaggcttttagtctagattctactgaaaacaaatacccgttctataaaggtatctttgatatgggtgttgatatcagtgttcgtcaagcaaactatttacattatcttatcactaaataacgcacaaactcttgagagcagagtataatgttctcattggataataaaataaccgaggaaaataatatgtctactaaaatcaaaaacgtagttaattctttcgctttcgataaagttgttgctcttctggaatccggcaatattgttactcctcaagttcttgacgcgtgggaattccgtctttatgaaatcatgcaaaaacacgaccagaaaattggacgtaattctattcgtgaaattctagtacaatatattctttctgaatttgacgttgctgcatttggtgttgaatctaaagcttatcagaaacatgaaatctctgaaaagactatccgtcgtatgaaaaatcaacgtaagaaaaaattcgttgacctgaaaattgttaaggcggtaaaatgagcgtattaacagaatctttgattaatgatctgcgtctagctggttacgaagttggtacaaatagtttaggtcttcctcagattgaaggtcctggatttattttggaatatgaattcaaacaatggtggttatatgctacggctgacgatgcgttgaatatcgatttcgttgaccaatttgattcgttggatggtgctcttgaagcagcaaaggaactagaatgaaattaactcgaatcagtataactgaagaaaagctgggcgaattttacgtcgacaactttatgaaagttacgtattttccatttgttaaaggtgtcggtttttgggaaactcatgtatctcaattaaatgaaggcgactataacgaaacacatgagaactttttagattttctttataatgccggtcttactgagctttatattgatatccatgagttcaaacgtttaatggaaaaagtgtttcaggcttattgtttgctccgatagtatctcgtgctttaagataggtctctaaatattatgatataatagacctatgaattgagctaagaggtacttatgactgaacaaaaacctaaaaataactatgtgaataataaagagcttctcgctgctataatcgagtggaaaaaggagctcttaaataataaagacccaaacaaaattattcgtcagaatgataccatcggtttagcaattatgcttatcgccgaaggcctgtccaaacgtttcaacttttcaggatatacccagtcttggaagcaggagatgattgcagatgggattgaagcctctattaagggacttcataatttcgacgaaactaagtacaataacccacatgcatacataactcgagcttgttttaatgcttttgtccaacgtatcaaaaaagaacgtaaggaagttgcaaagaaatatagttacttcgttcataatgtctacgacagtcatgacgatgatatggtagcgttggtagatgaaacgtttattcaagacatctacgataaaatgacgcattatgaagaatccgcttataaagctcctggggctgaaaagaaggaagttgttagcgattcgcctagtttggattttttatatgaggatgacaattgacatctctaactacttagaagaaccttttgacgaagcaatcccttatttggtaaaactgttgggtcgtgaatttaaaattaattttgacatcgaccctttgaacccacatgacgtgtcattttcgataaatgggactccggttgagtatgagttctgtattgaagaggacggacgtttttattttaatttaatgagataatatgactaccgagattattgaaaataaagaagcagaagatgcagtagctaaaatgctacaagaaatccaaaagaaaaatgaagctgaagcacgtaaaaaatccgaaaagattcttaaaaagaatcgttttgaactaaaccgtctttatgctcacgctcaagaagcagcaattcaaaacaacttcgaagcttacgaatatgctattaagaaatctcgggatattctacgacaaccatataatgacaagttaattaaaatccagtgggttactactcgtcaggctattgaggacattattaatggcactagttcaaacaaagtttaaacgtctgaagctgaacgcggggttcaccattaaattgggaggtcctctttgtgttaaaatttctgaaaaggaatatcacgacggttctattacagaaatttgtccgcctattgtaaaggcagacccaaaacaactcgtgtgggttgattcatttcaagttaagaaatggtggaaacgatgagagaaatcgatttaggcattttctgagaggtgcttatgcatgacgaacatcccgacttctgaaaatttcgataaaatccgtaaaggcaaagcagaaagaatgagatgttttaaagagtcttatgataaagctaaagccgaaggaactattacatacaagcccattcgatttaaaagttcaaatgagcctctgtatggtgtactatgtggataggaactcttcggagttccttttttttttttgctttataaacggatgatagaatgaattaactaatgaggaaataatatgaaaattttgcacttaggcgacttccatattggagtcaaacaagacgacccatgggttcaagatattcaacgtgatggtattcgtcaagcaattgaatactctaagaaacacgggattaaaacttggattcagtacggcgattggtttgatgtccgtaaagcaataacacatcgtacgatggaattcaatcgtgaaatcgttgatatgatttctaaagcaggcattcacgttcatgtcacgataggaaaccatgacatggcgtttaagaatacaataacacctaacactgtttctgaattgttaactcaatttgaaaactttactatttacgaacatccaactactgtagattttgacggatgtcttattgatatcgttccatggatgtgtgaagaaaatacaggtgaaatcttagagcacatcaagacttcttctgccgcgtactgtgttggccactgggaactgaatggcttttatttctataaaggaatgaagtctcatgggcttgaacctgatttcttaaagacctataaacaagtctggtctggccacttccacacaatctctgaagctgctaacgtcaaatatattgggacaccatggacccttactgcaggcgatgagaacgacccgcgcggattctgggtatttgacactgatgttgaacgtatggaatttattcccaatgaaacaacatggcatcgacgaatcacttatccgtttaaaggcaaaatcaattattctgattatactaatctagccgtacgtgttatagtatcagaaattgattcagagttgactaagtttgaatctgaacttgaaaaagtagttcactctcttcgtatggtttctaaagttgataatagtgttgaatctgatgacgaccaggaaatcgagattaaatcacttcaagatatcattaaagaatatattgacgcgattccagatatctcagacgaagacagagaagcgctggtcaaatattccaacgaactttatattgaggcaacacaatgactttagatgaatttaataatgccgggctcgggcttgaagttgaaatggacgttaaagatgatgatggattcgagaacactatcaagtattggattgagccattacgcgttgaaggcaatgaagttaaagctgttcatgtttgtaccgactgggctgttgaatttagctttaatataatggacaacgatactcctggctctattcttaaaatggctgaagcgtgtattgaggatgcgtataatgacgaagactgattatgaaatccatcgtcatgaatttagtattggtgatggttatattggtatcgttgaatggactgagaattacgaggaatcaactcctcgtttctttggaacaatgtatgttacctgtgagtacgcaccaggtgttgtcatgtatgcagaactagatgaatattttgctgatagagatgacatgttaaaatatgtagaggacttcattcgaagagaatacatatgaaatcatttaaattaaatcgtgttcgttatcaaaacatcatgtcggtaggtgggaatcctattgatatccaattagataaagtccaaaagacattaatcactggtaaaaatggcggtggtaaatctacgatgttagaagccattactttcggacttttcggtaaaccatttcgtgatgttaagaaaggacaaatcattaatagcacgaacaagaaagagctcttagttgagctttggatggaattcgatggtaaaaaatacttcattaaacgcggacaaaagcccaatattttcgaaatctccgttgacggtgttcgtcttgatgaatctgccagcagtcgggacttccaagaagaatttgaacgtagcatcggaatgtcatatgcgtcttttaaacaaatcgttgtgcttgggacggcagggtatacccctttcatggctcttagcacccctgctcgtagaaaacttgtcgaagaccttttagaagtcggcacactcgctgaaatggataaaattaataagtctcaagttcgagaacttaattcccagggacaagttctcgatgccaagaaagatggtgttatccaacaaattaagatttataacgagaatatcgaacgtcaaaagaaattatctggtgataatgtagcgcgtctacagaatatgtatgacgacctagccaaagaagctcgttcattaaaagcagaaatcgaagaagctaatgagcgactacttaatatcgttcttgatgaggaccctactgaggcattcaacaagataggacaagaagcattcttgattaaatctaaaattgactcatataacaaagttattaagatgtatcatgatggtggtacatgtcctacttgtgcatcacagttgcaccagggtgatcctattgtctctaagattaccgataagcttcacgaatgtaatcactcattcgagcaacttacatgtcacagagataatctgagtgtcctagtggacgaatatagagctaatgttaagactaaacaggaccttgcatctgatattcgtaccaagaaacagacaatgattgccactattgataaagctaagaaagttaaagctgcaatagagcaagcctcagcagaatttatcgaccatgctgatgagatagctttgcttcaaaaagaacttgataaaatcattaaaacaaaatcagacatcgttcttgaaaaataccatcgtggtattatcacagatatgttaaaagattccggtattaaaggtgctatcattaaaaaatatgtgcctctgttcaacaagcagattaaccattatcttaaaatcatggaagctgattacgtgttttctattgacgaagaattcaatgaatctataaaatcacgtggtcgtgaagattttagttatgcttcatttagtcaaggtgaaaaggcacgtatcgatatcgcattgttgtttacatggcgagatattgctgaaaaggtctctggtgttaaaatcaatacattaattatggacgaagtcatggattccgcgaccgattccgaaggtattaaagctatttcaacaattcttaactctctaaccgatgcaaatgtgtttataattagccatagagaccatgacccacaagcttatggacaacatttgcaaatgagcaaagttggacgatttactgtaatgaaagcctcttaatgaggcttatgtttacagttatcaaaatgccaacgatgcatattagcagggatccctattttatcgcaatgaggacatttaattttcttgtcctcttttttctttctgttaggatttgatttacagaattttatatgtggctttaacgccgataacttagtagttaagccacaaaacgggcaagaatcttctttccaaattttcgtggccatggttttaattattttatcttttgtttcttgatcaagttttactattttaggcgtagggccttgtttacagttatcaaaatgccaacgtctcatgtttccttcagtgccggttaaaccgcagtgtggacatgtaatctttggtttatttttgcagactcagacattttcttacgggtttcagcagtgaattctttgttcttttgaacttcttgattcttacgtcgaagccatccaaataatttgtttttgcttctatctgctttaggagatgatatggtcatcatacgagcggcatatattaaagaggcattatctggatggatttttaccaacagttgatgtgccaaataatgttcttccggtgttaagtctactaagtttaaagcatcatcacttccacctaaacattgtggtataatgtgatgacgttctgtataaccatctaaacttcttgatttagcattggtgataagcttttcgtatattgagttataattcatttactaaatccttatttgatacagcaacagataaattgataaacctatttatattgctttaatctcggagatttataatggcggagtattcaaccggacaacatcttctcgttgtccctgaaattaaaaaatatgttttgaccaatacgttttcaggtgaagaacatattgttactgaacaaatgctcaaatctgcttttaaagatgagtataataaaataatgtctaatcgcaattccgcatggacagttaccgacttctacgaataagagagaaataatatgtttactactgctaaaggtttcactgctgctgatctgaaagttacttctatccgtactgacgctaacccacataaccataatcgtgttcgtaaagcatgggtcctgcattgtgatgacgcaagtgctaaaaaactccaatctttgccacaagaaactcgttttatgatttatggttttattgataacgatgtatctgatatgtggattcatcttatgcgtaagcactataaagattctattgaagctggtggaaaaatcgttcttgataaagacggttctgagcgtctggaagatttctactgtgttgatgccgacgaacaactaattgcagctggtgaaattgttgcttctaaaattccagaatatattgaatcattgcctgaagctattaaaaagcagatggttgccgcataataaatttgttataaactttgaattgtcttgaaaggaaataaaatgaaactgtctaaagatactatcgctattctgaaaaactttgcctctattaactccggcattctgctgagtcaaggtaaatttattatgactcgtgcagttaatggcaccacttatgcggaagcaaatatctctgatgaaattgattttgacgtagcactttatgatttgaatagcttcttaagcattttgagtctagtgtctgatgatgctgaaatttcaatgcacactgatggcaatattaaaattgcagatacacgttccacagtttattggcctgccgctgacaagagcactattgtttttcctaataagccaattcaattcccagtggcttctgtgattactgaaattaaagctgaagaccttcaacaattacttcgagtttcacgtggtcttcagattgatacaattgctattacaaataaagatggtaaaattgttatcaatggctataataaagttgaagattctggtctaactcgtcctaagtattctttgactcttaccgattatgatggttctaacaactttaacttcgtaatcaatatggctaatatgaaaatccagccaggtaactataaagtaatgttgtggggagctggtgataaagttgcagccaagtttgaaagctctcaagtaagttatgttattgcgatggaagccgattctactcacgacttctaagtcaaagctttacatttattgtgatacgattatggaggagaaatcctccagtttaatgataatgaggaaaattacatgattactatcaattccaaagaacacattctagaacagaaatatcgtccttcttccattgacgaatgtattctgcctgcgtatgaccatgaaacattcaagtctttagtatctaaaggaaaacttcctcatattattttgcactctccttctcctggtacaggtaaaacaaccgtagcaaaagcattatgtaatgatatcaatgccgaaatgatgttcgtcaacggttctgattgtaagattgattttgtgcgtggtccgttaactgcattcgctcgttcggtctcaatggaaggcaagcctaaagttattgttattgatgaattcgaccgtagtggcctcgccgaatcacaacgccaccttcgtacgtttatggaagaattctctagtaactgctctattgttattactgctaacaacatcgatggaattattgaaccattacgtagtcgttgtcgagttatcgaattcggacgtccaaccgaagaagataaaatctcgatgatgaagaaaatgattcatcgtatggttgaaatctgtaagaacgaaaatatcgaaatcgctgatatgaaagttgttgcagctctggttaaaaagaacttcccggactttcgtcgtacaattggccaattagatcagtactcgtctaaaggtgttcttgatgcgggtattttgtctatcgtaactaatgaccgtggcacagtctctgatgttatcgaagcaatgaagaacaaagatattaaacagcttcgtgcattagctccaaaatatgccgcagattattcatggttcatcgataaattagtttcagaatgttatgaccaagttgcacctggtaaaagtattatttcgctttatgaaattgcaggcgaaaataataagtttcatggattagcaagtaatattgaattacatgttatgtatatgcttcttcaactgacctgcgaactgacttggaaataatatgaacttattcgatgatgacgtccagcttaacgagcaccaaattgcatggaagtctaatgacgctgatgcgattcaaaaatgtgctgatatgtttaaagaaaaacctgagaatgaattctttaaaatcattaatgctattaatgaaaagaaatctatgtcaattgctcaggtcgactactcaaaatttatggttgagaactcattatcccagttcccagaatgtatgccagctgtttacatgatgaacttagtcggttctgaattaagtgatgaagcgcacttcaactatatgatggcggcaattccgcgtggtcgtcgattctctaaatgggctaaactagtagaagacacttcagagttactagttatcaaactgttgatgaaacattacacaatcaacatgaacgatgctaccgagtataagcggctccttgaaaaaaataacaagttgccaatagtccttaaagaactgaaggccatggtcactgatgaatttctcaaagaagttaccaaaaacgtgaaagaacaaaaacaatttaaaaaattagcattggaatggtaaaaatgattgaaattaaattgaagaaccccgaagattttctgaaagtcaaagagactttgacccgtatgggcatcgctaataacaaggataaagtcctttaccagtcttgtcatatcctccaaaagcaaggtaagtactatatcgtccactttaaagaaatgctgcgtatggacggacgtcaagttgatatcgatggtgaagactaccaacgacgtgattcgattgctcagttgcttgaagactggggattgattgttattgaagactctgctcgtgaagatctatttagcctgactaataacttccgagttatctcttttaaacagaaagatgactggactttgaaagcaaaatatacaattggtaattaaagcaatgggacttcggtcccatttggagtataataagttcatcaacaaacaaaagacaataactcgtctaaaggaaattaaatgaaagaattttacttaacggttgaacagattggtgactcaatttttgaacgttacatcgattctaatggccgtgaacgtactcgtgaagtagaatataaaccatcactgtttgctcattgtccagaaagtcaggctacgaaatatttcgatatctacggtaagccgtgtactcgtaagttgttcgctaatatgcgtgatgcctcccaatggattaaacgcatggaagatatcggacttgaagcacttggcatggacgatttcaaattggcgtatttgtctgacacttataactatgaaatcaaatacgaccatacaaaaattcgtgtggctaacttcgacatcgaagtaacatctcctgacgggttccctgagccgtcacaagcaaaacatccgattgatgctatcacccattatgactcaattgacgacaggttctacgtatttgatctattgaattctccatatggtaatgtagaagaatggtctatcgaaattgcggctaagcttcaagaacaaggtggtgatgaagttccatccgaaattatcgataaaatcatttatatgccattcgataatgaaaaagaattgttgatggaatatctcaacttctggcaacagaaaactcctgtcattttgactggatggaacgttgagtcatttgatattccatatgtgtataaccgaatcaagaatatttttggcgaatctactgcgaaacgtttatcaccacatcgtaaaactcgtgttaaagttatcgaaaacatgtatggttctcgtgaaatcattacgttgttcggtatctctgttcttgattatattgacctttacaaaaagttctctttcacgaaccaaccgtcatattctctggattatatttcagaatttgaattgaacgttggtaaactgaaatatgacggccctatttctaaacttcgcgaaagtaatcatcaacgatatataagctataacatcatcgacgtatatcgggtattgcaaattgatgctaaacgccagttcatcaacttgagtttggacatggggtattatgctaaaattcagattcaatctgtgttcagtccaattaaaacttgggacgctattatttttaatagccttaaagagcagaacaaggtgattccacaaggtcgttctcacccggttcaaccttaccctggtgcttttgttaaggaacctattccaaaccgatacaaatatgtgatgagctttgacctcacatctctgtatccaagcatcattcgccaagtgaatattagcccagaaacaatagcaggaacgtttaaagtagctccattgcatgattatattaacgctgttgctgaacgtccttctgatgtgtacagttgttctcctaacggcatgatgtattataaagaccgtgatggtgtagttccaactgaaatcactaaagtctttaatcaacgtaaagaacataaaggttatatgcttgcagctcaacgtaatggtgaaataattaaagaggcgttgcataatcctaatctttctgttgatgaaccattagatgttgattatcgttttgacttcagcgatgatattaaagaaaagattaaaaagttgtctgctaaatctcttaatgaaatgttgtttagagctcaacgtactgaagttgcaggtatgactgcacagattaaccgtaagttgcttatcaactccctttatggtgcacttggtaacgtatggttccgttattatgatttgcgtaatgctactgcaatcacaacattcgggcaaatggctttacagtggattgaacgtaaagttaatgaatatctgaatgaagtttgtggtacagaaggcgaagctttcgttctatatggtgatacagactccatttacgtatctgcagataaaattattgataaggttggtgaatctaaattccgtgataccaaccattgggtagacttcttagataagttcgctcgtgaacgtatggaacctgctattgatagaggtttccgtgaaatgtgcgaatacatgaacaataaacaacacttaatgttcatggaccgagaagctatcgctggtcctccgctcggttctaaaggtattggtggattttggactggtaagaaacgttatgcattaaacgtatgggatatggaaggtactcgttacgctgagcctaaactcaaaatcatgggtctcgaaacacagaaatcttcgacccccaaagcagtacagaaagctcttaaggaatgtattcgtcgtatgcttcaggaaggtgaagaatcattacaagaatattttaaagagtttgaaaaagaattccgtcaattgaattatattagcatcgcgtcggtatcttctgcgaataacattgctaaatatgatgttggtggattccctggtcccaaatgcccgttccatattcgtggaattctgacgtataaccgggctatcaaaggtaatatcgatgcaccacaagttgtagaaggtgaaaaagtatatgttctgcctttacgtgaaggaaacccattcggtgataaatgtatcgcgtggccttctggcactgaaataacagatttaattaaagacgacgtacttcattggatggactacactgttctccttgagaagacatttattaaaccacttgaaggattcacatcagcagcgaaactcgattacgagaagaaagcatctctgttcgatatgttcgatttttgatataatgccaaggacggtaaactaattaaatgagagaaatatgaaaactacaccaatcactatcgctattgacgcaatcgtaaaacaagcttcatctcttgccactatggctaaagtaattagtcaaaaccctgctcgttataatgctattcttgaaactcttcgtcgccctggactgagtaattatgaaagccgagtaattattacaggtgttggtaagaatgctaatattgcaactaaagcttctgagacatttgcttcactaggtattcctagcatgtatttgaacaccgggcattattctcatggtgacgcaggatttattgcacctaatgatgtattagttcacatcagtcgttccggtaagactgaagaaatgataggtgttgctaaacatcttcgtatgattcgtcctcaggttaaacagattctgttacattgtaaccctgacattccacaagaatacgaagctctttttgattatacgttctgtaccggtatcgcggtagaagttgacgagaactctttagctccgactatgtccactacattgttgttagcgcttatcgatacgtttgctatcaacctttcgtctgaacgtggatttacctctaatgatttccttaagttccatccaggcggtgcactaggtgccatgttacgaggcgagcaatgaaagcaataacaataggacttttactattgatgcttgtcatgactatctactggagcttaacggctccggtaatgattccaacacttgtaattggatggattatgattggactacaagcgaagtatgaatgctttaactagaatagtgtacaatacatctacttaccaatgaggaccacaacatgaaaaaagctgttattcttggtgctggactggcaactcgtttgtatccaataacgcatcatattcctaaggtgcttgttaactataaacaagacactattctgagcaatttgtatacaatttattctgaccttggcgcagatgaaattattgtagtagttcattcaaaatttgctgaaactgttcgagcttattgtgagcaagaagggttcaatgtgactattcgtacagttgatgaagcatatggatctgcttatgctcttgctaaattacacaaagatttagacggccataatgtaattgttaactggtgtgatattattcctgattttggttcatggtcttggaatgtcaacgcaatctatgttaagggtgatgaatgtcgatataatttcgatggtgaaaatatcactaacgtaggttcaacaggcggtaatgttgtaggaatttatcagttcaaagactgggaattctatatgggttctaccgatgaggaaattcatgaatactgcaaaggacgtgatttcgtagaattcctttacagcggcgcattcaataaatcagagcttatgaatataattgatttaggtgatatgcctaaacttgaaaaagctcatgaagttcgtgaacttaatcgtagttttaatgcagttgaaattggtgaagaaactgtaactaaattcgcattaaccgaacagggacgagctcttcagaaagatgagatttcatggtatttgaaagtgaaatcagattcagtccctcagttagtttctgttaatgaaaataactttgaaatggaacgcattaaaggtaagccggcatttgaatatattaaatccaaatcaagtcttgctcgtccacaaattgttgatgcaattttagatgcactgaaattcagcacagacacgtattttgtaagtcctgaaactgttcgtcgtgatttcactaaagaattctatacgaaagttattgatcgttgtgaaagcattcaaccattgattgattcatttggtaaaatcacacatgtgaactacactaagattggacgtctgaagccaatgctgaaacaagctttagaacaccttattcgttatcataaccgttctcagggacagtactctgttattcatggtgaccctaacttcagtaatactatgattactgataacggcgaagtcaagtttatcgaccctcgtggatattttggtgaaaccaagatttacgggccaaaattgtatgacgaagctaaagtgctttatgctgtttcaggttatgatgaattcaatgctaatccgacctggggacagtttactattgatgaaacaacttgtaatgtgactattaacatcaatccattaatttacaaatatggaaagatgagttcgtttaacgagtatcatcatttggcggtggcaattatctggattgcattgggtggttatttcaagaataatccacttaaagcggtagccgcatattataaaggtatggaacttctgactaagcaattacgtaacatgggccgtgtacttcaggacggctctattagttatgacgtagcagaacctgtaacggctactctgattacaaaaaatcctggtaaatgggtactaactgataaagaaactggtgtttcctatcgtccaatcggtggcgatatcactcatcaatgggaacgaatctaatgcatcgtgtagaaaacatgcttaatctttgttttgatgtcgacgattgtataacagagtggaataacaatcgtgattacgtgaacttcaagccagacgtcgaaatggtgactgccattaatgccctgtatgatgcagggcataccataacgctttacactgctcgtggtatgaagtcagtaggtcctggacgtatagcaattgacattctcccaagtctgattcagaacttggcaaacattggcttgaagtaccataatttgctaacacataaaccagtatatgattggattatcgacgacaaagctatgcgtcctgacgaattcaaagctcttatgaataaaggcgaattcgaaacatttaaatcatataaaccgaacctataataatttaagtaagacctgcaaaaaccatcgcataaattaacgcgagatgcaaaaatgaatacttttaaaatcggaacgaattttgatttagctcttcttgataaaatcgtagagctcaataaaacttatcctaatagcttgataaacgaagtatacggctctacaagagaaatggcttttgtagcagccagacctgattttaggcttcctgacgttgacaaaaagatgttagaagattacgttaaacgttgtaacgaattaggtatttgctttaactatacactcaacacgataaatcccggttcaaaaagagaactagttgagtggaagaagaaagctattcaggattatgttcagtatctttggtcaataggcgtatggcgtattactatcgctaaccctgttgttatggaaattgttcgtgaagtcaataaagacattgagattgaagtttcaacaattctacatgtcgatgctgtaactcaaataaaatacttacatgaccaatacaatatcaaaaaggtctgctgtggaattcataagaaccgttcagtttctttcctgaagcgtgcagcagagttttgcaataagaacaatataatatttgaagttcttgtaaatgagttctgttctaatgctggtaaagggtatacaacacattgtagctatcgtgactcttgctatattttccatagtactgatgttacagctgatgatgctaaatccttaaacggatatccaatgcagcactgtattaaagctcgtgatacagacccatttaactggttgagaactcgttttgttcgtcctcaagatttgaaactttataatgatattggtatcactcaattcaaagtttcaggacgtacaggtagcacagactacattttgaaagttcttgaagcatacgcttctgaaaagtttgaaggtaatttgttagaactgtggaagcctttagagactattttcactcttgaaaacgaaaccgagttttcacatacagtaaatattgaaacctctttgttagatggctttttagaaaaaaggtggttcagacatccagatttcgattgtgctaatgaaatctgtgggacgacgtgtacatattgtgaaagatattataaacgtcagttatctaaaaacgggttagcagaaaactctatatctattattgatataactaactccgatgacgctttgaggtacccagaatgatttctagaaaaacttttaatcaccaacttaatgaagagattttgactatgaaactgaacactaacgaacaaattcttaaaaaggcccttatgggggcctgtttgaaaccaaagcggctaaagtgattaaagaacctgttcaattggaatactacgctgatgcatttcttcacagtgttcttggaagtattgatgctgaagctttacagtatatcgacactgccaagaaattcaaataagctttacgaatcgagtatataataaattgtattgaggtaaacatgggaaaacataacacaatgaaatatatcaaagccgcagattttcaaaccgcatttaaagcagtcaatcgtgaaattttagaaaacccggaattcgtaactgattctcgtattggacgttgtaatgaaattgggtctatgacagtagttgttgacactccatcatcattcaaaatgaccgacccacgtattaaccgcatctcttatgaatatgccgaagacttctggaagtttatgatttctggtggtactgatgcagaagaagcgtttaaggcatatcctaatgtcgctaaatttatttctaaaccaaaatcggatgctttgcctgcaaacttcaacactttctatggtcctcgcattgcggcccaattaccagctcttctaaaagaacttaaagagaaacctaactctcgaagagttgtgttccaaattctagaaagttctgatcaggctttgcttgattcggacgaaacgcttgaatatccatgtactgactcagtgacttattatattcgtgatggtaagctttatacccactgtcatatgcgttctcagaactgtgctgttgttatgcagttggatttttatctccaaggaaaattacttcattatatcgctaacgaatgtggtgtagaagttggtgattatactcataccatggtaagtgcccatgtgtttgaacgtgattttgattatgttaaaggattccttgactaatggctattttccgcgtacctatcttgagtatgcggtcttatgaaactggacagtatgctatccttaaggatggcaacttccaacttcatttgcaccgtgctaatccaggtgatgtgattacatatccacgtaatgcatctgatattaaagaatgcgaacgtctttttccggaatttaagtttgttccattatggtataaagataacgcgtataacactcgtaaatatttctggtctgaaaatgaatttgtggttgattcattaattgcttattatgattgtgattttctaatcacagatatcactggatatgatggcgtttttgacgtagaattcaatttcaatatcactgcagaccctaataaaccacgtttttatattgatgaattcttaaaaaccgacatgttgtctgttaatcgttcacttcaaactactgtgttgaatgaacgtcaaaaagaagtgctggttaacgcaggtgcagatggtaataagattatcgtaacgcagaaagttatacgtccttccgtcatgcagcgtcttgtaggtgatttggctcctattcatttagatggtatttttcatccatttcgaattagtgacccatgctatcgttttgaacaagttgttgaatgcgcaattcaattaggtcaaccgctttatataactgatccaaataatagtttcgacagaaataagtatcctgaagaagcgctgattcgaatttttaatccaactaaaactgagtactatcaaattcttaaaggacgtccgaagattcaatatttcgaaaatcctgaagaagtattccatccaggtcttggtgagttcatctactttaatgctttaatttcttcaccgtataatatacctaaatacgaagatgtcgtaatcgaggaataaaatggctaaaattattttagtagacggcccggataatgctggtaaaacaactttcattaatgacgtaatggaaattagtgaaagatatgtaaagattgatttccctaaacgaacagttgatgggcgtttcgatgttaagtctcgaaatgaagttggctgtttcgaaacgatgttgaattatttagaccctactaagatttatctgttagaccgtggatatattagtaactgggtctatggacgtattagacaagatgcggactcggttcttgacgtttatgaacaggattatgttcgtctttgccaaaaccatgatgtgttcacaattattttaacacgtaacgaaatgactgaaagttttgaagacgaccttattactttgtcttcattcggttttaatacagtcatttcatattttgaagagtttgcaattcataacgaaatccaaacgtatcaattacttaatcatgatggtgctaacaaagttataggatttaatgcaagcgaacgtaattatttgattacagaaatcattaaatgggctcgttaagagccatttaaatttttaaatgctgtataacccttagtatataatcatcttatcttttaaacatgagtaaaatataatgatgcctatggaaaaatacaatgtctgatttaaaatctcgtttgattaaagcttctacttctaaaatgactgcagacttgactaagtctaagctgtttaataatcgtgatgaagtccctactcgtattccgatgttgaatattgcattaggtggtgctctgaatgcaggattgcaatcaggcttgactatttttgctgcaccttctaaacattttaaaacattgtttggactaactatggttgcagcatatatgaagaaatataaagatgcaatctgtttgttttatgactcagaattcggtgcttcagaatcttacttccgttcgatgggtgttgatttagaccgtgtagttcatacgccaattcagtccgtcgaacaacttaaagttgatatgactaatcagcttgacgctattgaacgcggtgataaagttattatctttattgactcgattggtaatactgcatctaagaaagaaaccgaagatgcgttgaacgagaaagttgtaggtgatatgtctcgtgctaaggcacttaaatctcttttccgtattgtgaccccgtatctgactattaaagatattccgtgtgttgcaattaaccataccgcaatggaaattggtggattgtatcctaaagagattatgggcggtggtacaggtattctttattctgccaacacggtattttttatctctaaacgtcaggttaaagaaggtacagaattgaccggttatgacttcacgttgaaagcagaaaaatctcgcaccgttaaagaaaaatctactttcccgatcacggttaattttgatggtggtattgacccattcagtggcttgttagaaatggcaactgaaattggttttgtagttaagcctaaagccgggtggtatgctcgtgaattccttgacgaagaaacaggtgaaatgattcgtgaagaaaaatcatggcgtgctaaagctactgattgtgtagaattctggggacctttgtttaaacacaaacctttccgagatgcaattgaaactaaatataaactaggtgctatctcttctattaaagaagttgatgacgctgttaacgaccttattaattgcaaagcaacaactaaggttccagttaaaacttctgatgctccatctgcagcagatatagaaaacgaccttgacgaaatggaagatttcgatgaataatctcgatgatttaaatctagaaatcgttgatgaatccccttcttcggaaggggaggacattcgcaaagaacgagtgtttaatgaatctcttaaaattatccgttcagcaatggaaaatgtcattcaagagattctgattacacttgaagacggttcccatcatatagtctatattacaaaactagactgggttgatggtaaaatcgtaatggactttgcagttcttgaccaggacagaaaagcagaacttgcaccacacgttgaaaaatgtgttacaatgcaagtacaacaagcttttaatgaacgaaccaagaaaaaatttaaattcttttaaggagttatcgtggtagaaattattttgtctcatctcgtatatgaccaggcttatttttctaaggtatggccttatatggattctgagtattttgagcgtggaccggcaaaaaacgtctttaaaattataaagagccacgttaacgaatataatgcaatgccatccatcaatgcattaaaggtggctttagataacagttctttaactgaagccgaatataaaggaacttcagacctaattgaaaaattggctgatactcctgaagaccatgaatggctggttaaagaaactgagaaatatgtccagcaaaaagcgatgtataatgctacatccaaaatcattgagattcagtctaatgctgaactacctccagaacaacgtaacaagaaaatgcctgatgtaggagctattcctgatattatgcgtcaagcactttcaatttcgttcgatagttatgttggacatgactggatggaagactacgaagcacgctggctttcttatctaaataaagcacgtaaggtcccgttcaaattaaacattctaaataaaatcactaaaggtggtgcagaaaccggtacactaaacgttttaatggccggtgttaacgttggtaaatctttaggcctttgttcacttgctgcagattatcttcaaacaggacataatgttctttatatttccatggaaatggccgaagaagtttgtgctaagcgtatagatgcaaacatgcttgatgtatcacttgatgatatcgatgatggtaacgtatcttatgctgaatataaagccaagatggaaaaatggcgttcaaaatccacattaggacgtttagtagttaaacagtatcctaccggtggagctaatgctaatacatttcgtgcattgcttaatgagttaaaacttaagaagaactttgtgccatccgtaatcatggttgattacttaggtatttgtgggtcttgtcgtatcagagtttacactgaaaatagctacacattagttaaagctatcgcagaagaacttcgtgcattagcagtagaatctgaaacagttctatggactgctgctcaggtaggacgtgcagcatgggatgcttcggatatgaacatgagcgatattgcagaatcagcaggtttaccagcaacggcagatttcatgttggccgtaattgaaaccgaagaacttgcacaagctgaacaacaacttatcaaacaaatcaaatcacgatatggtgataagaataaatggaataaattcctaatgggtgtacgtaaaggcaaccagaaatggattgagattgatcaagaaggcatgaacacacctaacacagtaaatgaaaacgcaggtgctcagatgcgtcaggcagaggtgaatcgtacggaacgcgtaggtaaagccaaagcaacacgggctgacctagatagcttagccaatgagttaaaattttaataaaaaggagacttcggtctcctttcggggtttacatcttcctctaggcatgatatgatgaacttacaccaaccaagaggaaaacattatgaatatgtctcaagcaatttttactgcaatcaccgaaaacacaaccgttgaagtagtttctccactggcaacctacgttattcttgctcctaaaactattgtatctcgtatggaaaacatgggcaaacgtatcgtacaaatagttggagctggaaatcaaaaacttgattatctacgaaccatcaaagcttatgaacatttccaactcgaaaaaggttctcctatccaggtagaactcgtaaatggtgatatcgttcgagcaatgttccatcatttctatgcattgaatgacccatctaaagcggttcgtttaattgcatacgacgcaaaccaaaacgaaatcaacgcagatatatctaaattacgtttttaagtttacttctccagtagttgtgttattatagacctatcaactactggagaacaaaatgaaaaccatcgattgtaaagcagaatttaagattttttatcacggttcaagtagttcagctaacatcgaaaacatgctttgtcctcctgaagaaacaggagttctgtctgaaacaggacgtaagaaaaacttggatcgtgtattctttaccgaagatatcggtttagcaaagatttatgcaggacgagcagcacgctcttatggaggtgaaccacgtctctatcgagtaatttctccggtagacgtagttcaaatgaataatactaaaggtgctacagtttatcacgctgaatgggcattttgcgaggaaatatgagcaaattaactaaagttacttttatcggttggtttaaaagcggtgagatgttcactaaagatatcatgttatcaggagatcgcgaagaaatcgagtgggttgcggtacaacttgctgaagtgaacaaagcatttgttaaagcatttgttaatgacgagaaagttttcgaagcagattttcgataattttaaaaactgtttacaagcactacgtactgtgttattatctttatatcaactacagaggaaattgaaatgaaaaaattaatcgctttagcaatggtatttggattaacaggatgtggtgcccatggctttattcctaataatgttggccaactgatttacaatccgaatgttaaacaatatgaacaacctaaagttgaagtggaagacccggttactgtaggtaatcgaatgattcaagctgatgctcatgctcaacgttatcgtgattctgatactgtagctatgtcaaaagaacagcgcgttaaagaacattgcttacaggctactgaaatcgcagtcattcgctatgttgaaacaactggtaaagagcctacccagaaacaaatcgcgaataactacgtccagtgtattgaacgtttaaacaaatttaattaattggtttacactaaagttaaatcaagatactataaacataacaaatcaagaggaaattaacatggaattattcgtagctagttcagtagcagttttaatcgcaggtatcggttcaattatcatttacatgttgccttgggtaatcgcacttattcgtggcacaaaaagcacaacagcaatcttcttcgtatctttactctttaactggacgatggttggttggattggaactttaatttggtctatcgttgccgaaaagaaatcggctcagcagcctcaacaagtaattattattcgcgaaaaagaataaacttgtttacattatagatggactatagtatagtagtcctatcaaatcaactaaggagttaaaatgaaaaagttatcattggcggcaatcttacttgcagtatcatgtgcaccagctccagttacggcaggttatgataaagacctctgtgagtggtcaatgactgcaaatcaagaagatgttgaacaacaaatcttctctgatatcatgaacatcactaaacgagaccgtcctaatatggttaataaagttgttgaacaacttaagtctggcggtatcatgcagtacaactatgttttgtattgtgaccctaatttcgataacaaagatatcgtaaccgaaatcacaggtgagtaatatgatttattatatgcacaaaaacgcgccgtttaaatatggtaaatttcctaatgcacaatgttataatataacgccgaacgaaaataataacggctaccatattggtgtaatttttgtaattgttaaagataacgaaatcgttgcttgggcagattttaaaggtacaacatatgatgttaatcctgtgcctttcacatattacaatataatggatttggcatatgattataattggtttggctcatattgaaggtgtag

SEQ ID NO: 5 - DNA, 134466 bp, Unknown
  Myoviridae; Vequintavirinae; Unclassified V5virus
accattctataaaatcttgataccactctccctctgagcgctccgtaggccaataatcctcaccttctcttgcattaaaatctgagtattcaactttccactcttttaccagctcgtggagaaggttttcagcctgttctaaagatttattttctgtcattactgtcccctttttcaagataactgtacatcagcgccgcgccacctaaaatggctaccagcagtaatacccccgagagcatttcaataaacatggcttgaaacactagaaggcctcctctaatttaacgcaccattttaaatacatgttcttttcccataaaggtgcctggctaagatctgcgtagaatgcaatctctttaagaacagtataaacagttttaggtgaggtctccattcctactctcctttttctccttacggagattcttgtagtagtcaaccaggcacattatcacaatgaagacaacaacaggccaaaaaggtgcagcagtaatgatggtgataaaatcatcaaacttcacccttcgtgtagacacgacgcatatacctgtcaagattactgctgttataacggctattactaggtaacctatcagtacagcatctatactcattggatcctcctttacaggttaaattgtatactacagatggttgctgagggtgtcaagaaaattatcccgttctttctcagagttttcatgggtgtagctgaaaaacatatcgagaataaccttattgatatattccagctcctctgtgttcagatacttatcaggatctacaatgacttcccaaatatcgtacagaccgcactcatgatatccccaacgccactcaattgttaaaccgagcggcaaatctttaccgtcacaaacaaccttccatctacagatgttggtatctggacgcacctgtgcacggtatacctgtacaaaatccaatttgaatttgaggtactcgtcatacaatttaagtacaaagctctcgatttgtggagacacttttgcagcaaactgtgcgtatttgtacttgcactggatgatctttctgcgttttgcagttaaattttttgcagacagttgttcttcagtgtacctccacctacggtcaacaaacgcaacagggtctttgtccccatagaggtcttcccagttaatcagaagcatacctgtcactcctccacaacttcaaggcctttaccgcccctctctggaagattgccgagggataggtagtaagtatagtctggtgagattctacccgcttgtgctcctgcagcgatcaaatcttttccagtgatcataacaacgtttttgtttgccgtcaaccgttttgctactacaattttaccgacgcaatcgatcagtgatggataccctaaatctgtaagaaatttaactttcatgctacctcctacttctaccgtccctggcaagataaattattactgaacagaacgcggagctgggaaggataactcttctaaagagaagatttcatttcctaccacccaagttgctggatcatctggatcaacaggttggataatcattacctcatcaaccttgcacacacgtttcccacctatggtagcgtcagccactaacatacgcggctcttcagaaatgcacaggtagccacctcggcccactgttccttctacaggatcctgccctttgacaacgatgaataccttttctcctgtggcgatattactttgcacacggacagtttgaccaactttagaggtaccgaccttggtggcttcaaacattaaatcccgaattactgttgcatagttgccggaaactttcttaccttctttggtgatctcaatcttcataatttaggctccttaaatgaatctatgtagtcaattaaatcccaagcatcgcgatgggctgtcagaggatatacttctccgagagggatcatagcggcaagtctatcaaaaacccagtctggacgcaacattttatggtgatattcccactcaccttctacagactttttctgagtgatcaggatctctgtgtagtgtttagcctgtcttgagtagattgaaaatgacttgtacataaatggcccctcttgttgaaaacaagaatacataactaccaggtcactgtcaagtaggcaactgtgttatttttctctggcgatatgccaacaacatccacttgcagaccccctgcccttaaatctccgacgatgtgtgggaagtaatcagagagatgtgatggaagatttatcgaaaatccgcaccccagaaagcctgctaacgctttattttgtatctcccctacaatcgcatcgtaaatagcgttaagctcgtcaggaagcgtcacagggcgttttagcgctaactggtgtaatttgtccttagcactcattttcatttcagatctacctctggtggtgccaaccacataaatggcggcaaatctaagcggtttttcttatcccacacaaaatatgcatatgcttgcccgtcagttctgccattggactggaatgatgggcgcttagatattgtaatcactgtggtaggggcattttcaagccaccactcaaaacgtgctttactttccaggaagttgagacgcaaaagcataacaactacgtcagcatctttcaacgccttttctacaaactcacgggccaggctgtagggagggttggttataatgcagtcaacatggttgtattctgtattcaagtagtccacaccttcttgaatctctccccatgcagatcctaacggcatacgggagtagaataccccgttaacactgtttcggcacggctccagataagtccagttctccgggaaatcaattaagttatatagaccttctgcacaccaatctggtgtaacatactcatcataagcattacgttgttcgtcaggttttctagcgcaagtcatgcaaatctccagatcataaaagccctccgaagagggctttaagattaatatttaagcttcttcgacaattcctgcacccaggattttttcattaagctcttttgcggttttaataatattatccaccagacgcttacgggtcttgtctttcacctgaacctcttcgccaccgttcagagtagtcttcaattgagacagaatatcctgaagttcaacgacagagaatcgctgcagatcttctgaggtaatctcgccgagagcgatccggacggtctcaccactttccatctgcagattcaggaacacggtgtgaacatcatctttcacaccatttgcttttgcagactcgacagcatgaaccagttcgtccagggaggtgcactggtgaatctctggcagacctgcttcacctagtaccccttcatcaccttttgccaggagctttttcggtttctgcccgttctggatacgctgaatattttcatcgtccagaatgatagctccagttctagctgccagctcctctccgtccaaccacacttctccaccagccgtgatggatgcgatctcatcttctgtcagcaccccaccgtagtatttttcgatcagacgttcgaaacgttttttccagtagctgacctgagtattcatgttcacaccgttgccataagtgccgccttggtagtagtggaacataaattctgtgtccggagccacagtgcgttctttgcaacccagccataagattgtcccagcagagcagcacatcccttcagcatgtacaacaacgcttgcctgagactcgcggaatgcctgcagatatgccattgcaatgtgcacgcaaccaccagggctattgatgatcacccgaatgctttcttcaggctgagccatacggatcgtctgcagacgagacatatgatcttgtaggtcttccaagtcgtcgatataaagaacgtggtcaacaacaggtgttgggtagctgtatgtttccataataccacccggcataccaaacattttattactcatcggttcgaagccgttctgtttttctttcatgccgtgtaccatggtgctgcgaggtgttaaattcatgtgaggtccttaatgttggaaaattaaaagcgatttatttaaacctgattctcatttgtctttatttggcaattaccatggaatacttgcaattgtcagaagcatcacaggtcaacgattgccagtctaccacataccacgtgtcattgtcaacaattactttatcacctgttctgtaaaaggtgttgctttcaataacacgagactcagtgaagaatcggtgtcttcgctcacgtagtagagccaagttgattatattaccaccgctgtccttaatccacacattcttgtatcctttatttgccaaaattgtctcgccgttatagacaaacaggcagtagattttattcaatctctcttgtatcgtagccatactgttcttctcctcgttttgtcaggcaataatacctaaagcttgtctgtttgtcaacaagtgttttagatattcaagggtggaataaccacccttatatgttactcggaaacaggagtccaaatacggtttgcacggtcctcaataagattgagtgcaatctgacgacccagcccagaacgaacaacatcgtcaggactatcaaagctaatcatcccaacttcaggatctggatgtcgtgtaaagaaatctgtcacccatgcaaggccagatttaccagggatgtctcgttggctattgtcccccataattacaagggtggcctgatctgaaatccttgtgataattgacaacatttcttcagggttagtttgctgtgcctcgtcaattaggacaaagcatcgttcatcgaaactacgaccacgaatactttcaacttcacaaatctcgatacggctgttctgaccgtctcccagcattgctgcaaaagcacctttgccaacacgacgacaaatcgtgtccatcatactccgaagatagggccacagtttctgcattgcatttccgggtttaaatcctgaagtctttcctgtctgaacgtaagggcgtgcaacaatgatcttatcaatctcgttcttacgcagaagatcacctgcatatgcagatgccatgaatgtcttaccggatccaaacacaccgtttacaataataatcttacgtgaccctagataatcaagatacttttgctgctttttattcattggtcggagagctggagcggtgtgctctcgttcgtcggcaaatttctcagcagccttacgcaggcgatcagatttacgagcctctctggcttcatcacgcatgcgttttgtttctttagctcgacccatagtgggactcctttcagattgagatgtgtctggaacttttattgcaacagtttttcgatagccgcttccatactgcttgcaacagcctgaactcggatattcatctcttcttgatggatcagttccttaagctctttaacggtaaattccttagagaaaccttccaccataatattgtgtaaggcttcttgcgtgtctacttgcaagaacttttccagtttgttggcagaggcttctaaatcggcccgaatacgaggatcatctgtgcgattcagcattaggcgtaagccatcaagattagtagaaatagcgtcagcatgttgagtaactaaccgtggcaaaatgagatctacaaacttattagccaaatcaatacgttcttgtgtcactgttgtaccccctcttcatcctcatgatgtttcttttcacgcttgtgttttttcttaagctcaagcgcaatctcttttttgtacgccttcttcaaggcctttttagccatttggcacctcctctgctttcattttacgataattatatctgtctaaacaaagctttgtcaacaattaatctacctgaacccatccgcctgctacctttttaaacattctttggttatcactgcctcggaacggtttcttggttggcaaatcttttatatacttaccatcaatgatgatatcagccagtttaagaacatcactagagatatggtcaaatgtgaacccagtatacacaagaatagttttcttgtcaccaaatttttccttaattttctccatcaggctaataatacctggctcattatagtatgccaagggttctccacccagcagagagataccgcacacagactggttgtccaaatctgacaagattttttgcaagtcttcttcggtgaactctctccccttatcttttgaccaaaatgcctgattaaagcaaccagggcaagcgtgtgggcacccagatacccacaaggcagttctaatgcctggtccttcggtgtaagatatttctgtgtatccagcaatgttcatagatactccgtaccacattcagggcaataccaaataaaatcatccagcgccttgcaccaacgaagattacaatgacaaccacacttgcaaattttataaatacctgtagacatactgcacctcctagtttactgtgtaccaacaatatgccacatccttgtggcttttgtcaagtatcagcagccacaacttccgtagtgcttaactcgctcgataacttcagcttgcttgcctttattgtaaggacgtgagttaggactggaaaggtatccagacacacgtcgaattacactgatcgttccctcttcgtggtttccacagtccgggcatacaaagcctttagctgttgcactgaactcaccagagaaaccgcactttagacatttatccactggttggttaataccaaaatacataatgtgtttatacccgaagtcaacaagagcctctaaagcatccaggttgtttttcaggttaggtgtctctatgtatccaatgttgccgccagaggagatcatagcaaaaccttcttcatacttccacttatcaaaaggtgaactattgatccatactggttggtggaaactgttggtgatatattcatgctcgtgcttcaatacctcaggatattcacgatccagacaggttgcagctttgtagcataagctttcagaaggagtgccgtacaagctgaatgccagaccactttccttcttatatcgctcacaagcatctttcatgtgctgaaggattccaagagctaaagccttgtctccctctctacccaagatctgacaggtttcatacacaccaatatatccaatactgatggaagcgtacccgtcatagaagagtttatcaatactctcttcaggatccaagcgagcaagagcgccttcacaccacatgatggggttctgacctgccttagtgcctttcagacggttaacccttacaaggtgagcttcatatgccaaatccagatattcgtctagaactgtaaagaaatcaacaccttctgttttagcttttgctgcaatcattggcaggttgaggctaacaacacccaagttgaatctgccgaggtatttctcctcacctgtttctaagtcattatatttgctaagaaaactccggcaacccatgctcgttactttgccatctgtagaacctgtcaccttacgatttagcggaacagaaacaaagtcaggataaattcgctctgcagagcattccagagctaatcgtttcaaatcatagttcggatcctcagggttcatgttgacaccctcttctaagaagaacagcactttagggaacacaggtgtgatccgttcttcaccaagacccattttgtggactttcaggtagtttttggtaatcattctaccaaataccgaggtatcaagtcctaaacttaatgttatgaacggagtttgcccgttgacagaagttaacgtgttgatttgataaagcaacgtctgcatactgtcaaacacgtctttatcagtcatctgcattgcaacgccttcagcatccggcaaccaatgctcctgacaaaatttaaggttcttctcataggtagcttcagcatactgtgccaaataatgatcaatatggctcatagtctgacccccatattgagcactagctactgcactagagatttggctaaggattgttgttgcaacccctattgacttaggcttgctgacatgagcgttgccaatattgaatccgttttccagcatatctggataatttaccaaacaacagtttgttaacgggctaattagatagtcaagatcatgcacatggatgaatcctctattgtgctcttcggagacacgatctggcaggatctgtgttgatgcaaggtgtttgctgaggatgcctgcaagcaggtcacgatgagtgtgtacatggttggttggcttatttgcattctcttttgtaaattcatcacaagttcgatccaagaagccaccaatatctgcaagcagttttccaccagcttctctgttattatcccttgtctgtctgtattggatgtattctctggctgcacattttaaacccatatccataagagcatcttcaacaaggatatggatattttttacagagattgtgccctgatcggctggtagattgttagcaacagcttcattaaccgcgcaggcgatccggtaagcttcctcttcagtatgtccggactcaagtaaggcggactctgccgccttgatcaccttaatgccgttgtaaaattcttctctaccgtctcgttttacaactttcactttttctctccaaaattgttcttaacaaaagagatgaaatcgtcagcaccaccaatgtggacactgtcaaggtcgctttctaagaagatttgaggtaacgttctgggaacaattgggctacacttcttaataagctcttcttttgtatagccctcccctagcgtcttgtatacaaaaggtagacctttactgactgcaaattcttttgctcttacacaatgtggacaattatccttaccgtaaataatgatgaaaaaagatttttcacaactcatatattaaaactcccaaatttcttcttcagcgtcgttaacagttgtgttgacgcggtagtcagtgttcgacatttcttggttcgccgtctgttgcaatgagggtttcatccacacctgcataaacggtagcgggtcctttgttggcggcacaaagtctttgtcgatgtcgtagtaatcataaatcggtgagcagttatagtcaacccattctttaagcaacggtgagttaagacctataatcgctcttccttcgctgaaaatatagtcactccaaccgtactccttggttcgtacttcatcaagaatctcttttaactctccctttatctcaaggaagcttttctcccatgctggatcattaagcaggatatcaatgatggcaaaatcgcctttcgaatgcagcatttcgtcaagcatgattttttgaacaagctgcgccacctgaacaaaaataccctgctcagctactgcgaaagtgcatgcaaaacttgcaataaactcaatactctccagagctaaaagtgcaaaaagcgctctaagaatgcatttccgtacaacatcttcttcaacactggagggatccagtcggtattttgcaccaataacctcaagctcttgcatatatttgacaataaccccagatctgcttagcacgttctggttttcctgaatttcttctatgatctcgcgagcattaggtaggcactgtctaacaatctctgagtaagtaagtgcgtgaagaacttcaatctccgactgcttcatcaacagagcgaaaagctcactattagtgatgaatggtgaaaagaggcagatgattgatcttgccgcaacgctatcagcctcccattgccacatcaaggtctgcaccatcacgtcataagttgactttgagcatgttacaaaatctgaaatagattgcgacaaatccacttcatcctctgcccaatcctgttctttttgttttttatacagttcaaacagttgtgggtattttttattgatagagtcatacatccccatttgctgtcccagaaacagcggatagtcaccagttttatgagcggtgttctcagcattaaatacagccattagtctacctctaaaatggggccgaagccccttttaaaattacagtgcacaactttcgcaatacggatcttcaactgaactatctgcgatcaaaggatagttctttctggtttcatcttcagcctgtttcttggcatgaagttcctctgccaaggagtcaccagcaccaaccctagagtttaaataataccatgtcttcatcccgaatttagtggcacggataaggtaccctagttgctccttcattgaaattttaccatctttcaacttggtgtaatctatgtacaaatctgcgctgattgcctgacctgtgaatttttgaatcacggcatacatatcgatcatgtcgttggtatcaacgtcccaagccgaagtgtaatactctttcaactcatcgtattcaggaacgataaacagcacctgcccttgtggagactttttaaagataatgtgctcacggacaggataaaccccgttagtggtgtttgttgccagcgaagagctttcattaggcatatatgcttcaagaacactattacgtagcccaccattttcaatgatttgtttacgtaacccttcccaatcctgtttaagagaaggatcttttaccacactgtcgacctctttgttataggtgtcgattggtaaccaaccctccgggtattttgttttatgcatccactcacagacaccacgctcttttgccaatcgtaaacttgctttgtgcaagctgtagctgtgaagctctgcaagatcatggacaagctgtttactttccggagatccgtaagtaaccttgtggctggcaataaaatgtgcaacattggtaaggccaaccccgatagatctgcgttttttaacagtgctctccatattctcatacggatatgtcatgatttccataacattgtcaatcataagcaccgtgtagtatgcaacatcttcatactcctctggggtaaccctcccagctacaagagatgataggaagcacaatgcaacctcaccatcatcagcatcgtacttgaagatattacgcatatctgaatagccttttgtcggaagggctatctcggcacacagattacttgaatagattacatctttaaaaggtgtatgtctattcatctcatctgtccagtatacgtacagtcttcctacctcagtacgctgcgtgataagttcagcagcaagatctctagcacggatccatgttttaggaatactgtcatctttagcgatacgatcaacctctgcatcaaactcctccatagacatggtgaagatgccttcgtgcagctgaggtgcgtgcttataagaaacaagcatccaatctaaatttttagccacacggttgataaacgacctattaatacctatggaataatccatagtgttgattctttttgaagcaacagtcatagggtttctcaaacggattagctcatcaatctgagggtccagtgcaaggaatgacactgttgcagaaccaccacgggattgttgtctattctccttaacccccgcatcaataccgcgataatatgggagcttacccatatgcttaatcgtgttaccacgaacaccatcacctgcagatcttgacgataaatagtagccaatgcctgcttggttaaccgtcattgtgtacgcaacttcacgtgctacaccaatggactttgctgtatcgtcagcttttattacgcaacaagatgcataccctgtcttgcctgtgcgtagaccgtttaagtacggtgtcggggcattgatctttaagtctgacagataagtgtataattttacaacatcgttaatacggcgttctttaggcatattcttcatgacagccattgctatccccataaacatcatctggggagattcaaacagggtgtctttaagagtatccttgatcccgtatttgtcacgaaactgtttaaggactgcatagccataaccgagatctttactgtgatcaataacagtgtttaaagtgtttaactcagtaaagctataacccatatcctcccaataccctttctcaaccatggtattgtagaatgagggtaaggaagggatctttgtaaaccctccaaaagcctctttatagatctgaccaataagaacacgaccagccatacgggaatgtgcttcgtctttacggctaacacatgaatctataatagcctggttaacttctttggttgtgcatccatcatacagacgtttgtatgcatccattgcaatatgtgaccaattgccgttaccgtcgtcaccgaaaatagctgccttatttaaacgttctggatcgaattcaacttcacatccgttacttttaattactttggtgatcaatttgcttcctccacttcatcaacgtatttatcaaggcaggtatcagtatcttgctgagtaaaggtatcctcttctacagagatatttataattttacctgtatactcgtcataataaacatcatcatacattttaatatcgtttgtcaggccgttgaaccaaagccacccaacatactctgtccgacttgcaaaaccaagatccttccacttggaattatgactcatcttcaccaccttagctttcaataccgaataatttttccaggcgatgcagatcttcaaaattgaaaggttcatcaacaatatgaatatcttcagccttttcagattgttttgtatactttcttacattaacacgatcctctacagggatatcgtatggaagatcttgaacaagcagtgcctcatctggcgctttatccacatctaaaatatctacaccattgtacatttgtgggtatctaaagtcagcacgcatgacacccgcaaatacatctgcctttcggtaatgggtaggcttatttttgcatctaacgttttttccacgaagaacatcaatattttttaaatcaaaccccacagcaaacagtgcagctcggagaccgtttcgtgtacgaacgttaaacccaggaacggtagataggaaatctaaagtaactgaaataaatgtctttttaggaatcataacatcactcatatctgtctcctttctggctcaccaacaaagtgagccattattatagatcatctgatactgttagtcaacacaaaagttacctatcgctgtgataggattatcctttcatgaagtgattattaagaagctgtcggtgctgaacccacccacaaaagttggcagaccagaatttaccatcacgatcttgatgggttacaccttcctgccaaacacaactgtcttgtgtgatctcacatgaggacagataatagtttaaacgttccattgcattgtcgtgatccataggggtcgcctggtgctcgtaagggcttgcatgaatacgatcccccccaatcaattttttagccacattgtctgccttttcaaacgtgctgtcaatattgcgataagatacttgtgcacaacagctcgcactaatagacagagcttcttcagtattgagaacgcagagctttccttctgcatcccgtacagcatagttaaactcaccgtccaaataaatgtgctctacatatggggtgtgccattgaccaggtttaaggatttcaggagtactattagccatagcctcccacatacaattagccaacatctgaatcgtaggatccgcatcgtgccagcaacggaggtggaaaaaattattccactcggtgcttgttacaactgttttcatgcgctgaaacggctctactaagcggttacacacctgcttatggtatccagcaagagcaaacttctcagcatgccaggctgcatttttggcagcttctttccagaactcttcaggagagaactcaagatcagtgtactcgacacggatcttctgatcgtgatcgccaccatcctccatgcctcgctggtttacaccaaaacgaactggcattgcaggattttccacaacctgctgcagcattttgctaacaggtactgcacgagaggacattgcatttctgctgaaaactcggtgtgtcatgagttcagagtgaatgattcgaggatactctagctcaaaagtggtgatacgcttacctttctcggaaatgctgtcagcaataatctttgcagtgcacagttttagcattatttagctctccttgttttaattttggaaatttcgtctgggtttatgttggccttaaatgcaaggtacctgttaaacatatcagagcacatatcctgggtgatcctggaagcatacaccagctttccatccagattatatacctctagccagtctccgtatcggactacaggatctccacctttagaacatctgcccatttcaaataccttctaaaaactttcctattttataccagctatgagtggtatagtcaacactaacctttaactcctcgaattgctcataaggtgtgtcttttaagattttaataacttctggtcgtgaagcaaactggttcaggtattcatgcctgtcatcaattatgacatctacagccacattccctttgaaatgtgtggcatagaagccgtgaccctgagaatgatcgtccagatccataaagtcgctggtccaacgctttaagaaccttgatttagaagctaggtgacctttcttgcacaccgagataaatgcaagcttgtgaccacggcccaccaagtctttcataacctcaatagcaccctcctcaggcttaagaaagtcgtaaaggaacgggtcactccagaaatcaaaaggacctatgatgttttctttggggcggtcaggccaatactttgacagatcgtaatacatcgttccgttagaaggtttagcgattgtcttgttagctgggccatataaacgctctagccactcccaccatgctgttcctgagtctaccagtgtcaaatctacatcaattccgatcagcattgctctcagccctctttagtatcaatatacttgcacacaatctcagatgcacactcccaaggtgctccctcagggttaacgacatcaaactcgataccttttatcccgttcttctctaggctaaggtaagttctggaatcatttccccaatcatatcctgcacggtgtatacggaacaatagcagatctccacctgtgcggtatgcgtactcgctaaggcatgccagctcctctttgaagccaccatcagagtaaacaacaacccctttaccttctgggaaatctttctccagagaagcaacactggcctttccgaaagcgtcgctaccgaatacaggtttaataagggactcgctacaatggatcatccactcgcgaggagaaacgtgctttccatcaatcatcaagaacgggcacggctcttctttgtagcggcgatcataaaatgcattccacaactgtggtgaaatacccgctgccttaattgccacgctgaatagcatttcctttacctcgcggtgatgcgagtttggaatagcttccaacaaaagatctgcgatatggtcttttccagagcttggtggtgcattaagaacaataatatccattaaaaacctccgtgatattctccaactgcatcaatgatacttttacacttatctaccaactcgttagctactacagcatcgtcttcccaaacagcctcctcgatctgatcaagcagtgatcgcatcttctgcatcatttctgggataaagtcttctgaaaagctatctggaattattaactctggtgtcattgctgtctccaatcatactgtgcgttattagaagtttgtttttacacgtcccttttcatcgacttcgttgttagctagaagcgttacaaagtctgtaaaacgaacatgaagaactcttttcttatccaggtaccctaaagccacccctgagaaatttagcatcaaaggggctaaagaagctctggcactgaaatgctgttgttccacccttccaacacctttagtataggatgggttgagattataagttctgaatccaagttttgttggagctttagagttaaaaacaactttatagcgtttcttactcagtttatgctccaggataagcatccccttatcacctttgataagttgaaaatctgtaaagtgctcttttaagacgaaaggtagtgccagccccatggcctgccccctttgaaccgcagtctcaccaaaagcttttgcgtcagtaagttctttagttaagtctatacttttgatcatactgggcctccagaatgtattgtagttctttcttacctatactcttcattcctgcggtcttacccgcttcttcttgaaaagaagaatagcactcgataaacactctgtcaacaccatcaaccaaagattttatgaaatatgttgattctttagattttgggtcatcctcacctaatacttttccggcattatacccaacacgcctcacacagaagtcgtagtcatctggtgtactaaaagaaaatagcttattctctccaatctctacaggacttctattgcagtcctttttctcccagatctggaaaacgcatggcacgtcataaggtttgccactgagtaaaaaagaattcttggggcacctttcgctgtaaacaaggtgcatcgacatatccagcttgtttgcaaaaaatattttttcaaatgttcgtggtaagatgaaggctatagccccaccaagctccaataacgacgcacagtggttaaagaacttgcaagctaaagatgaattcttgccaaatggagggttacctatgaatacatctgccttgggatgcacctccaaaaagtttgcctgaatgcacggtgttgggccttcaaattcaggatctgggaccaaatcgtacgacaatatctctgagaacagttttgaaaaagaaccctttccagcagaaggctcaacgtatgcacaatttccatacttaccttttactttgccaacaagatatttggcatactcgggatctgtgtaatatttgtcgttggactctttcttgctcaaagtgcctccaaaaaggaaagggaggcgcaagcctccctctaagtgttagattatctggatcagggtgtttttcatttcttctctggtccggatgttgttacgatcacgaacaacagacccacaaccttcgcaacggtatgttttaaatgcactcagctgagtatacgccaaagcttcctcttcgtgaaggtgttctccaccgcagcgtgggcaacgaactttcgactcctcgtcctggtagtacagcgacatgttggggtgctgcttagcaaacgggcgagccagcaagtacagaccttccagagacagaatatccccaacattatactcacgcatttgtttaaacgcctcaagatcaccatggacacacttgatccacatttcaaatgtatggtcaatcagcttctgtcgggccagttggaagtatttgcatgcatattccaaggtgtttgcattcaaacggaatgccttcttaatcatcttaagggtgtcaacctctttgtagggacttgttggcggcaacccgtgaaatgcaaatcgttggttggcccacccacagtcaaaacctgaattgtgagctactgcaacatcacatttgtccagataataccacagatcctgaatcaactcaagatcgttgtgaatatcctcaccccacattttgtaatcaggaagagcacagtcaaccacgctaggactgtctaaccacttacctgcaaaagttagcatatagggcataatttcaataccgcaggtttgaatgttggttttatagtgcccaaagaaccagccgtttgttggagatgtctctgtatcatacacccaaactttggcacccttgtgttcttcaaggaagcgctcagttgcctctcctacaatctctgacatattttcctgtgcacgtttaagctgtagtcggatccagctctctcgtgactcacggcctaaaaattcacgagcaatttgtctattagtgtatccctgctgctttagtgttaaaatttgctcaagagttaactttgtcatcatcgttaaaattccttagtaaaactgaagaatgtcttttaaagcgaagtcacgatattcgcccttgtctacatcaaaggcatgcatcaaccactgctcttctttatgatactctgtagaaccaaaccataaattaggttcagtaacgcagcgatctgcaacaacacctttccagttacggtatttcatcctgatcagaactgaatcgcaaggattgaatacctttttcatccccatagaagtctctctcctcagttttctttatgaactcctgcatgtaggcttcaatagcctcatgcttagtgtactctggattaatgacaagatcgagatccgattctgctcgtgcaataattgtggctttagagcatctcctcaagaactttgtcatatcgtctctgtagtttttgtggagcgggaagtcgctgtagtctttctccagatagtcagccatccggcgcaacgcctctgataaactgcaatctgtatactcgttacagtatttcatccagtacttaagcacatacccttcaaaggtattagtgcattgggacaaaacacccctgcaacgaccagtcagatgatcatgatctaaacaaggcttacgaagtggctcgcacaagatcggatcaaggccatcctgctcttctgacaattctttccgaaagttggctatgtccttagaatcttttagccacccgctatgaacaggggctttgacagctttctttcttattttacgctttgcgataatccctccagatgcgccctgcctatccaataggcatctgcgagatcggccttaccttgtaccaaattgatcccatccagaaaccctggttcagatacttcacaggccttaaccattaactttttatccatcgtaacaggtttcttcacagtatgctctttacctgtctttttgtcaagctttttcttctcctcaaaagcaagttcttcaggaagatgactacgagcaaactttttggcggttgtcggtgttactgtgtggaccttaaacaggccgtcattttcacaatctgctaaagcatcccaaagcataacttcgagaccgtaaaacagcccagctagttcacgtgtggcatccccgcgcgatccaaatgagagcccttccataaccaccgtgtcgatgccgtgtgtgtggatataatatctgacctgtttgcaaatccagtcaatacgctcagcagctgtcgcaaaagaaaccgtccctggtttcttctcttttgcagatgagctttgagtgcgtaacacaactttatgaacaggctttccatcgtcccatacaacgcaagctgtgtgtgtcaacgactggtctatggataatagacgctctctcatgcttcctcaccctcctctccttcatcaggagcataggccttatctttgaacaggacaagagagcaaagcttgacatctgtttccacactggtgaacatgcataaccgctcgccctcaataagctcacaatcctcttttaaaacagcagaccatacacggtcatctgcgtaatcatcagtatataagatgtatgaaatggtgtcatcttcatacaaccgccacatacctgtggcaacaataaatgtattttttgttttaagtgtccctgttgtatgatcatcctcaaaaacagcttccataattgcgttatctacagcatttttagtcatcagattgctccaacatttctaagaacgttaacaagttttgtttggtcattaaatgtccgcttcatatacagacagtcaaaaattatactcatccattgacctacggaaattctacgatcaataccattgaagtcggtatacttaacaacacctttcgggaaccatttcttgtactgatcgataatagccacccacatctcctttggagtgttgcactgagatagcaggtagaatgctgaggcatctccgaatttgcctttaccgataagtccttgatacggcttgatgttatcagcagagtcaccacacagcatttggtatccgaagaacagcattccgtaaccaccaacttctccattaggcttcatgaagatgttccccataccgttatcaatcagcataggagtctctcttacaaaatctcctttatcgtttctcatgggatcgaacacaagcccaggtagtgttctttggtccttatcgatagagataataaacttgttgaacttacctgttttttggtagtggttccaaccttcaaattgctggatagctaaccagtcgtcagcctcgataccgttgatcacttgagcattatactgcttttggagatactgtcttgcatctccaagcagcagtggtcgaagagtattgttacggttggctttgtatctttccggcattgggagatctagtctgaagttacctgtacctcccaacaccccgacacatcgatcttccggaatacccaggtagttaagaactgcatttgccttacatttgattgtgtgcaagcagttctctacaggatcaggcgtttggatatccaagacatcgaaatcttcacgtgtccacggaataaactccttaccagactttttgcatgcggcttcacggttggtattctcagcttttaaccaaccaccaacggtgttcttctgccgcccccagaactctgttcgtgttttaaacatcttcttacgtccggaggctttgtgtgttacctcaattgtccttttttcacaacttgccgcagcttgatatgcaacctggtcgaagtcataatagactatagcgtcaggttcgagaagatcagcaagacaatctacagattcaataagtggatattctctactcaaagcccctcctgttagttattctgcaagatggttggatgctgtaatgaaatgcatcatcactctctgcaataagtgactcaacatcccaatacttttcaaaaaggaacggattagaaccccagtggtgggttattttcatcagggagtctggtatcaggtagccacagatcttaactacatcaccaggttgaattgtgttttcatgaaggttgtttgccttcttcagaatcatacctttgtgattctcatttgcatacaactggacaatatctttatcttcaacaataaaaattttaagcatacctggttctcctagttaataaatagttaactgataatatcagatcagaggctcatttgtcaagactttttagtctttcttggagagctttttgttgatcttttcctcttgtggtaaattccaagtgcagcattttcttgggcgcacgttttaacggtttttagatcagagctttcagctttaggtagattaagctcccaccaacccagccagtaaagttctgattccgacaactgctcagattcagccttccgatataaggcttgcatacctctgaggatatcgtccagaggtgtatcgaatacaaaagctgtcttatcgaatttctcttttacaggtttcttagccatcaaggtaaccctctatccacgaaaagtcagtcttccattccggaaccttactaagctcacgccactctgcaaaacaatctctgtagtaagcttctgccatacctttagtgatcttattcaccttagccaactgattaactgcctgagcatactttccacggatatttgccaaccctggatgcaccgatgtgtgacagtctgggcacaacgctattagtcctacaagccggatcaccccctcttcgaaagtgtaaagttcatgacactctactgggtgtttgctgcctttaccgccgcacacctcacaagtgtagttggcctccctgtagcacttcttacggattttatcccactcactcttcttcacagcgtttcgtaggttattataccaagctgtttctgggatcagctgcacaataagcctacgttcagacttcattaaacgaccgtcttccacgtaacccccgctcattcaaagaaatgggtgcgaggacaggaacctgcctcgccttgtttcacaagctcataaagttcaccttggcttgtctcataaaggcaaatacgtttaccattgtctcgatatacatcgacaaggtacgctgtttcacctgcaaatacgacaccacaggccaaacatgctaccatgaacaaaattgccaacagaaaatctttcatggttaaaccctccttaatattttatgaggaaacaataccacgtccgtgtggttgtgtcaaccattaatccaggacaatcccacctgactttttaaacacttcgatcaacttatcgatcttctgctcgtgctgaccgtaccctgcaccggggaggctcgcccatcgggatctgcagagatgaatagccttgtggatacgcccttcatcaatatcatcaagtgccttgcactcacggattagctgtaaggcaatcttatcctgactgtcagggccaaaatctggcaatcctaactgattcatatagtgtttagcaaacttctccaaaacttggtaacgaccagcagcagaggaggtaagtttagaatttagcttaacgtacacacctggatgcttgctgtaatcgctaaacagcttgccaccaactatgacatcgtatccccgatccttggtaggttgtctaccattatctgtgccttctgaatatgcgatcatatccaagaaagcttttcgttgaacatttttatcaagtttcattttccatactctccagttcactcataacgaacccgatcaacaacactgcacagcatggttatgttgcacagtgcgaataccagggcatatacaggagacaattgaaaaaccatcattcaattgacctccgttacctactaaaccctacattattccagcacctcccaagtgtctgggttaacatttcggacgcatatagccaccgggaactggaagttgttatcctctgttcgcgcctgatatttaaaagtcacaaacttaccaatcaactcccgcatccggtcataactacgctcctcgtgcgtccctttcatcttcattttaacaacaataccttccttgtcaacacagacaagaacaccctcatcgttcttatccttttctacatccaccactttggcttccgtgtcgttgaattttttccatttcaacgcttcagatgttcgctgaccatattcatatttaccacagaagttacgcatgatagtgccttcatacccttccgacataaatacacccacagattcttcgcaacgatcaactgtgtacgcaagttctgcgtcaacaaccttgatatggtcaagcatcaaagtggtaacggtatctcctgcatccataagatccttgcagcgtccagactctgtttctggatcccaccataccttatcgctagggatgtcgaaaatgtgatactctaagtcataactgcagtatccaccgtagcgcaaatcatcacgaacaggctcaacctctacaggaatatctaccttgttgaagtttttatatgttgccaagcctgccttaattgcagcagaacggcgttttttatctgcctcgtagtccttatcaatctcggcttgaatatcctcttgtgtgcgccagcgtttagccagagacactattttctgcagaggaagaccatgaagatagatctctccgtcgagttgtttaatcccggtggtgaagtggaaagaacgaagttgctccagaagctttccttgaataggataggacttattaccacgggaaataaatttaggctcaccattctggaaaacaacaagtagacgaaggccgtccaacttacgcaagatccagcaaggtaatttaagtgccttgctacgcttcaggtagtcatgcaccagcatgggtaaaaggtcaacaccctgctcgcaatcttccatattctcaacataccccaggcgaacttgtttttcccacttactgatcgcttccagctcggcctgttgctcagctgtagtctcgttggatcgacctacgttcttaggcgtgcatactgtttctttatactgcaatttaccgccaagcttaccaaactctacgataaccttttcaccatctgtgaatactttccactgctggtaactgccatctttgtttagtgcgtacagtggtgttttgatttgatgcattactcagtctcctccttaaaaattttaaacatttcttctttactcattaccagccagtctcccataaagtcaactaaccaatccccctcgtacaagaccaggttaccaaacggctcgacaagctcacacatgcgacgaatatctctggtccgaacaggtgacgatgtaaactcacctgtatcaatccaccgttgcagatcagatgctgatgaagagctcccatcaaactggtgtgcttctacaggtttagcaagattaaataatggcattgcagtcctccttctctaatagatcttttatcgggtaaacaagcagatgtggatcgtgataacttatagtcttattctgccacactatgaacttaattacaactaaatttactacatctctatccccatgtagtccaacacacacatttgtccatattttgtggttgaagaccttgctgtcgatgtagatcttagtgtcaaacttatcctctatcctgcctataagtttaaccaattctctcatctgatccccaaacacagcatcgttttcaagatacctggagtgcttgtacataactaactacctcactttcctactttccacaacaggtaaagccgggtaacccccggctatgttgttaaatatactctgttacatccttgaagcttgaaggcttcataatcttacctttgctgtcaaggaagatgataaccttattaccgttgtagaattcttctttagcaacaaaaccttcatatcgaccatcgaagcgtcgctcaagatctttaatctctaactctacaagttgttcaacaggcatatctgcactggcaccgtgtgaatactgtagatggttgacccgtgcaaacttgctgtcattagatttgagaaccttccgcatcatcccgcacacatcaccgcgaagctggaatagcaaagctgttgacaactccgccaggcggtaagcagaggctttttgcttggaggtgtttttcgcagcgatcagtgtgtcatagaactcaccgatcttaaacttaagacctcgcggattatcaaacaggtttgaccacttttcatgattatcattaacaagataagcggcatagcttgtaacaacatgaagatcgcaggcctcttttagcagatgatctccaccatcacctttctccagttcttccaaaacttcattaaactcttcctcaatgaagctaagctgtaattcgaatggtgtgtatgattttttcactttggctgccacacggttccagttttccacccagttggcagaccaaaggtagttttcaggttgggacagtttttcaagattgtcaattaacttagtattcagcattaaaggtctccttttaaagttccatgaagttttctacagtttcaatcaatgttttatcagagaaggcgtcaacagccccgttaaaccaaacaggaatgccgcgatcctcatactggtaaatgtcactacgtgaaatgccattctcctccaaatgctgtgagtcgtatttgttaacaatcaacagcttagtgcccttgttacaggcagggaacagctcccagttaaaattgataactgtgtttgagcaccctacaaggataaccatatcattgcttgtcagagaagtcaataggtcatacatgtctgtgtactttggagcaacttctccgaagaataccacattaggcttaacccaaatgtactctcctgcatctacctccgaatacccaacatctttaatgacattacttccttcatcgtcctcatagactatttctggcaaatacccgtggacatgtaaaatgtcttcatgttttacaccagcacgctccagcaaatcatctacattggtggtcaggttgatcacacgaccagaccagcgagaataccactcggcgatccggagatgtgcaagattaggctcaacactacccagagctacacgccgtgcattgtaaaagtcatgcaccttatagtagttcttggcaaaggtgtggatgttacacacctcatcgatgctgaaattctcccacattgcagtgctaccagatcgaaaggtggggataccggattcagcactcaagccagcaccagagataataatcagtcgtcgcataggtgtcctcagtaaatgttctgtttgatctctattccaaactttctgaacgaatctgcagcaagcataaatttacgagctgctgatgggttagaagtatgcacgaaaatcttcacgttgtcaacaacaggtggcttgccaaatacaaatttttcctccaacacagagaagcaatcgtacccctcaaagacttctcccaaatcattgtcaaaatgccactcagatacgcgtctgtagagctttcccttgtcgttaatgaaatccataaactcctccgaatttttaagccagatggcatctgggagtccgtgatcggacggatctctcaagtcatcaagccacacaatcaacttcttcattgcatatagtcctcgttgtggaaatagcagtcaagtatctcacggcgttcctgctcaagtaggcagttccacacatcctctgtgtagttgttacgaatgaagtttaccatgccataaaactcttcgtcaatacgtttaaagatatcctcatcccaaatcttccaagctctccctctcattacggccttccgtgccaggtagtatggagatttgatcttcaactgcaggtcataagggtagtatggattacggatcatgtacccttcaccccttgtttctgcagctaattcttttgcatagctgaacggaatttcacgcacagtgtgaggacgttttgcaccaaggtatttggcaataccgtctaaagccgcctctggtagcattattccagaatcattgtatctacaccctatcaaatacgcaccatgatcctcatgaacaatatgcgggtctgaagggtgacaaatttcaaacataaatgtcatgttttcatggcccataaccttcttgataagatctaaattgccacattgctcctggatggtttcctttgcaaggttacaatatggagaatcaagagacccagtcgttgagaataatagttcacctttatgagaggataccacgccaaggaacccgttctttttctctacagccgtcacaagcttattgtcaggtaggttggtggagttttctcccaagttaaacacttttgtgaagggccatgccacaacattcccctcgttaccgacaacaatgcctcgacactccagtagacgcggagacaaatgccataaattgttgtagaatacttttctggcatatttgtagatctttaatccgagatctggataataccgactggttacaagacctttatccactaaatcatctgcattaaaatacttcatcatgcgttcctcatttgtcattttgttccacaatcttcccacacaaacagtatcatgtcaacacttgaaatgttcaaaagaacacggtatactgtcgttaaaattaaaacggagggtcgctatgtctaaaatgctatatatcgtgcgtggtctaccagggtctggcaaatcaacactggcaaatgcgttatctttagaaggtctgtatccacattttgagaacgacatgttctggtacgacgatgatggaaattacaactgggatgcaagtaaagtgacgcttgctgcaaaatggtgcaaagataacatagaagatatgatgcgtatgggatacgaccgtgtcgtggtaagcaacacattcacaaaagaaaagcatgtgcaagagtatattgaaatggcgatccgtaatgggtataattacaccgtaatcgtagtggagaatcgccacggtaacaaaagtatccacaatgttccagaaagggttgtggatcgtatggaacgtgaactgaaaaactgtattaaacttaaatgaggatagtatgaaatattttataacaagtgacacacactttctccaccagcgtgttatggagttcgattcttgtcaaaagcacagatcgcagtataaccacgatcttgatagcatgaatgcagggatcatagacaagtggaactcaattgtgtcaccatgggacaccgtgttacacttgggagacattgcatgcactaaggataagaatatcaacaacttactgcctgaaattctaaatatgctgaacggacatattattcttgttcgtggtaaccatgacacagggacgactgtcagaattatgaaagagttctgtcatgaggttgtagattattacgagcttcgccacaacaagaatctgatctgtatgagccattaccagtttgcaacgtggaacagaaagccccacggatcagttcaactgtttggtcatgctcacggaaccacacaacagttatttggcaggcagttggatgttggttgggatgtgtgggggagactgttaccgctagaagaggcatacggccttgcaatgagttttgatattgacagcagggagtaatccctgctatattaaagaaaatagccacacaaggagaatcaggagatatgaaagatgaggataagctgccctatcttaaagtcccgcttgggatactttctctgtcgaaagttttgaatactgcaacgggagaggtggttattcttgatctgtatgacaaggtagtatactgctatctgcacaactggtataagcttggaggaaattcacgattcacaccaagcacaaggaaaattgcagctgatacagggattaagaaaacaaaagcagcagaatgcgttagaactttggagtgtgctgggatagttgaaacttccacacaagggagagggaaaagatgcacattttctaaagttttaccaccagaagaagtgattcacatgtcgacaactggttagaccagtaaaaacttaaatatttgtattataaaggtatgtatgttttatgtccacaccagcacaaagattaccaactgtccgtgagacggacactactgtccgccacgcggacacatctgcccgtaatacggacactactgtccgtgatacggacacataaagaatataactaaaataactaaagaataaaaataaaaagatctagtacttattgtactaaagtacatatacttaacttatgtagaatatactagatctaaagtactatgttttaaatttattacttactggtatagtgtcggcccttcattggcactcgcctatgaggggcgagatgccgggcctccatagtgcacacaataacaggcgtgcatacgtgcatgactgttcacatgtgtgggagcgaagctatagcgcaggccaaaggccgagcactaatgtggaccgccgacgaaagcttgccagcgccgtaaggagtcggttgagagtctcccgcgcgagtttgtttaaagtttatgtgtggaaactgacaagaaggcctctaaatcgctctacagctgtgtgaactacactagataaggcaatcccaccagtttgatagaaaagcttgttacaaagcgatacagtgagtttttctataacctgaagaggagtcagctatgagctcacgcaaacatgaccgagaaaagattgcaaaacgttatcaggatgaagaacagatggagaaaactttcaagtggaagccgggtttccagcgcaatcattcggacgctcgtgatcgtaagcatccagataagtggttaacaccgccaaacgatgacatgcaagtcggtgatgagaaggagttgtcaccggggaaagatggcaactacattcgcactaaggaagctggtccaaaggatgacagctatcttgtagataaggttcttgctagtattgatgtagatgttgatactgtacgagacactttccttggttggtatcgcacagggtttttcgacatcaaggctattcgtcgtgtttgcgatattaaaaagtctgcctacgatgacgactctctacatcgcactctaagacaatattcagagcgatacggtcatccagttatcactcttgacgatattaacgaagtgatgtatcatgtagaggttgttgcaggtaggttcggtgatgcatatctcggtattctttctgcaaaggatgaggtaatgttaaataaaatttactatgaacgctgaggagagctaatgaacaacccggtagcaaagaactgtaataagttcaacaagtctgcaattcacactgacaggaaaaagagctggtctccggatattgacgaggagcttgaggattacttcgaaggcttggcccttaatgcagatgagattgcgattaaagagtacgcagacaggaaggataaggccggaatctgttgacaaaaacagtgttacctgataagatctgcaatatgatgtgatgcaattttaacttacgaggtctacaggtaatgctatgtttaaggttaagctcgtttttcgttccatgaatgaggattatttagaagatgaaggtgaatttcgtgcactggatgatgcaatagattttgccaacgacttagcttgtatgaatactggatacgggttatgttgttgggatggcggtgttcagatcggtgacagcaagattttctacttctaccctgagccagataacaaacaaattaagtatgttttatttatttgcgctttacaatgaggttgttttcatgtatgatgatgaatatccaatttaaagacgaatttgatggttttatctccggatgctttgaaacaggattcggagaaggctgagttccccttagagggcttgatagtgcaccacacttaaaatggtaggggcagccagcacatgacgatgtgaccccagccaacctgtaataaggtcgagcccaagcgcggtaatgggtctctggtaacccacttgttgggtcttgctggtccaggacgctggacaagtcgcagggaacaccaccctgcggcgaacttgacaattagtatctgccgtgataaaatccacctatcacgtgataatggaggaaacatggcggatacaactaaaaagcgtcgccgtagaggcagacctctgaaagaggagtccaacgccattcagctagagaagaacattcttgatatgaaggaatcttttatagcgatggttccagaagctcataaagttctaagagagctgatgttggatccgaaaaccaaacaaaatattcgtcaaagcattgcagagtatgtccttgacaaggcagacagaatgcaggaagaatatgatgagatgtttggtgaagaggaagaagaggtggtagtagaagaggctgaaaaaccagcaccttttatgccgtttaccaccgaaatacagcctgttagcaacagttaaaatattttcttgacaaactttgcttaacagtgtaatattataaacatggtctcccaccttttctggcggctcaggtgtaaaagaaagccacccagtgccctgttagcttagtggataaagcagcggccttctaagccgttgacactggttcgagtccagtacggggtgccaagttctttttaatgtagcttactttagcagagtaaatcttcggcaagtggcggtaaccactttaccgatacctcatagttagtggtgagaacactagctattttaaaaagaatttaaatattagtatttaggtgagttaattccgtaggggtagcggggcagactgtaaatctgttatcattgcgattcgggtggttcgactccatcactcaccaccaaatttatatttttaaatgcataaatcatacagataatggcattgatatttatcgtcgtttatactagtcactaactgctcgaaaatcagtgtcattatcagtattgtttataaaagagggtagggagcatggtgctcaagcggtcttgaaaaccgtcccgttgagatatcctcgatgatggttcgattccattactctctgccagatcgtggatcatgaaattaagcgagcgccggaagcagaaccggattaacaaatgttacagtcgtcatcgccgactagcagcatgattcgcataatatgctaggtaggccctttggcaagggcgaggatttttaatcctgaaaatagacgaagtagtcgttgaatacataggtggttcgattccatcgcctagcacctttttgctgatgtagcacaattggtagtgcaattgatttgtaatcaataggttgcaggttcgagtcctgccatcagcaccatggccctgtagctggaaggttcaagcaagcgactcataatcgccagacggtggttcaattccacccagggccaccaaattataaactccgcgtagctcagcttggtagagcgcctgatttgggatcaggaggtcgagtgttcgaatcactccgtggagaccaatttcaccataccttaaacatatatacaaaaggaatcctaaaaatgtatacacttaaaattgtagaacgtgtaaatccaacccatactgtagattttcgtgacgatttcaaccctcttgctgtaaatcttcgagagtcgtatcatgaactaagctgcgatgcagtagtggtcttctttgaagacaactctgaaggggcagtagcttgtgttgttgatagcgagcagaagttttatatttacagagatgtggatgcttacttgatgaatgagaatgcagttactgttagaatcatccaccgagtgcctcgataagtattagtctccttttagttagtttcgatctatttaggttactcaattttaacccgccccgttagctgtatggctgcggggttttttcgtttctggagccgtaaaatgatttcagttttaacagggctgggcaggtacaaaggggtcataaaaggtttagtttttgcagcaactcttggtgtagcctatcttggtgccgtatattggtttaattctaagcttgacactgcttaccaggaaggtgtgacagcaacagagttgaagtgggaacggatccttgatcagcaacaaaagcaagcggacaggattaaaatgggccatgcggaggaggttaaaaaccttgaaaaatccctttctgacctgcaggataaattaagtatagctgagaaggcaggtaaagaaaagcagattatttacctacaatcgcctgagggtaagaagtcaacactccctgatcagcttatagagatttataatgagagtataaatcaggaggggcgatgagagttgctacactacttattatatgcttgttattatgcgggtgtacaaccaacgttgagagagagtacaagattgaccctccggatgtaggaaggttgattgttaaacctccagagggtgccatgaaaccgcctgctaaagccgtgcctttgaagaaaggtgctccggatgcggtgaattctggcattatgagggataataacctgtcttgtagtaatgatagggctaaattgatcattttgcaagactatattagaacactgtttccaaaggagagaggttaatgtctaagatttacggaccgtgttctgaaaagcagaagatgatcctggaaaatgatgcagatattttggtaattggcggggcagcaggatctggcaagtcattcctcttgcagctaatgccgcttaaaattattgatgacccgcacagctctgtggttatgttccgaagaacaaccccacagttggaaggtgagggtggactatggcctaaagcagtagctatttatagtgatctgccagaaaacattaagccaaagtttagagagaaggatcataagttcatttttccacggtttgatccgagcactggcaagtgggacagaagcaaaaagggagctgttgtaaaatattgtcacatggaatatgtccaagataagcttaaccatcagggtttggaatacaccatggtttgcttcgatgagggcacgcagtttgaatgggagcagatagactatctgatgtctcgtttgcgatctcagtcaaagtatccatcaagaatggttatcagctgtaaccccgattcagagcatatgcttgccaaactggttagatggtggctggacgatgaagggtatccagatccggagaaatgtggcaagaaaagatattttatccggcgtgacggtgaatttatttggggagactctaaagaggagttgatagagaaatacaccacggttaacggactgggtgtagagatcaagccaagacctttgtcattctcgtttataggcgcaacaatattcgataaccctgtctgcttgagagacaacccagaataccttgctttccttgaaggtctgccagaactagaaaaagctcagcttcttcatggtaactggtttgccaaacctgagggtgcgaactactttcaaagatctttccttcgtgatgccgacagcgtacctttagggtctgtgtcttgcagggcatgggataaagctggaactgaaagaacttcaggtaataaattccctgactttactgccagtgtcaaggtaagtaaagatagtgatggattctactacctgtcaggagattattgtccggagaacgtggatgacgggaggtattccacaggtctggaaggcaagttctgtaaaaaggctggcgaacgagatgtgatcatcaggaaacaggcgcagtttgatggtgatgattgtataatcgtattctctgtggaccccggtcaggcaggtaagagtgagttcttaacctcatccagatccttgctcgccgaaggtttcagggttgaagaagacccaatgccttccaacaaatctaaactgacaaggttctcaccttttgccaatcttgcccaacaagggatggtgaggattgtaaaatccagtttccatcctgatactttggaagcatttctgactgaacttgaaaagttcaacggggaaagatcaacatttaacagaaaagacgactgggccgactgtgtagcatctgcgattaatttcctggagaaagaggaggtagcactgccttgtgtgatcccatcaatatcatcaccttctatgtttaagcgttttatctaagtgttgccaatcttgatcagatgtggtacaatagagtaattggagatactagccctctgacgagggctattttgttatactgttttgaggggtaaagcttgtgtccaaaaagaaccgcaggaaacacaacgccacagccaaaactgtgaataaatctgggaacgcaggcgcaccaactcataatgttcgtatgagtgagatcggttctggcgcactttcccaaattatggcagaatcgcaatctatgatggttgaggaattgcgttggcctcagctgattgccacagtggagactatgaaatgtgattccacagttgctactgccttagatacaaaatatgttttcatcacgaaagcatttaatgattttaagatcctttataatgttaaaagtgaagactctaagaaagctgccgagcttatagagtattctttgcgtaatttggcaaaccaacaaactcttcgagatattgcaagaagcgcagctacctttaacgagtatggtttttcactgtttgagaaagtataccgcagagagaaagaaggtaaatacgccgggatgcttcttattgataaaattgcattccgacctcaggccagtctgtccagatcagagccgtttgtctttgacaagaacagtagaacactgacaggtatttatcagtcacctaatgcatttctaaacaatcagaatgcacgctgggctggacctcttgctgcaatgccttcaaaaggctttaatgagcctgaaattttcatccctgctaaaaagcttatgctcatgaccctgtcaggaacagaatctaaccctgcaggtgtgtcaccgatgataggttgctacagatctttccgtgagaaagttctgattgaaaaccttgaggttgttggctgttccaaagaccttggtggtgtgcttgagctgaaaattccttccaatatcttgaacaaggccagcattgatcctaattcaatggaagggagaatggttgcagaccttatgcttgacgcagcaaacgcccatagtggtgagcaaagtttctttatacttccgtcggatagagataagtctggtaaagagctttactccatgaccctgaagggtgttgacggtatgggtaagcagtattccactaaagatttgattgatgcccgtaagaaggcgattcttgaccgtttcggtgctggatttattaacctcggtaacgataacgttggatccttctctctgtctgagtcaaaacagtctatccatggtcattttgttcagcgtgatatagatattatcactgaggccttcaataaagatcttattccacagcttctggcattgaatggtatcatccttgaagatgatgatatgcctaaactgaaacctggtctgattgaagaggtggacatggagagcttctccaaatttgtccaaaggatcggtgctgtaggttacttgccaaaaactcctgcagtaattaataagattcttgaagtaggcgggtttgatgaaagatttgacgaggacatggatcaggaagagctgatgaagctattgggccaggatatcagcagagctggtgatggaatggctgcaggatccactggaaacggcacttctaagatgtcatcaaccagagataattccatatccaacatggaaaattaaaaaattatcaacacagggggttgcaaaacctcctttggcgtgataaaataatccacatggggaataagatgccacaggaagaaatgatttcctacgaaatcatctacgaacctgacactaaagatgctcacggtgagtggatgagtaaagacaccatcaaaaaggctaaagacaactgggacgcagcatacgccgcaggactagtttctgaaaacctttttcacttgacctctacagatgctttcactattgaaaagacgtggattcaagaagagtttgatgttgtagtaattggcactgagcaggtcatcaaggctggctcttgggttgctaaagttaaatacaataatcctgaattatgggaagctaagaaggctggcattgttggtggcctaagcattcaggcaacaggtaatgttgatgaagaaactggtgaaattaccaacgtaaacttcgggatcagtgttgtagaagagggcaatgaataatgtctgaaaaaacgattactattaaagagaaggggattgccctgtgccataaggcgcaaggctatagcgctaacaatcgtcctgtatctcttttaatgaagagtgatcttcagcctgagcagttgacagacgatattgttaaggcacttcgccaagtcactgtggagcttagttttgaagaatacctgcgtcgtttcttcgatatgtggtatgacgatgccaaagcacttgcacacatgcttggttttgagattgaagaagaggcttgggctaaagagcatcctgattgggaatgggcgcaagctgacgcagagtcttgtattgcatggctggaagagcgttgtgataacgtgaccattcataaagctgcaaaagaaggcaagcagctcagtgtggtagatcagtatagtctgttaaaaacacaacagatttttgaacaagtaaccgctgatctcttcgataaagaagggaacctgatcaaggcggtacaggaacctgctgaggtggataaaactgccgaggtggatgatatttcaaaatccgcaaataccgaggagaatccggtggacgtaaccaaaactaaagagtatctggatctgctgaagcaagtagaagagctgaaagcaacccagagtaaagctgaagaaatcatcaaggcccaggttgaagttgaaaaagctaaaatgctggctaaagctcaagctttaagctttgttggtgaagaagatcatgcaaccctggttgacttcatgctggaaaaagctaacgaacctatcgtagctatgctggagaaagctcaagccaaaattaaagagctggaagcagaggtgcataaaaccaaagaagagtttgccaccactgaacatggtaatgatggcgaacctgttgtggatgatattgcaaaatccgcagaagaaattcttgctgaaaacgttgcaaaagcacttgctcgtgcacgtgcagaatctaccaaataagacattaacgggggaaataaatgattaccgctcaatattctgatatcgtgctcggcaaagttgattctagcgatgctggctacaattttaaagagatggaaattacactgacagagcatcaccacgctggcacggttgtgaccaaagatggtagcattgccaatcaggacggttcagacgcttacggcgttctggtggatcgtgctttaattccagactctgctggtaaagtgcatatcgctgaacctcttggcacaaagaaatataaactggttgttgctgtacgtggtgttacttttgccaaggataaattgctggcaactggtggcgctaaagcagcacaggctgtgttagacaagcttgaggcccttggtaacaaggttcaagtccagacccttggtgatgagtaagccctaaattgttcgggaaatatttaagttttactttggagaaataaatgattactcgtaaagatgaatttggcattgttgatttaggtgctactctggaacttgttccgcgccaattccgactgattactggtatggatctgttcgaaacccgtctcggcacctcaacgattgctcagatcgagcgtgttgatgaagttgtaaccgacattccggcacgccgtcgtggtggtgagcgtaactacgttggtagtgaacgtgcccaggttaaaaacctgaacatcccgttcttccctctggacaaaggcatcactgccgcagatgttcagaacttccgtcgttacttcacccctgatgctccgaaaactgttcaggacgtagtaacccgcgttgttcgccgtatccgtgtttctcatgaagcactgcgtgagaaagcgctgttccaggctattctgggtaaatcctatgcacctggtgacaccacctgtcagtatgactactacactctgtggggtgttgaacagaaatctgttgagattgaccctgcaaaagcagatcaggatcctatggaggttctggaagaggctcgtctgcacatcgcgctgcaagctggtgataacgcagctggctatcgcatcgtagctctgtgctcaccggagttcttcagtgctgttacccatcacccgctggtagaactggcatacacctattacggctctgctcaggaacctctgcgtcgccgtctgggtgctggcggtcaagacagcgtataccgtgtgtttgaacataaaggtatcacctttatcgaagatatctctggtaatattcctaagaaagaagctcgcattctgccgatgggtattgatcagatgttccagctgcactttgctccggcagacgatgttaacgaagcaaacactccagcacaggaactgtatatgtggtataaacactcttcatacctgcgtgaagaaaagattgaatctgaaacttccatgctggcagttaacacccgcccagagctggttgttaaagcaactctgaaaagtgaataatcgctaaggtgattcatcccatatggggagggggttctcccctcccctttttatttattagggtttaacaggagcgtcccgtgaagagagccgtatatccagtcgagtatgatcctctattaagagttttcaataaccagttaagtttctatcaatttttagcacaatataacccagagatcaatgttggtttatcagccctgctgccaccaacagaattcgttattggcagtgttcattacccgtgcagaacaattgtagacttcttcaagaagattgcaaaacatacgggcctgccaatcgatactggtatttcaactatccgtatgggtgttattcttctgttcttcacagagaaccttgatgaaagcactttaacactgcaaagcggtgatgtcaatatcacactcaccccgtcagtctttaaagaagtagatgctgctttcaaggtttccgtggcagaaggttatctgtgggatcctgaagggatgcctaaaaaagtgaccataaacgatgagcaatgcgatgttgtttatgcagctgatacccaaactttcaccattgagtggcctaagaaacgttctcaggttgtaaatcttggtttgacctctacagtggcaccggaaccagctccacctgtgccgcctgtaggtcctactgaacctggtggtggtgaagaatcccaaggtccgactgtacctgaggaaggcactgagcaggatcctgaacgggcacaagaatcaagatcttctcgcagtgatgttgatgccgtgctacagcaggccgcagctcttaacaacgaagatgacaaaagtggttcaaaagatgcactccaaaccttcgccaaagagcacggtgttaccttaagtaaggcaaaaactttccaaaatatgatgaaagattttgaggctgcactggcataattttgttaaggccccttccaaatcaggaatggggctttatttttatgaggtattatcaaatggcctggtatgaagatgaagagattatcccgtccccgcctaaccatgatggtgtagtcgataccccagaagatccaccaaaagaagatcctgtgcctccagaacctgatccggaccaacctcttattgatattatgaggttgttgcttggaaatgttgatgaggaaacactccctgatggggtaattaaaacattcctcgacatggagaagctgaaattaaattacccagcagaccctgataagctaccactacttaagtacaatgtgcttgtgcagcttgtgcggtggctgatgatgcaagaagtgtccagcggtaatgcaagtataacttcccgtctggaaaaaataggtgatgagaccatagagattcgtggtggatcttcctacgcccagtggaaagatttccttgattggctgctggcacacccagactatgtagattctgatctggatgcttatagcagaatgatcattatcggtggtgttcgtgtagacgaaggaattcgggttaaatttaatgaaaacagtaacggcccgttcgatgttcaggggattacacctattagtggtctaaataatcaacctcctcgccacccaagacgcaaacgcagtttttaaaaattgttgcttttgatgcatctttgtggtaaaatacattagtgaggaataataatgctaaaggttaaatgtcaaacaaggttcaacctaaagcgtttagatcgcttttacaaagaacttgtgaaacttgagagcaaaacaataacctacggcttttatgacgaacctcacccttcgggcttaaatatggcgacattggcagctattcacaacttcggttggaacgggctgcctgttcgcaattttatggagacagcctttgcatttcacagcactcaactgcagaccttaacagaaaaattgttgagagctatggctagagggtcaaatgcagaggccattcttaggcagatgggggatacaggggccaaagctatccagtttgttattgaggctgggcagtttagtaatcctacggttagtgagcagtgggcacaagagaagggcttcaacgaagctatgcggcattatgatgtgctgcttgaatctgcaacctttaaaattggacagcaaaaataaggggggttgagtggcagcaggttataggctgataggaaagaacaggctaatacctcgtaaaacattcaaaggtcgccacagagtgtataacaaaacaattggtgggccttttgtcaacgaggggttagaacttgaatatgaagagtttgatgtcttagagtgtgttgtgcagccgttgacaggaagggcagctaaagattactcctctcaaataaaccctgagggtgacagacagtatgaggcttttacagtttactcatcaaccaagttgtatagtccggatgaaggaacgtatgcaatggctgatcaaattcaactgcctgacatacgtggtgacttgaaatggtttaccgttttaaagtgtgatgcatatgtcacgtctggtgggggaagatatagattttttgtggtagaagagcctgaaggagaaaactaatggaagctttcgaaaaagttttttctgatcttgaaaccactattgctaaactcgtcaaggttgctacaggaagaactgtggttctggcagaaagttctaccataccgaagccggaaggtgagtttgtacttttacaaacattggcgatcaatcctaccacttgggaagacaatgagtttcaagatgcggagggtaatgcttacgtcacccacagttacactgttacttatctgttaacagcttatcgtggcagggcatatgctgcactgagtagagtactgcaagcaatcaatctcccaatgttttatgacaagtatttccctctgggatcgtgctttgcctactctaacaattcaacaatctcacctcaaagggtgccgttgaataagcagacgtatgaaaatagagccactgtaatgttgacatttaacgtaaggtttgttgagacagacattggggcttttgaagatctccagggaatcaaggctgaagtaaccacacatttcccttcacccgatgctggtcaagcggttacagacagcggtcagtaatcgttataattgtgtagtgtaatgattacactgcgtgtttgatatccgtgcacagatattaagaggaaacaaatgccatatttagataaagtggtagatgttacagttaacctcggaacccagcctattgacactgtaggtttcgaaactcccctgttcatcgctatccacaataactttactgagcgagctcgcgtatatgctgagctggaccagatggtggaagatggtttcgcacaaggctctgcagcatatgagtttgcagcaaaagcttttggtggtgtattccctccacagtacgttatgatcggcagacaagccaaaaagaacacgactgtagatttcaaaggtattgctgccgcagctgatactgatgtcgtaatgaccattgcaaaaggcgactacaatactgccttgatagtacctatctctggtggaactgctgcaacacagattgcagaatctatgaagtcaaaaattgaggcagatgataacttagaggatattactgtagaggcttcagaaggtgttatcaccattactggtgactgtacggttggttatcatactggtaactataccattaagaatgtccctaatgatgaaaaaccttccacagtaattgacaagatcaatgctgagcgggacaattggtacttcctgtgtcatgaagaccacacagacattgaagcgtgtgctaagtgggctcaggctaactacaagttacatgtctactctacttcagaagatgtaactggtaaagacagcaacatcgccgctaaactgaaagctgcaaaatatgacagtgttggtatgtacgaccctcgcgccgacaaagacttcccagagggcggtattatcggtgctatggcatccaacgatccatcttacggcgacagcttacacttaaaacagatgcctggtgtgctcgcaccatcactgaccttgacccagcgcatggcgatttgggagaacaacattaacttctacagaacaatcaacggtgttggtgctttctgggaaggtaaatgtgcctctggtcagtatgcagatgctatccgcttcgctcactggattaagtttagatctgaagagtccatgttcggatatatgcaccgccgttctaatatgggcctgagcatgaagatgtctgatgatgatctgccagttatcaagtctgttctgatgaacaacccgatcaatacgggcattaagaacggtgcgatcctgacaggttttgacgaagacaacaatgtattctacgacccgatcattacagttccaaaacgtgcagaaatcccgaccaaccagttggctgctcgtgttctggaaggtgtgaaagtagaactggtgtataacaacgctctgcacttcgttcgtatccggatcaacgttcttctggacaaagttggttctaaatccaccaatgctgttgcaatgactgaataaggaatactagatggaaactcaaattttaactccttatgcgtatgaccctaaaaaggtcaaactgtatctgatgcagcagcgtgtcactggcttcgctgctgacaccaagatcgttgtttcaagaaatgaagacaacatctaccctcacgtcggtgtggatggcgaaatgtctgcggctctgtctcgtaaccaatccggtgttatgactgtatctttgcagaacacttctgtatggaacgcctacctttctgactggcagaaacaggcatcaatcactggtctggtattcttcccggttctgctggaaggtagccagggccctggtattgccacaatcggttggatccagaaacagcctgacctgacttatggaaccgaagtaggtcagctggactgggatatcggtatcctggatgcatggctcaaccgtgacaacatcactggtgctctcactggcctcgcaggtcttgcaggtattatctaagagcacacttcagcataagcctcaccttcgggtggggctttttgcttttatggttttgacacgcgtttttgaattgcttgaaaggttaaattgacaatgcaccataatcatggtaaaatacaaaaatatggtgcacaacatgactaataaggatgctataaaatggctataaactttagacctacaacagagattgacttagcagggcacaacttcgtgatcacccactggggtccgatgaaggcaatgaaaaacatgcctaagattggcaagattgtggctgtcccgttgggtgctatcggtggatctattatctcaggcggtcagaatatggcagaggtccttcctactgctctggcctacctgttccaggaacttgatgataactctattgaagagttatttaaaatcttgttcgaagatattactgtagacggtgtggataggcttaatccagatgtcgtgtttgcagggcatctgctggaaatgattaaactggcaggtaaggttctggaggttaactacggctgttttttcacacaagacggtttaggaagccttctggagatgttacagcagatgggtatgattcagcaggtgaacaatctggatcagactccggaagagcaggaataagcaaagttgttgtgagagccagtgagtgggcagctaagaacagctcacttaactggttcgactttctttggtgcagggtgctcaagaacttcaaaggggaaaattttgaatcgctcaatcttgcagatatggcgtatttcctcaagctatgtgagtatcttgatatcgaagaattcctagataccgtccaaaacagggaaatggagcgggagcagaaggctgccgcagctgctgcgaaagctaagcgcaggagaggataatctaagggccggattccttttctgggatctggccctttttattatgaggaaaacatggctacaaataagatagttgccacaacagtcaacaagattggctttgagatagagaactcctcctacaaaaaagctgtagagaaaattcgcagtatcgggaaggagttcaggaaactgggcgaggattttaactcagccaaccccatgagcagatggcaggcagtggctgttaaaactcagcagacaatgcaacgtgttgccagacagcaatcccaagcaaatgctaaactgcacagggagagcgttgctcaggccaagaaagaggctgcagtaaaggctgcaatagagcgcagggagaatgcaagacgtaagcaagctgtaggcaatcttaccgccaaaaacccagagatggctaggatgcgtaagttctaccagcagcaagctaaagaggccaaaaaagctgccaaatctgcaccagtatcctatggtggttataaggcacctaaggcaagagttcttgctaacgccaagtctttcagatacattccaggcaaccctaacatgggtggggtggcttcagatcctaatcttgtgaaagcccagactgctgccatgaaccgttatcacagacagctaagaagggacagcaaagctgggatggataataggcttatggcagatcgtgaggcaaggagaacccacctctacaactctgcgataagactttctgccaaatatggtgccggattccgtggtagtctgtctggatattcggagttggagtccagatttgctcgcggggaaatgagtaagtcaacctttaacgcccacctgtctgcgttgcagtctgggtttaaaagtgccaccagccaaactctgaccctcggtgatgctatgagggatttgcgtagatctgtaatcaacgctacagctgcgtataccgctttttctggatttgctgcagttaacagatccggtcatatgatggagggggcaagtgctgctcttactgctgttactggagatccaaacaaagccaacagtgaagttgcgtttgtccagcaggaggctatgcgtcttggttttgacctcaagtctggtcttcaaggttattctcagatggcggtaaacgccaaaaatcagatgacaaaccaagaggtgcatgagctattctctgcatactcccagtatgctgctgcttacggtgccgatgaggtaaaataccagcgcggtattatggcaatccagcaaatgctcggtaaagggcaagtaatgtccgaagaactgaagcaacaacttgctgaagcattacccggtgcatacgaaccttttatcaaagctacccaagaggcttttggtcttgctgagctctccatggatcagttcatggatatgatgaaaaaaggtgaagttaaaacagccaagatcatgaagtatgtggctaagtacatgaatgaggcatctgcagctggttatgaaagaatgcagaagtctaacgtactggcagaaaacagactgaaaacctttattgaactgtcccgtcagaaactgttcacacgttgggcagatgagctgacagagttctactacaccttaatccgcacaggtgagaccctgcaatttgtgtgggatgccgctggcgattttgttagcgggtttgtgagaggtttgaactgggttgttggtgaactaaacaacactatagttaagatccgtttgtttttccttgagtggggaattaaatggggtatcataactgctaagacgaaggaatattccgaagagatacatgacacctttagcatggctaaatgggcagggtatgctgctgcaatcatgctggtagtgaacgcccttaccaaagggtttgttatggcatccatgcttgtaaaaacatttaagttcctcagcaacctgagaggtgcagctggggctgcaggtgctggtgcagtaaccgcagacggctctggagggggagcagccggaaaaggtggtggaggcattaagacgcccggtggtaaagttggcattcttggcaaactaggtatcatcggcacaatactgagcgccggagaactatttaatgatcgtttcaacccgctgagtgaaagaaatcaacagctggataccatcagtgatatgattcgtaaagacatcatatctggaggtaacgggtttgttgatcctctaagcaccttgccgggaggtactcttccgttaccaggtggccctggttttgcttctcaattaagaaccatggaaatgctacctttagagatcagtgatggtaaaatcacgatttcaatagatgagggtgagtttagcaaaatatttgatgcaaaacttgagtgggagaacagtaaagatatcaactttatgtccacagacctttggtaattaaactatgtgggggctctggccccctttattttatcagtgttgtaaaaacggctattttatgatacaatatctaaatggtatcggagtgtcctggagaggttatgccaagtaatatagttgatgaaaaagacctgtacaagcctcaagaggttaaatctccaaaggctgaaaaggcagagcagcaaactgaaagtgatgtaaagtatactatgtttgtcagcggtcttaactacggcggtcgcaatatagagatgaagggtaaaaacttcactaacgaccttgccattatcttcgatcaggttgagaattattcttttaaacaaacggtcgataagtcagattttgcagtagaagataagtctaccctgtcagaccatgcggtggttaaggatggggtattttctttcactggtcgggtaaatacatctcctcatataatttatgagcaaaactacattgatagaaatactgactccaaaaaccctgcagcgtctatgcgacctggtgcggcattagaagctttgacagagatcattaataagcgacagttggtttctttagttaccgaggagagactccttgaaaactacattataaccagtctttctgccaacaagtctgttggtgaaggtgctgcaatggtgtttgatgtggaacttacagaattccgcacattctacttgaacaaggttgttaatgcaactgtatacagcaatcctaagaaggtcggcaagactcagcaaaaaggtgctgtcaacgattgcaagaatggtagtaacgtaggtaacaagagagacacaggggcatttgcagacaccgcgtccacaaatgctgcagaagagtggcagccatacaaatccatgatgtggacagatgaaaacggtgttacccaatcggctgcagattggtactatcaggaatatggaagaccttccaccatagtcccatctgagcaggggaactacaacaaagttaacggaaaataaggggagcgtgtaatggagcttaaagattggtgcgtaatcacctttgtgtgggacattgacggctttcctgatcagaccatgcgtgtggttttagataatgaaacctatgaaatgcgtatgcaatggaacgagagggatgagtcctggtggttatctcttggtccagtaggcgacagtcctttagtaaccagaaaagtaacagcttgtcaagacattttagacgggctgcattacagagacgatttaccgaagggtaggctaatggctctgtcgtttaaagacgatcaatattggggcagggttggaagatacaaccttggggccagatctgagctacaacttgtatacggcaccccggttgatctttacaaggaacagcaagggttagactaatggcagagtatagacgtagaacatggcgattgttgtttggtcgccctgtagaacatggcggaaaatcaaaaaccaatatcccaaaatctgttgaaaagaaaggagaaagtgattctggagtttatgaggttagctcagacacaggtgctgccaatatagagttcgacatacaaaaggataacaccaaagagccaaacaaaggctatgtgatagtttacaacctgtctgacgatacggttaactatctggacatgcaccaagctgatgctcttgcagtgatgtttgaggctggctatgataatgagaaccagttgatattctccggaactgtagagtttgttgaagatagatgggaaggcccgactagaaaaactaagttcatctttggtgatggcactgagaacatcattaagtgccaaagcaccagatcttatcagaaaggcacacctctggactctgtgcttaatgacctcctgaaggatatgaacttaccaaaaggtagggttgttggttttggaaaccaaactttgcaatactccatggctttctctgggaacactgcagagaacctccgcagatttgcaagactgaccaactcaacatttagcgttcaggatggggctttatattggaccaaggttggaaaaaggttcaaggactctgtgtttgaaatcagtgcagagtccgggatgcacggatcgccaacccctaaaaacccagagcctgctagaaaacgaaaggctaaagctgctgcaaaaggcggttcaacatctaaaaagaaaaagaaaaacccgaaagaggacgttggtcttactgtgaccacatgccttaacggagctatcctcccagagtcaaccatctatcttaagagcagacaatatacaggtttctacaaggtgatcacagtgcaccacaagggcaccatcgaaggaggtgactacattacagagcttggacttggagaagctgttggcggggttgttgacaaaactgaggaggtataatggcaataaacaggaaagatgctgctgtaagatcctttatagaaaaaataatgagggactaccacaccagtattagagccagagttgtcagtgtagattacagcatcccctctgcagccgtgcagccaatagccgaaaccatgtttgacgatggggatgtagaaaggtaccctcttatctatgatgttccaattcaggtgatgtctgcaaacggtgggaaggcaaggttaacgcttcctattaaagctggtgatgttgtagggctgcaattttcagagagaaatgaaaacaataacgatgaccagcaaacccacggcctgtttccaggatgggctatcacctctgttcattccgactctaatgccttgcagatcgacccagataatgtagagttatggaatgatagggtttattttaaactaacaccttctggtgattttgagcttcaaacaccgggcggaacattacggtgcgacagtagcggggagttctctttcactaacggagctgccaatttacgcgctgctgtggatggaaatattagaatgaatggtgccacaatagatccgtcaggtagaattataactgctgctggtgtggatttggattcattctatgcagaatataaaggtcatacccactcttgccctgatggcgagactagtggaccgcactaatagagggcttgcatggctacgctttatagtgatatattgatggacccacaaacaggcgatttggcaatagacaaaggtcttgagttgatagattcaaaccaagtaagtctgcgccagcgcctgtggatgaggtttaacacatggaaggggagctggtactttgacgagttgtttggcttcccttatatggactttcttagtaagaaggtcatgaagactgttcttgataacaagattatggaggtggcaagacaggagcctgatgtgctaaacatcataaacttccagtctaccatggatcgaagatcgagaacataccaggcgttctttgaggttgttaccaaggagaacgaaattgtaagactggccttcgtaggtcttgatcagttcacttacccacaacctgatgatggagcaacttctctttgtgatgatgaaggctggattaagtgggctaataagctgtactacctaatcaacttcagactaccgaggacaggtgatgccacatggtggaaccagtatgctggccctgagatggaaaacccgatccctgtaggctctttgttgactcaggataaagatctgctgatgactgaggcagaacaaaccattaaccgtaatacctggacgcttgctccagatgagcgcgaatactctggcgttattgctacctctaatgatgaggctattgccaaccagtctggtcgtgctattgatgttaactaaggagaaatcatggctgtagcttatcctacaataccaattccagatcttgaagatgcagaaacagtcttgagcgatgacttcttggttgtcaaccagactgatgggacaagaaaggctaagattgatgatgttgtcaatgatcttagtattactaagatagtttatttcacagagggtggttatcttaaaagtaagaaagattttgcctacgatcctgagactaagcgctactacacgtggaacggggattatcctaaaataatccttcctgattccactgtggagggggcaggaggggtatctgcaaaagcctggtctgtttttggagagcttgctgcaacttcttcaggcaggatagttgactatgggtctatcggcggtcagttggacatggatcttaacgttgcagacacatttaaagttaggcttacttcgaataccacaatctcttttgaaaatcaaacagaggggcttaacgaggtggcaagaactgtgactgtatgcattacccagtcctctggcggcaacaaggtttattggcctgacaatgttaaatgggcctacggaagagatcctatcctaacattcacagctggtgcaacagacattttcaagttagaaacctacgataatggactaacttggtacggggcactgattatcgcaggagctatctaagatgcgtattcaacacaacattgataacgtatttcagatgattgaggggcacaggaagtgcctcgataataacacaggtattaccaacaccactacacaaaataagctagtaaaccctgatggtcttatagctgcagggtgggcaggtaataagataaataatgattgggcaatgcatgaggcccaagctgtgttgattctggggtacattgaagcatatagggcatcgaaaagcgatttctatctggacagggcaaaagaggcttgggaagcttacaatagccatcttctgggagtatacgcagtagaaagtaaaatgcaaagactatcccactacccgttatctactgatggggttccctcccatggtgggtttaaagatgtagtggtgtcttttaccaatggtagaggaaaaatcccagctggatctccgacatggggagaatacttggacaaggcattccaagcgtataacggtgtgctaggaagaaacactgtagactctgatgtttacggcggcacagatgctaacccaaattggacaacatctggattaagttggtgggttgagtggtatatagcatgggatggtaaccgctattgggctaacggtagcatagccgacagtggtcatacgtctgtagagttcggcacaatccaattacaagataagggtgttacaggcagccacaaggtgacctattgtgtgagattacctcaagagcagggtggatcggtgatacctgctggatcccctgtaactgtaaatcctataaacgtggttgcagataatcaggccccagagttggacggggaagaaatgtggtgtgacgcttgttatcaactctacaccttgacaggtgaggaaaagtattacaccgcgtttaaacagtcttacaacaagttgcttaatttcagtgatataaacgcctacgacaaactgtttagaaagaccacgttgattaaggcaccgtttacagatggtacttgtcttgttgcaggaacagttcctgctatgagcagggacagtgacggatatatcaactttagaatgaatgcacgccagccctgcgagataattcaaaaaggtaccacctacaaaataggtagagatactgaaattgttatgaatttcgggggagaaggtgttctgttccagcctcatttcattattaacgatggcaacaataataaaaaacaatacagaataggggtcccttttggagcggcagatgtaacagaggtggttgccaaagttactgatttcgtagaggtggtagggaaggatggtaacccgtacctcctgcctgaggaggaaaacattgtcgtaactggtggcgctagtgttagtatgcaatacgctactgacatttacaaccactctgacaacttctcccgttgcaatatagcaaaaggtaaagtaactttcaatttcggaagagagatttctttaaactcagtgacttaccgatcagatgatgaaatggtaagagtcaaattccttgacaaagatcgttggttatggtatgctgatctatatgctactaacggacaatgggtaacagaaactcttactttaggggatttcaaactagacccaacacaacctcatcacaccgaagaggagattaagcctttctttgctaacaccaaaggtattacctctgtagatttcagtctgagcgatagacagataggaaatggcctgtttgatctgtattgcgtcaatacgctgcctcaattctatattgcagatatggatgcttacctaatctggtttagtgtatggatggcaagcaagacagaatcggttgctaaagttggcgattgctatgtcagaaactacaagcaaggggcatacagacacaccccaggtgtgttccctgcagggaaggtgatagataaggaaagttatcttctggaagaaaagccaaattggccctacccaggtatgcaatacccagcggtatattgtatgggcgcggaaaacatagatcgcctcaggttgtcaaatacaattgggtttatgtacgactctcaagtttggtataataacacatttaaaaccgaaggaccagtcgcatcccgctacgtgtggcagagaggtaatgagggattgtctggttggtgggagatggtagataactctaaactccagtcaagatcttttgttgctgcgtgccgcacaatatatgagctcaagaaacataaagagcctgttgatgaaaaacttttcctgttctgccagagatgggcatggttcctcaacagattccaatcatctcattctggaaatcttcccacagactttaacacctctggaggatattcttatcaagacagaggagacaggatgtgggtggtcggtgagtggcttgcaggttgctgctggttaggcttgtgtgggtattcagagacaatacctcaaatagatattgttgtagaagcttgcatgaagctgctgcaaaaacaccacttcattaatggtgataatgttttaaacggctgctgggcagtttctgatccggtaggctatcactctggcgaaatccttcgcggtctaggcctttatgctcaataccgtggattgtacctttaacataagggggctgtttgcccccttcaggagaaagaatggctgatattaaagttgtcagaattgaatctcttcctgccaccacagcagtggcagaggatgattacctggttgttcaacaaccagacctgacccgtcgtgtaaaaattggcgatgttgtccatgtggatgggactgtttctcatgtgatctcctttaaggaaggtggtaagttaaatggcccaatggattttgcctacttcgaagaggaagacctctacctgcgttggaagggtgaattcccgcacactgttcctgcactgtcctcaccatactctgatggcggtattactgatgccacatggatggtatatacagacccttccttaagagaggagctggaatcaacaattggcgcatccatgattatgacagccgaagggcagtctgtccaggatgtaatggatgttacagttaagacagccaacgatgctaaagcgcttgcacagcgggtggattttggtactgtgcacacagtaggtgatgttattcaccttgataattttgttggccctgcagttattgaagagggaagaaccaccaactatccttctgaagccgctggtgaaaaatttctgaacggtgtggtatctcgtcgtgatactacaactgttgatggcattttccgtggcgctacctctggagctatgtacaccattgcagtaaccaacggtgtcgcaacaacaaaaagaatagcccttcgtgatgaatttaaacgcctggaggcaagcaatccaacaagaacagttatccgtgctggagatgatttaaacacggcagggtacttgcagcttgatgcaacaggccgttggggtatgtggaaccaacaaacagcttcgtggcaacctcttgctatagagcaaggcggtacaggggccagagatgccgcaggtgcacgtattaacttaggggctttctataagcaacgtgcagcccttgagccaaatttcaatatcaataacttgactggtaatcaggatggtgtatactaccagccgatgactgcttatgcaaccgaggcaaatggttaccctgcaggttctggtgctggtcacttgattgtttggcagaacaatgctaacggcggtacaggttgtcgtcaggaatactacccgttctctaacgtggatgtttggtatctgagaacctaccaagccaacacaaaccagtggactgcatggcagccgatggtcagacctcgtaacgatgatacctttagagcgcacatcggtcttggttccagaaattcccctaccttcgggcacctttacctgtctcaaagctctgcggatgttaagtcagcatcaggtattgttcacggagacaaatacagtgctgacggcgttcttgagcatgggtatagaatttactccgaggtaagaaacgacaataaggcttggttgacaatccacctccacaaaggtgcaaaagggtctgaaactcatagatatttaggcttccgtgaagacggtgtgttagattgtcctaaatatatgcaggttggtgatctgaacggtcagctggcaaactggggacttggagaatggatccgcagttcaggagcagaaagaggtttctggggatccaagaaagccgccaagatggtcatctgggatggcggtatggatgagcaaggtgaaggcactctggaatggggtgtttataacaaccgcaaggctaaatgggaacctttgccgatatgttgcggtggcaccagtgctaggactgtgggagatgtccaggcacaattcagaatccctcttgcagcaggtgtcagaccatatataaacctgcctagaactgcagcgatgcaggatggcaagtattatccgattattgtcagaaccgatcctaaccatgcgccaacaatcgggacagatttaaccatcgttaccagatcttcttctggcaacgatcctatgaactgtgctacactgcagtgccactacagaactggtggctggactgatcgtggtgacttctttaccgggtcgataaatttctaccagaatgagaaggcgatacttgggtgcgttgctccaacaaggggtaaacaagagtatgttgcgttctatgtagaggcacgtgccttccctgtaacagtgtatgccagcgctgacgtaatagaagtgtcaacaagagaggcagactggcaggttggcaatgtaacagacaaccaagacggtgttaaattctgtgcacctctagcatctgctgacttgaatctagcaatcaaaggtgacaatgtaacaaacactcgacctttggctgaatttaatggtgtaacaggtttctacaccaatcagtggatgtatcgtgggtcttctgacagatatttcctgtccaataaaacagagtttggcctgacagagttatggtgcaacggtcttaactacatctgcccaggtagccagactactcgaaaagcactgttctctaatgcagggttccaggctgcatcggaaggaacagaggatctgatcaacaacacctttacctctaaatgtggtaatggtgcaaggctgcaaggccaggcagagttcagatctactccggaagctggtcaagttatcgttcgcgatgttgtaggtacagctcataagttctacaatttcaacaaagacggcacatttttccctccgggaggctatgtttgccagacaggtgctgactggaacaatcagtttggtaatacaaacccctccaagataatggctggcaatgtcaacgggccggaaggttcgatggttgttggtggactgtctgtggcgttttctggaaactatgctttccaaatggctggtcgccttgatcgattatacacccggtctatcgagggcggtaaccatagggcgtggaacaaagtcatacaacacagaggtcagggtctggggacagacgatcttaatagctatgatggaactcgtgacggtatctatcatcagggtgcaaattctgacgcactcacatcccgtcattatcctgctccgtacgctggtacgctgattgtttatcagaacactgctaaccagttgacagggtgtgtgcaggagtatataacctattttggtgacaggtatactcgtgctggcaacacgaatggtgaagattttgtttgggaagagtggagacacgatgcgggtaagggaatccagttaagacctaattacacttttggtgaaaccagtaatcaactggaaattcatgtcggtgctaatggtcttccctccaacgcagatggcttacctaagaatgatgctgtactccattattggggtaacggcagcacaggggatcgtccaaacgtgttagagtttaaggttcgtgacgagtctcaagcaaattgggtatggcattgcggtaccttgccagataactcaagatatctttctgtaaatggtgctgtgaattgcacatctgtcaatcagagttctgacagagacctgaaagataacatatctgttattcctgatgcgttagaagctatccggaagatgaagggttatacttacactcttaaagagaacggtatgccttatgcaggtgttatagcacaagaggtgcttgaagcgctgccggaagcagttagctctttcgtgcaaagaaaggaaatcccaaaccctgatcaagatggaactcctttgataacagaggaaagattctacagcgtggattacgcagccgtaacaggcttgcttgtccaggtttgcagggaacaggatgataaaataaccgcccttgaggagcaggttaaaaaattgacagaggttgttactgggttgcaagagaaattgaagtaactgttttgccctcgcttcggcgggggctttttgtttgtattgcgtattaacttaaaatctggtaaaataactatcatacttgtttaacctggaggcacaatgtttttatgggaaaggcctagataccttccagatattagattagagttgctggcagatattgtcacgtttaaaagcccgtttacagataaaacgcaaaaagtaacctatgccacacctaactggaaaggcactttgacggtttccaatattagcgaatcgcagttgcttgagctcaagagttttgttgaccaagtttacaaagatgggaatatctttcttatcaaaacttatggtcattcggtgacagccaatgagccaatcgctctcggaccgactggtaacgacgattttttgaagacggttggttgggagccgaacagggatatagccagagctggggataagatatctgttaatgatgagttgaaagtggtaacagctccagtacgtagtgatggtgttggggccgctgttataaacatatctccaaggcttaggaaacctattgcagcaggggatactatgaagataataactcaatccccgaagggtaggtttcatatcagagatatttataaaattaagcaaaaagttgatgctatgcaaaaaggcgataatatagttatcaatttctttgaggatttctaagatgatcagagctccattagataatttatttcttgaaaagctagagcttgatggcgttgagatcttaattgctgcaaaactggagctaccaacaggaactgtcagggtgtgctcaggcactggtgttgtagtaattgaagggcaacattttataggtataggtggatcagctacattaactgctgtgtcggagaaagatgccaccaacttcggatctgtggtagcaacattgaacgggtttgaccctaaatatgttggtgatttgttgaagactgagtattcaggttgtcgtgccacgttatacattacagccatggagaatggtctgccagtaaccactaatggcttgtttgacggacttataacagatatggctattcagacaggagagaatagtgctctatctatatccatatcttcaatcttcaacagctggctaagagggttcccttatcgctacacagaagaaagtcatagctcaagaaacgacaacgatagattttttaaatatgtggatcaggtggctagtcgcccgatcatttgggaggtttaatgagtatcatacatcctcgtttagtagactggcaagaaagattgttgaaggtgtttgacgaagagtcagccgttccgttcgagtggggatttcacgattgttgcacttttgcagctaagtgtgttgatgctcagtatggaacagatattctttctaacttcgaaggcacgtacaaaacagaactggaaagtaagagatggtgtatgttacatttcaaaaccaccaacttgcctaccatttttgatctctttatgaccagactggatactcctaaacaggttcagcgtggagatattgttattttcaaaggtctgaacggacttaccgctggcgtgttttggaacaatcagatttggtcaaaaggtgataaaggggtctttatgtttgacatgaaagattctatcgttgttgatgtctggaggtattaatgccaattgcaatgattgataacatcgttgcttctgcaagatcttcgagctatgactggaacgcatccaaggcggctctggctgacagtctgaacactgttaccaccagaactctggataagatttttgagggcaacaaatcttacaggggccagcaagatagacaaaatcttctcagatcttcagctgcaccttgctctgtagtgtatgggaagacacgcacatctggattgcttgcgtttttggagcaggatagggacagaaccctccattgtgctattgttcttgccaatcaccctctggaaggtgtagaagacatacttatcgacggtaatcctatttcttcatatggagatttggtatcgtgggagctgcacaacgacagaaaaacatctgatcctttcatgggaacacactgcccttcgtggtcaccagacatgataggtagagggatcagttggctgcgtgccagcttcaaatttgaccctaacaagtttccttttgggttgccaaacgttacactcgtcaaggttggtaaaaaatgctatgatcctcgcatcagcaaagaggtgtataccaataacgcagccttggtgattctggactatttaagaacataccttaaatgtcctgacgaaaccatcaactgggagtccttcaaggaagctgccaacatatgtgacgaggcggtaagaaacgctgacggaaccagtgagcgtcgttacaccatcaatggtgagttcgacatggatgaggctccagcaagcattatggcagaaatgctgaaagcctgtggtgcagatcttagctatgtggctggtaagtatggattgctggttggtgcctattatggcccagcaacaatgacactgggtgaggactgtgtttgtggtgaggtcaagatctatccagaagcttcctttgacaaaagatccaacacaataactggtagattcaccagtcctgccaaaggatactctgaaacagatttcccatcagtgtttgtgccagagtggatagagaaggatggggaaagaaagataatcgatatagattatcgttttgtcaccagtccttatcaggcccagcgtgtttccgcgatattcttaagacgtgccagagctggtaggattattgaagtcacgtgcaatatgcgtggttttaaatttaagcctggacgctacgtcacaatgaacctcccaagtattggcatagtaggccaagagatgagggttcttgagtgggagttcactaaaaaaggcggcgttaaggtaaaacttcgtcaagatgcgaaagagtggaatgatgccacaggtcaacttcctgactctggtgatgtagatattcctgtgtccccatctggtgtggctcaaccgcaaaacttcagattctctgttcttcaagctggagaagtaactcatggtgttttagcttgggacaacgttggaacttacgctcaaaacattgtgcaggttaggaaaaacggagagattgtctggacagcacagacagttgagcagtttgtccgtgttgaaggtctgactaaaggatcctacacagccactgttgttgcaacgtcttataaaggtggtgtatctccagaagcgtactgtgagtttaacattcaggcacctgaggctccggtttctgtagaagttaagcagggatattttgctattaccttaattccgcacagcagggatttagcaagtgtaagcacccagtatgacttttggacatccggtatgacaaggttgcctgacactagtgatgcaaccgtcacttcaaaagctactcgcatgggtgttggttcaacctggacatctgaaggtctgcagaacgataagatctattattggtatattcgaaccacaaacgcttttggtagttctcaatttgtagagtgtgctgcacgctgctatacctctattgaagatttgatgcctcagatagatgctgaatttaaaaagacagaaacttataaagagttgatgagcactttagattcttctatcgaagaggttgaaaatcgggtcacagagcttaacaagtacatggatggtagagttgatgaagcttttgaccacatggaaagcgagttctctagagtagacaagctatatgctcagctgggggatagagtaggggtattcatccaagaaaccagcgaaaacttccaggatgttaatggaacacttaccgctcttgaccagaaactggtagccactcagaacaagtttacagatgatctctctaaagaaagcggcaagctaacctctctgatccagaccaccaacaaggctacaactgatcttcttaataagaagacagaagctttggacgagaagattgtttcgaccaggggcgagttggaagatgctttagcacaggaaagcgctgagctgaactctctgattgtgtctaccaataaaacgactacagatctccttaatcagaaaactgaggcactggacaataagttgacggcaacgaaaggtgagttgaccaacaacttgaataatgagagtgccaaactgtcgtcgttgattgagacaaccaacaaatccaccactgatcttcttaacaagaagacagatgcgttggatgaaaaactggttgctgcacagggtgagctaaccgagcagatcggtgatgttgaaaaaggatatctggctggagataagagcctagaaggcaagttgaatactcagagatctgagttggatgcaagcattctgagcactaatcaggccactgtagatttgctgaatagaacttctcagactcttgaccagaagattagccagactaacgccacggtatctaaaaactacaccactctagatggtaagatcaacaccaccaaatctgatctcaatacgttgatctctaccaccaacaaggccacaacggacctgctgaatcagaaaactgcagctttatctgaacaattaacctctgctaaagggcagattacaaccaacaccaacaatattacggggttggataataagcttacccaagctaagaaagatttgtctgcaaatatttctgaaactaatcaggccactgttgacctgattaacggaacagcgtcagctattcgtcaagaacttgctgttgctaagcaggagattattgatgatgttggagatgtgtccgagatcagggctgcagtagctacaacatctaaggccgtaaccgacttagagggtaaagtaaacgctcagtggggcacaaaaatacaggtggactccgcagggaataaatatgttgcaggtatccagttggggatggaagggtctgggggccaagttcaatcctacttcatggttagtgcaaacaattttgcggtatataaccctgggaacggaacagcaacccttgctttcgcaatcaagaacaaccaagcgttcttgaaagatgccttcatagaaaatggcacgatctcttccgccaagattgcacaggagatttcgtcaagcaactacgatggcaatgggtaccataaatacggttggtatattaacaagagtgggcacgcccagtttatggatgtgtgggtgaaagggaacatcaacgccagtgcaggtaactttacaggggcagttaacgctaccagcggtaccttccgtggcgatgtttatgccaacaacggtagttttagaggtaccatagacgcaacaggtggtactttccgtgggcgtgtagaagcttctgttatccgtgccaaccagtttgaaggtgcaattgttgcacacaggacctatggtgactgtcctccggtatataactcccagcagagggtttgccgctggaaatggagatatgtggataacgtgcaaggccaaggtaagaacgtaacattcttctttaaactgaacggtacgctcgctagctcccagcttaacgtttggatagccggacatcaaatccttgcaggtaagaagtacggaaacgacaacaacggcatgtgtgcggtagggataacgggtctaggtgaacagaccatagacattatcgttgaaatttacacaccatggtcaacgtcaagcgtgacaggagttacaatatcttgtcctactgttgtggtgagccgttccaactcaagtttccaaggcccttggaacgagtctcacgactaacctttaaagccccgcttcggcggggtttatttttatgctcagattgactattgttacaaaatttggtaaaataccttgtagagattttcataccggaggagtgaagtggctaagtatggattgacagaggctggtttcgttataccaaccctaaatgacctgatcgttgaaactaagcaaagcctgatccgtgcttttggcgaaaacttcaacgtacagagtaactcagttgcagataagctgaccactatcttcaacgagcgagagtatcaacttattcttatggcagcgtctgtgtatgcatcgcagacactgtatggggcagagggtatttaccttgatgaacttcttggaagacaaggtatttaccgaagaggtcgttctaaatcatcaggtacctgccagttgacaattaacacaactgtgccgtacaatatgatttatgattccaaaacttacacgctggacagtggcaactttgtcctcagtaatgacgtgcaggtagctgggaatctgattgctcacagaataaacgctccagacctaagaattgggaaatacaattttcaaattaccaaccagacagatggaagtatcaaaacaaaaagtctggttttaacagataaggccctggactcttctgatcttcccagcttttacggggagattaagcaatttattgtcgataatacaaccctgttgaacgacgatttgatccagatcgatatgttgacaggaacgttgtggataggttacaattctaaccttgatcaagttgggcttaatagtagggtggatttcagagtatctccgattgtaggggaaagaactatcaccctggatgttatcgctaacgaggctggtgagctgtcaagagaggcagaaactgtaacaacaatgtcacctacccctagtgggtttattaaactcaccaaccgagaaagattcaatgagggcagggatgttgagaaagactctgagtatcgcttaagagctaccagcactaaacagctgacatctaaagctactcgccctgcaatccttagcgccgtaagcgaggtgaaaggtgttgagaaagtgagagtgttctctaacaacaccgataaaacggatgcgaaaggtataccaccttacaaatttcaagtggtggtgtttgggggtacaacagaggatatctgtcaagcattgtatcaaaccatagcttgcacaaacagaacttatggtaatatcttctacgatattaatacatcagacggtcaaactgaaaggatttattattctaaggcaaacacttaccgtctggatatgaggattacctactcaggtgctgcgctttccacgactgaaaaagatgctattacagaggcccttctgcaggttgttaatggactagatgttgccgatacgttgtataatatccaattggttggtgctgcatctgcggctgtttctataggcagatttaacagactggtaattcaagttaaacctgtaggggcttctgatgaagcttacaccacaaacgacattgttgcaaacatgaccgaggtgtttgacctcgacgaaagtaatataactttccaacaaactatttaaggcggcgagatatggcagagattaagtcggatgtcaaccacatccacactctgccagattttgttcagggaggtcttgactacctgcctggagattttctggctgagaaggttaatttggtcacattcttaaccgtgtaccttaaaaggttggaggatgttgataagatgctggtaggtttggctgaaggaagattgcttaacaatgccagcggaagataccttgacgaggtaggaaatcagcttggcattcttaggaacgggctttcagatgccgattttcgtgccacactaattattcagcaggcagcatcctcaaggggtgggactagagaagatgtcatctccactttgcgacaattgttcggaagaaataatttcgatacgtggaaaggtgacaacttcaggtttgacataaatattagaaaaacttgctttgatatactgcagtctatcgatcagatcttagatatgctaccgctgccttgccatttgcggcttacagagtcgcaggggcaagcttttggctttgaaggggacccaacagctctcggtttcggatcagtgtgggaagaaaaccagttcggagttggtggattggctactttattgtacgttcctgacgtaagacctgattgggacaccacaaccatttattgtgaaagtattacagtgaacgcaactagacaggagggttaatggcaacagctatttttaaaccttaccgtgattactctacaatggctgcacggtttcattaccgcacagttcaggatactgccgttccaggtagggattatgatcatgttgagggagatgtaactattccggttggagcaaccagcattgagatcccagtagaaattgttgacaaattgcccaacaggttgccaagaagcttcttcatggagttttcatcagagtctcaaggggtgatgatcgggacgcaaaaagcaaaatgcacaatagtctcggatgagaatcttgacagattatcctgggatactgttgaggagagaatgttccacccaaggtattgggttacaaccactcaacaaactgaaagtacctgtattgttgcagataacaactgttgtattaaccgtttggtgtcaagaacgtatgggggtatggcaggttgcatttgggaaacagttgacaagtatgaccatttcggtattggatttgatgatcattatgaaatgagaaacaccaagctttggttcagaatgtcaataaacaacgccaccaacttctccacccctgaaaagatgattatgactgtggaccttgttgatggcacaatcatctatgttcctttagctcaatatgccgccagcatttcagaagataaaaatgttgcagagattcatattgactttgaggattgcattgggatggaccagcacaacaacatgatgggtgttgatcctcggcaggtgagaaggattctaattccgcttatgcctaaagattgggtaagcaacagcacagacccaaggacggaaaatgtagagtgcgagttgcgcctagacctgcttcagccagacacaggctggaaaatgatgcaacttaacaatattcaggtgaaagagcacgacgtcgggatctgcactgcatatgatgatatgtggaacgtatcacctttgagagtgttgaacaatattaagcgtttgggctacacggggatcataaatcactatgttgggatgagtcattactatgactacacgtggactggtactcaatggtctataaacaaaacaggggccttgaacgcagcagcttataaatggcatgatgactttatgtataatgccaaacagcatggcttcgaggttatgcaatctgtaagttttgagctttacagtgatgcctgcccgttagaatggacccaaagagattggaatgataactatgctaaaacagggtacaccccttgcagctaccttctatctccgaccattgaagagggtatgaatttccttacggcagtgtttaagaattttgcatcggcagctatgcgaaacaatctgccagtgattatgcagatcggggagccgtggtggtggttcaacaccgacactcgtaaaccttgtatttatgattatcctacaaaacaagcgttttatgacgagactggagaatatgcgctagatattggaactattgacgatcctaaaactggcggggtttacgacaagtatgtagcattttgtcgtggcaagctcggagctcgtattgcagccatttcaaaagcaatcaaggcacacgctgcatcggctcagatgacagctttgctgtttttcccaaccattatggaaaccgagcttacgcagaaactgaaccttgctgaccaatataaaaaggaagcaggagctcttgatttcttctgcactgagtgctacgattgggtgatgcagggcggtattgaaaaggcaaaagagtctgtaaacatacctatcgttaagttaggttggcaaccgtctgaaatacaataccttgcagggttcgttcctagtaaagagcttgctccggtatatggctacgacccaaccaggaattaccaagaatttttatggagatgtatttgcggaaacatggcaaccatagagtatagataccctgaggtaaaacagtatgtgtgggcatacccacaagtgatgtctgatagtattactgttactgccagggagtctactgtgcttcatatggggcaggttgctctgaaagggtatgtagaagatgttgttccgccagacttctcataatcaggagataaaatgtcaaaacctagttttccattagagatttgggcagaggaggatcaggttctgcctaacacccacagacagaacaggctgcgcccgattgatgatttgtggagaaaaggttgggatcttggtcaaaagccctcatgtgaagagcttaactatatttttaatatgcttggaacttgggcaaaatatattgctgacgagcagatccccgctcaagaaggtcgctatctggtacgggataataacttgagcgatcttttgaacatccctgttgcccgtaaaaaccttgggattatcactaaggaagaggcagatgcccggtatgtaaaagttacaggggatacaatgacaggccctttaggtctgcaacgtatcaactttaaagctgccgagacggacaaggcttggatagagacaaccattggtccagacaagacaactcttgattttggattgagtgacaatacagggtcgttcgatgatggtggaacatctacagtagacgcattccgctggagatttcaaccaactcagccggacattaaccctgagtttaccttgatgtacctgaatgccatcacagctaaccgtgcactgctgaaagtgataggtaatgttgaaattgtagacaacatgaggtgcaataaccttaccattaccagcacagcaacattcaccaactgcaatgtgggaagccagttaactacagggtcactgtatgtcaatggaggcaccagctgcgatagtttggttgtgagaagtcagcactgtgttgttggtaaccgaaatgtggtccgctctgtgaacggtgtaaccgccaacggtaacggcgatgtaacgatcactattccgcaaacaggtgtgcaagacatcagaattggtgcaagacttgttgacggtgtttctgaatctccagtccgcaatggctacgttgtcacaggatggcattttggtgataaaaaagaaatgcgtggttcaacttactgggcaggacctttacaaaaacttgtaaacggtcaatggatcactgttaattatgcgtagatcggaggactagcatgaaaatacttcaagagtttaagctttaccagccaggatctggcgaatactccgccaatgaggaaaccaaagagttgacccctcaagaggttgaggattacactgcatacacagggtattttttacgtaatgatgacggcgattggtatgtgcagtccagaacattacgacaagaaaaccctggttgtatattcctacttgttgacgagaagggtattcttaagacatctacagaagagcctgatgccttatggcctgctccaggtcttcgtgtggttatcgccaaaaaggaagaggtaccagaaaacattatgctccaccacgacgctttgcgtttagttggtgatgaatttgtcacagataatgaattctttgttcaacaggcagagggtgtcatagagacagaacttgcttgggctactgctagaattggtgcctatcaagacatgattgaccttgaatatgatcttactgatgaccaaaaacgcaacatcagagatttgaaaatgtacagggtaaaacttcttgaaatagatacatctaaagcccctgacattttcttcccggaacgacctaccctctaagaggaggtgttgtggagttggatttggcggcgttgtacggtatctgcatgggtaccgttgtcccgatctgtgtatgggctttcaaccagtggcacaccaaatggaaaggtatttccaagaggttggatgagctggagaaagacctcatcttagtgaaaaatagcatggttacaaaagatagacttgattccattatcgagacccggttaagtaagctagaggccgatattaacgaccttaagcaagatgtcagaacagatgtctccggtatccgagctgacgtgcaaaagattttgcacatgctcgtagagcatagtaaaaggtaaacaaaggtcaggacggaaaggactccgttcttgcattttgttctctaaagtgttaaaatagtcctaaggaattttctcaggagaacgtgatggctaaaccagttatccctcttgatatttgggccaatcaggatgttgtgcttgaaaatacaggagagttgaacaagtctcaaccaaaaaaagaagagagactgaaaggttgggatatgacacaaagagtggcatgtgaagttgttaactttgaacttcacatgctttctgcgtggttaagacatttaacagaagatgttgtcccaggatgggataatagatttttaagggttaccaataatctagcagacgttccagacaaagctgctgcacgccaagttctcaatgtatactcccctgaagaaatggacgacctgtatgttgacaaatctggggacacaatgactcagactcaaactctaggtcttcaaagaatacagttcgcagctgcgtccacagatagtgcggcaatatataccactataactccagacaagacgctgatggatttctggattatggacaatattggtggtgcagacggtgcagatcttgatgactcttctaatcaaatagacgggttccgttggagattccaaccttctggtggacagcctgtgttttctgccatgaagctcaatgctataactgccaatcgtgcaagactggctatccaggggaatcttgaatgcaacgatgcaaaaagttcctctgcaaatgctaatgctgtcacgataccaagagctaccgtcaatggacaacaatcttgcggtaatgcccaagttggtggaagattggattgtaatgatggaactgtgcgggggcagcattcaatagtcggtggtagaaatgtggttcgtagggttaacggtaatagtgcagacagcagcggcaatcttaccattcctatgcccagcaggggagttgacgatgtaagaatagcaaaccgcttcagaaccacctacagagaatcaagagtttacgtagggcatgtaatgtgttctggtaactacgcttacaaacacccatatcaaggcgactattggacaggtgctatccaaaaacttgtaaacggtcaatggatcactatatcttatgcttaaaagagggtaaatgaaactgactcagtttttatggggactggttgcggcatctgatgaccctacaaaagtgtcccaatctaagctatggtcgaacatcggcatggcagtgatgactggggtgtttattcacatggggtacaatgatacacttcctgaatggtatgcgtggatatacgcaccatcggtagcctgtccccagcttattagcaaattcatctcgctccggtggggttgccagcaccctgaccacgttaaaagcgaagagcaaaaagcttaaggagaaatcatggcgcaagacatgacaagcttcgagcaggcggtagatcaagtaattgtggattctgaacgcctgcacttgattgtcaacggtaacgctgtggatgaagttgtcgtagaggatggcaccaccatccctacggtacggaaagccatgcttgacaccctttattttaaaacgccaccaattccttgggcgtacggggcatccacaacagtttttaaccaactttatgagtttaaaggtgacactggtcctcagtggtggtacgcgcctgcggcatcaaaagctaatccggttagaatgccagcagacccttcacaatctgcaaactggagattgtataccgactctgcagtaatggcaaagtactatgcaaagcttaacagcccgaggtttgaaggtgatccgcgagtaccgacacctccaatggatgataagtcagagtctatagcaaacacggagtttgttgttgactatgtggatagtatatttgaagctatggaggggatgaaagttaccgtaggttctttggtggtaaaaggtctttcagagcttgccaataccatagttggagggactcttaccctacaagggcctgtcaacggagcagactctacggcacgcttcagaaacctaatcctcacggcaaatacttctacacttaccttcgcttggagcgatcctaagcatacggactggaaaagcacagaactgcagcctcacgaagtgtcaacgcacagggttatagctgacactataacatctggaaaacctgtggcaaacaacaatgatgtgcattttaatggtcttggaaacaacttctttgactatgtgtatatccgtggtaatgccatgaaggcggcgaccgaaccaacactgcaggttgatggtatcaccagggttaaaaacctggaagtgacaggcactgttacagggataacctactctgttgatggcaccatgatttaccctagctacatcgaaagcacaggggatgcactgatcaatggagatttagaggttggcggggcaatagttattcgtggtacagcctctgtgcagaacctgtcattaaacactctgaatgtgaacgagcgtgccacttttgaaggagaagggattacagccaataagggtgcaattacctccctgactgccaccactttaacggcaacaactgcaaacgctgaaaactgcaacgttagcagaaacttgcaagttaatggggatgtgagtttgaacgcagcagggactggaactacctacctccacaaccttgaaatatcaggcgctgtcaccgggtggttgccagacttctccaatgttaactttgtctgtaatggtatcaactctagtggtaagataaccacctctcaaggaattgaggctggtaaaactatcactgcccctgctttccacgcaggaaaagtagactttgacttagaagaggttgatgcatccagtgggacatggacacctaacgggcaggccaatatgtatgttgtccacgcaaaaggtgactttacaataggtcagtggcctggaacatcggctgaagataaaccatacccgttcactgcaatcatctatgtcattcaggatgctgtaggtcacaacgtgactttacacgataagtatgccatcttgtcggcaacgcctgttattaacaacaaggccaacagcgtcaccttgctacaattgacatattgtggtgttggtgatattgtggatgtggttattgcacaacgttaatatatctgaccgctcctgacggggcggttttcttatctggagaacacaatgcttccaatccctttgctaaaacttggtcgtcatttcctcgataagaggggtggagttaaggaacttgctgttctgtcatacccaatagacaacagtgacggtacaagcactacagtagcctatgtaaatagcttagctatactttttgacaacggtcagcttaatatcacagggtacaacaggttcggggagtgtaggactggggatcttgacacgataaactaccctaatgaggctgcctggaacgtcgatcatgtgtggagagcagaccgtgcgtttgtgatccgaacttttgataatcagtttttctacatcggctgtactgcagggcttattgggtctgatgctgcaggcggtaatgatgtttgtgtaagggagtggacacctcttccagaacaaatcgttaaaggattgcaccttgacacccacccagagcgccttgttgaggtgatgggcggcattaacaacactgtctgggttattgcagaggctgaaggtaacggtattttacacctgtatgggtctggtaacaacacctatggatctttacatgtggataaaaatcaacatgcaacccctgtaaaaattggtgagacatctgagaatcctgaaacaggtccttggaaaaacccaagcattaattgcgaggtgcatgacaactctgttatcttcggtggtcctagaggtttctggattgctggatacgactttctgagaaacaacagtagaaacgaccttgtttggcctcctgtacagatcactcgtaacgatttgagaggcattcctgcagacgaggagtggaaagggtttatgtgtggtcctaacggggcaataattgctacacagaggatgcatagacccgatgaccagcagcttgttaacgtattctatggtcaaaacatttggggagatgatacatggcgggaactgaatatcacctacacccacgaggtaataatggctcgtgggtacggcacaagcggcattttcttcaataatggcactaagcagtatcgtgggttctctcgcaacttatgtaatgatattggtgcacaatctgcaaacaatagtcctagggccgattttatccactatcaagctcttgctacagctaaatatgttgagcaacgcctgccagttagctggacagagagtgtttatttccaaggaatccacagggaaggtttcttaggaacatttactgttgttaatggtaaactttggtggtcaggaattccaaggggaagttttgcaggatctaacaacctgtttggcggcagacttaatagtcaggggttcacagaggttcctgagaattggtataaaaatgtcccggtagacagttggggtgttgatgatattttcgacgttaacggtgttagcagcgttagcaatatttacattggtgacacggtcaagatgaaattgaagcctcagccagagggggctacgttcattattgacaagattgaactggtaaatgctgcaggcacggttgttacagatgcaaattaccaattctctaccaactggaaccacggtggggccaatgaagttattgttacccagtataacagaaatgttaacagacgtggcctgtactctgtaaaaataacctatcatgacaagcatggcacaggcaggacccacacaacaaggactttgaactggaacactatcgtcccggcgtacccgtctgatggtaaatggcatactgtcggtagaaataagcagttccatgtcaatgacactgtatactttggactgaatggggctcagcctgcagtagaaggggatacatcgtatatggtcagactccatagaatggatgctggatcagtaacttatgatgttacccaagagatttatgatcagcgacgaaatacctacaataacttggtgcagacacaggccttatgggagttcaaccccaacggcagaggtggtaaaatgttgcaggtcaacgaacaaaacggaacatcgttgactgtacacgaacattcagatccttggcctgatcctggaaaacctcacccgggcgctcgtacactaaaaattgtcagccatgacgtaggatatttcggaatacgctgggaagccacggtaagatatgccgacgggacgacaaacaatattgggattactcttggcggcaccagtgaggataactcgctgaaaattgcctacacacccagaggcatctctattgataatatggatgttgttcgcaacggttacggggatgtgaacatcaaagttactcttggtgaacatcttggcggagaaaggatcatcatgtatgcctttgatcatgaccctcgcaccgacggaacctatgcaaaccaagcgtggagctacctgataagcgcacctgagccgaatactaaagaattctactatggtatgaagcgagatgtgtgcaagaaaacaggaacacatgactggattgctatctgcgttaaagacgagagaacagcttgggatgagcctgttaacagatggttcataggtatccccactcgaagtgataaatacgttgaagaatatattgtgtgcatgggtggcaccaacctcaatatgtgttggaacgaggatgcaaacaaatactctgattatgactatatgagggactactcttgcaatcaatggtttaaccaaaccgggtatgctaatcggcagtcaagagtaaaccctgcaatctttacagatacgcaggttttcttgacaaaacaggccaacgaggttcagaccttcaagaataaatatgaccctaacaagtggttttataactgttatggcgcatttttctggggtccgggggaactacctggtggtgggtcttgcttcgaggctgcaacttacgccagcgacagattcatgggacaggtcaagaagtacaagataattccaggacctgaaactttgggtaatgctgttgatccttacatcatcatgaccgtactaagatcgaacatggacggaacatccatatctatgcaggttccgataacaaacggctacaagcgtgttgtgatgatcattaagtgtgacttaataggtaagcaagttcttgcagaaaacggaacctcaacacatctatttgagactgctctgcactatcagtttgctgattcaccttttgcaggggataagagaatatcagatacagacactgcgcggtgcaagaaatttatgcttggtggcggatggtggtggtatgaatttgatttaacagacaaattcaccgacacatctaaagtggtgacaggacttcgtctagacctgggtgagaacatgcataaaagtgtttgtgatggcacctacggtgatcctacggtatacttgaagtatgtctcttttgagcatcctgaagatgttgtttatggtccaaaactgaggctgtttggcaattggattgctaaagacagagaagggatgggtaggaaggtaagaggcttcttggtcgatgctggcacagaggatatgctggtgaatgcggtgtggcctgaattaccgggaactcagtgggacaattctgctaagtctataaactggttcaatatccacagagctatgtgggcaactaactgctatctgtggaaagagttgaatgacggcgctttcgggtttactggtggcagaagaatggcaatcatttgctggacaacgctgcagagatgttatgaccatgattatgagattggaggcagggcatggaaaaatataagggatagaatcataactaactttgcagatcctaacggtggcggggcgtatggtttcgactgcagcaggcttatccatttgaacggatcttcggcctataagaaagaaggctactccgggtccatgattgaatggggcttggtaaaagatgctcgtgtgttaatgggtcagcaacttgctgctgcaataggaccgaacgcagtacaatctgttaaaccagcgtggttcgatatcccattatggtcctctggaacacctggaactgctgcaatcaatcctaccactggggatctggaaatctcttgggaggacttgaagcaggtcggtggttgggacaaaacagggtatcaggttcagtggtggagagctgatggatctttggctgctgatgagtttgttaaggacaatttctacactatgtcctctgcaaaagcacagcaactgtttggtcaggctactccgtcaacgattaccatgtccatgtgctgtaaagacaccaggactggagctctgggaccaagggttgctaaagttttctcaggtattaaatggaatctccctgttcaaagtgtttcatggaagcaaataggtgataacaagctactagttactcctgcctgccagttcaacgcaaccctcaacgttgatccggctgttgcagcaaactcagctaaagcttctgacttctctgtgtctaacactgccatggcagatgtgagaaagattgatacactgaatgccagaattacctgtaaaaacacttacggcacattccagatcatcaacaacttcacagatgctgattctaaggtagtgaggacagcaagccagactatgcagttgggaactctggcatactctgccctgatcactgaacaatctcctacccttcagggtggaggtgttggtaagttgatcacaacacctgtgtggaagccaaatgagtgggttgtgtttgatttgactgtagacttctccagtgacaataactggacatgggtaaggaattgcttgtcacagttgatgggtggtccaagctctgttagtgatagccacgactctacggacccgagcgtgttccaggtgggtaaaactcacccagaaactggggcacagttgcctgacaggaagtatgctttggtttgcatctccaacggcaaggcagatgtaaccttctcagggacacacgcatataacggcacttacaacttctctaaaaagtacagcctcaaggcaggtaacattgtagatgaagttggtgcgttgtataatccaggtaacggcatagggattgtgggcggtaaactgcagatgcaggaaccttctattaccccttccaatgtgccagggattagaaagacttgggaaagtagtaatactaacattgcaacagtggatgctaccacaggattggtaacatttaaagcccctggtaatgtcactataaagtttgtagttacggatgatgcaggccgcaaaacgtcttcaacatctttcactgtcagacagatggcacctcagtggagaatgtggataggcacagcaacaaacggggcataccctaatccggcagggacttctggtatgaagactttctctacaagcaagccgatggagtacggcagcggtcctaaggtagggcagatggtgtactttggtgcatatattcctgaaattatagggcttccgagaagtcagcttcagttgctgtttggggctggtgttgacgatcttgccactttcgggtatagcgacaacatcgaggctgcaagaagttcaggatgggtagggttcagaatggagtctggaaaggaaggcaggattctagggacagcctctataggtgttatgttccctggtgaccagcagtatcgtctgggagcctacgcaactttctctctttagcaagtagtaaataaaaaaggggccgtttggcccctttctttttatagttagtaatactcccaacatgccccatcttcagacggcttgactcgcttacccttgtggtccacataggtgtaaccgcaaccttcacaaataacaggtgctgcataaccttctttccactgatcctcagtgatcagaccttccaaatctttgcagtcaaagccaaacaactcttcagaacaatctttgcaaaaatcagccatttctcagtcctcgcatttaacaaatttttctacagatccaccaagcacagcttgttgtttgatggcactttcttcatcatagtggatagacttatgttccgtacctccgaacttacctgtgtggaaggtgtgcacccaaatctctttgggaagggatttattctcttcttccaccaattcccacataccccacaagtgatctgtgatatctttgatgaaatatccctcgccgaggtttgtattcacactataggccgattcgtgatctccgtgaatataacggaaggcagtatactctttccctggcgtgaagtggggatccatcagtatggctgttaaagaattagggtctcgaaatcccaagaactttagtttaacaatttcgacgtttacacttgcaagattctccatgacagtctcctctgtttggtaggtgagagaatcatatacaaacccggtgtcggcgtcaagcttaattttaagggatctgagagggtattttattcaggaaggtaatcacacagggtggggcaatttatgaaggcacaggcctcgtttgaggccttaaattttattagggcaccttgacatagcgctctgacaaagctgggaagccaaaagtggtgcctatactgccataggctatccaccattggagttcatcgtgacaccattttccgatcaggaaggtgctggggtatcgggtcagtattttggcataagctttaggatctgcatcttctgggataatgatgcttggaacatctttgttatgaccgcagcagcagtttagcgttttcaaacctgctgcccacaagctcatgataggcttagccatacacttatcaaggcacacacgttttttgccgtcacgaagatttttaggcacatcaacgataacatttgggtgcttggcacctttcactttccaattgtaggatttacacttacacatttcatcagtctccgtctagaaagtcgcactgtatgtttttgaggtatattttacttaaagtctttatcacctgtcacgattgcatgaatccactcgttgtgatgcttaatggcggtgaggtgtaacatgatgtagtgattgtcattaccaagcatggtgagataggctttagcagcaccatgatataacttccacattaagtgatgataccttcgtttcatggctctttctccggttcaggatctgggtaatcttcaataataaaaggccatccattacgctttgcgtcagacttatacttaatatccttcattgcgaactctaactgatttttagcaggaatgcaagccggagaatcatccacccagatgtcagggtagatatcgaactgtgccaagtaggctgccttttgtacaccgcctgtgtagaacacacctacatccaactccttgcgccaatactcaatgtccacgttgtcttgagtgatgaaccgagaagtcacaaggtatactgtccacccttcctttttcaagtccttaatcaggcgggagaagatgaaaggactcgcattaaacgttccatcaaagtcaatggcaatgatgtgtgtgccgtggcgagtctcatatggattgctcgtggtgagattgctgtagttaaaagggacctcttccccgcagtagctgtagtccatattcacaccttctcgttgataaatttacgggcggtttggtgagttgtttctgctgtcttcaggatgatattaattttatcgtcaagatcattcatctcagcagttaattcaggaatctctccggcatgcatggtgaaatcatacatagacatacccaggatctcgttgattcggcggttgcattctgcagcacgctggttcattttccaggctaacactaaagcctcttgtgtagcctccagtgcaaagtctaatacgtcagcttcttctttcgtcatctcagtctctcttgttgtatttgttggtaggtgcatgaacaccttatatctcacttttattcaaactgcaatagcaagtccaccaccgcactaggcctgtcaacaaattccccaggtccacatgcccatagagggtatccgtcaacatacctccatatccaacctgcagtgtggagctcaagcagggcagtgccgtccttactgtcaaccactctttcccacagtgttgggcagcgaagcttgagaatcgggtccccgcccttatacccgtccatgtagatacccattgcaaagttcagcatcatctttttgtgcatagatcttttactgagggtgctcatcacttcctctttgtgaatgcttgtaagcttctccttagctatccgtagatcgttgcaaccattgttcagcagatcttccaggcacttaatccgaaggtcgtgaatgtctttgtcgtgtaccgttggcacagggtcgtagcgatatagcactgttgatacaaggttgctagggtgtgggtctgatagcaacccatacccccagtactcttctgtatctgaaaggacaagacacccaatgtctctgtcaagctttcctgtgttgtaagccacattgaccgccatgatcataactccactagcaaagtactttcaaaatgcctctcatgtagaccgttataaggaaccacttccacaacaccatcacggatatatggagtcatcatagtgatataatccccgaacgggttggtattatcactaaccacaacaacatgctgcccttccttggcagagtgccagatagatctgcacttcatcatgtgctctagggcacctggtaaaattttgttacgttctttacgagttttcataatagaaatagctccttatgaaaatgggctttcaatttctcaccaagaaacttcttaatgccttcttcaagggtgttctcgatgtagtccaacttaaccgcttcgatggacatatcatagatcgccagctctaagctgtcaagccccatcatagcatgaaccataagattttcatcttcagatacgttcagtgggctacctataacatccgtaggtagaatagtctcccagttattctgggaggttctatcaccatccactttacggcggagctcgaaggtattcttagtgtaaaacacttcataagaaacgatacggctgtcgctctcgtaataaacgaagttcaggtaggagccgagccgcagtcggcaaacttctaccccaaaccattgtttcttataggaattcaggctaatgctgtcgcattcacgtttgctcaacacggctctctcctttttgttaatcttcgtaaataaggatttctgctttaggttttcgtgctttcaggtccagctctatccagtgtaccatagctgtttcaagaaaaacagcctggatacatccgtcctcagcgtgaccaaccagcataacaagatcttcaacttcatcatctgcatcacgaacatacagaatctctccagattcaaagtctttcacaacctgattgttggataatttacgaatttttgccatattagaagccctccaggaagcttttatagaggattatttcagtgtcaacacctgttacaatcttatcgttgcggatctcgtcagtaaggtaggtgtcgaaacgtaatacctgtgtggtattgtcacacatccactctgaggtaaccatagcgaagattttggtgtcttcattgtctggtgtgaatgttacaacttcaccacccttaaatttttcaataggttgggtgttggctttcggctctgcgacagtgattttcgtggtcattactctttctccgtagtttcaccaaatacctcgatacgagcatcaagctcagttactttcagctccccaacaaaatctttcagttctttctcgtccagatcgtaagcccacacacaagaagagcatgcagatttcacaatcagcagagtagatacacggcctgactctgtaatcatgctcacaatggttcccacaggaaacgtgttgatggcctttttaactggacgttcagttttaattattacctctgttgccataaaatactctcttacttagcatactcgattaactctacagttttcccaaagcttgggatataatttttattatacccctctgtgagaacccacaaagtatcgtactttttccacttgttgtcaacagccttttgttcaaagttatgctcaaagtataggtcggtcaggacgatgacatcttttgcatttggtatgttagcgtccagatactcgaacacgcaagcggctgttgtgccccatgttgagtgaacctcataattgatcatctcgtcgatgttgccacgagtgtatactttgacctctccaacctcagttgaccaacagaacatcgtaaccttgaactctttatacagattgcacaacccagtgatctcattgaacattttctttaaagttctttgtgagatcgatccagaaacatctaaagccaccacaatatctatagtgttttccgggttacgcccaggaacaacaacgtgctgattcttgtttatagccccaacttttcgcattgtgctggtcaaagatccagatcggcgaccgggttttctgtaggttagttcagcctttcgtttagacaacatacgttgcttaataatgtctatataattgatcacaggcttgcctctgtttttgacaaactcacgcacagcctcagggcaacgacctccggaagcctgcattgctgcttccaacatgtcgccagagtcctgcatggcttgatctttatcagattgactgatcactggttgtggctgatcataccccatcgcctttccaagatcatcactagtgccaccgttcccactcatgtgatcatcggtttgtcgtttatctccttgagagttctctcctttaccgttcttacttttaccactattctgatctctttgcttatcaagaactgcataaacgttctcagcaatccatccatggaacctcatgtcacagtagcaactagctaagaagccaaaaggcttaccttttacaaacgtagtgcttttccccttcgggaagaaaacacaaggtggcttgctaaagtcaaccacaagacctgtgttgataacatgatcacaggcaatattgaacagttccggctcaaagcttttaccacggaccagatgatcacagataatatgccccacctcatgtgatagaagaaatgccacctctttcacagattttggggaatagaaaatctcagccatctcaaactgctcgtcagtaagggaggctttaagaatggccctacgctcatcagccaaccccataatgaactcagggctgtaatagatgcgtttatggtcggttgccatggtggagcaccatgtgtggttttctacgaactgcaaccctgacaacagtgtgccataaaacggcagcttttcaaggagatacatacgtgcagcctgcaacattctcagggcatcatctttttgcgaggcaatgatttttgaacttctgctatccattaaaactccagaaggggccgttggcccctgtcattatttaacgtgtttgaaaatactcgccaactcggtcatcgtcatgcgggtagtcttcataaggtctgtcatagctttttccataatcggtgatactaccatgaagttacctttagtgaaacctttgttccagtcggtcaccaacagaggtttgatcccagccccaagacgctcaccagttaaagcacagcatttgcgaatatacgaactcttgaattggctaaaggatagatcaactttcatacctgcatcgtagaatgtttggcaatagaaagtgtaagccttggcaatctcaacatcgtcaggcagtgcaggaacctcttctgtgagctcttcttcgtccccttgaggctctttttcctcttcgtaagcctgttgcgccacttcttcaatctcctctgctgcaggctcgtttacaatgtcagaaatgtgcttgttggctccacggttagccatgaagtttttaaaatcctgcattggtgacatatcttcctcccattcttcgtcaaagagtgccagtttatcctcttccgtcccatattgcaagatgaaatcttcaaaagtgtaatcacctttcaatttctccatgcgctcttcgctcaggtggagcatcatctgctggacaatttttcgatcagttttgtctttaatcaagattgcggtctttttatctaccaggcagtctttcagagagttacacctcaatcctaccacacaacagttatcaattgcgtaaggaccttcatcatctatccgctccagagatgggtagaaaggattccccagcccgttttcatctgtgtgcatgtcgaaaggtataagggtatagtcgcatactccctctcctaaaagttttttaccaaataggaggtattcttcccatgacaggttgaactctatatctcgtttccgtgcattattctgtttgcgtctatattttttgagcaggcgctctaactcttctggtgtataatatttttcaatattcatgagttgtctcttgtgctctgtaggtgaagaaatcttatcaagcgcctcaacagatgtcaacctcaaaaacgggttgactttactctaaatccacgatatagtgcacccattcgaaagaaaacgaacacaggagtacttaatcatggcaaatcttaacagctttagcactcgatggaaacaagatatcacaactaatctctcagcaggcgatatcctttctgcaatttacgaggctttggatgataaagctacttcaaaatcggtttgtaccaacccgttaattcctatggtaatgaaggtgattgagcgtaggttggtatccggatctgataagtggacatatctggataatggaggccacacttactccaacggctatgtcgatataaaagtagaatatgcggtatcatatcgccggagcggctctgtaactttcaacttctccggtggtttccgatctctggcaacttcaccttttgtttcctcagagcagaagtttgaacttccgttcctttggatgatggctaacgcgacaggcaaaacccctgtaagcattcgcgtaaaatacaactacaacggatctagtaagatctatgccgagagtgtctcagcaagtttttattttgtgatgggagatggagtcctcaaacatataaagatgtgcgatatgcatgatgttataaatgaagtgactgataagaatgttctagtgaaggatctcaacaatttttatacaccgggagactattacgtcaaccgtccactgtgcatttttaatgctgcacaccctttaggtgagtatttgattgccaatagtgatattgccaataaccgcttcgaggtagcaagagtacagaatgaggtgttgacatcttgcaagagcggtgataagtttaccgaagaagagatgggtgttttagaaatgatgggatataagtgtagcctttgggtagatgaggtgtttaatgacggcatctatggacaggatatttacccgttaaagaagtatactgattccagtttaatttacgcggagatttgactatgatgaaggcatgtggtagtgtatattacgtcggtgaacatgttcaggcagacagtgtgtggaaatctattaagtctaccactgatgatgcctttctgagtagcctatgtttccccaaccctggggacatccttccccaccagggagattttgttgttaacaaagtggatggctatactgtgtgcctgatggttgaaaaaatctttttagaccctcgacacaatcaccgtcttgtgttaaaattccaagaatgtaaaatgacagtcgcctaaggaggcctatcaatgtcaaaagttacttaccgtgcagctatttattgtaacgaacaccgtgtgaaggacggcgaagtatgcctgtttgaggaaggtcaattggggtgtgtcgccttgccggaggaaggagagggctacctgatagccttaacaggttttgatgcagatgctttagaggataacttagattacctcgtagagaaaggggctgcagatatcattgccaatggatgctcacgcagtctagatgaaattgttaatttcatgggcgactatagggttgtacgtgaatttaccgtagaggtggaaacctcagagtggggtagtgcagaagaagagggggcagaataatgaaagtacaaatcttgactaacgccgagaagatgtttattgaagatacaccttttgaggcgggtgagctgcagtttgtatattttgttgaggcagataaggttttccctgcactgaatctgggactggatgaagtcccttataaagttctgcgccaagttgtccgtgccctggcggcagacggggagttccacaccattgaagatgtccaggcttatgggtatcttgagctgcagcgagaagaagaggtggactaataatggcacagtggaagacgacagtagatctccatgagcagtggttaggacgcatcgctgaagacgggaaactggtggattgggataacaagcatgttagtgagctggcaagtatcgtggctgagaagttacgtgccaagttccctgagcagctggaccctgataattcaaagttcgatcctgaattggaagatgttgtatattactttgacactgtagatgactatgattcatggtttgcagcaatgaatcatttccctcaaggttctgccatgcgccggatggaggaggactatccaccgtcagagcaattcaatagtgcaatgacttgcctttatgattgggcagataaaaaccttgtttggattagaactgcattctagcaggtggtggtggcaaggatgccgcttaaaagagtaataaatatgttatatcagaaacacgtaacgcgtgcagaaaaagagttaaattttgacaaagttatccacagatgttgttatggaaaaatcggaagacagctaagagggtgccccacattctttcactccagtagacggctaactcctgaagaggcaacagcagaaatggttgcatataactgggaagttgtgtacgatattgacagatccgatgtgacatctgttttggaaagctttgaaaacacttacacacaagtagaggacttttactaatgtcaagaaacgtatttgaaagtggtcaaattactgtccgcgagttgccagctgttattaagtttgcccaacggcataatcgatctgttctgattttaggaccgatgggtgttgggaagagccaagtgatgaagcaggtcgctgacagcatgtttggtgagcgagatgacaacctggttgatgttcggctgtcagataaagaccctgctgacttgtctgggttacctatccctgtagagtctgatgggactacacgcacagtgtttgcaattccagaattttggcctgcagatccggactggagcggaattatctttctagatgagcttactcatgcagataactacctgcagaaggttgcaatgcaaattatgcttgaccacaagtgtggcacctatgcatttcctaagggctctgtttttgtagctgcaggtaaccgtgctacagacggtgctgttctttcggcgctcgaagctcctctagctaaccgctttatcattgtagaagttacaagtaatgcagaggtgtttattgaggactatgcattccttaatggggtgcactcctcggtaattggatatctgaaaagagtcccatcagccatcgataattatgaggccatggctgagattaattgcccatcttttgctacaccgcgatcttgggttgctgcatctgacatcctgcacgattttgacagcggtattatttctgacgctatggcccgtgttcttctacaaggtgccattggtcacactgcagcggtagaaatttggacctaccacaccaagaaacgaaacttgccagaaatcggtcggattatggcagggggctgcaaagaatatgtaggccctaagcagccagacatcttgtggattctggggtctgaaggctgtatcgctattcgtaatatgatggaaaatgcaagtatctccgacgaagatcttgtcagctgtgtggcaaacttccttgatttcctttgggaaaatttcaaggatgagaaccgagactttgtattctcagtctttatggcgatgatgaaacctaacgccttagggaatgccttacttattggtaaaggcagggacaagatcgttgctcagctgatcaaagcatacccaaacctgatgaagattgtaaaagagtttggtgaagagtttagcgccattttagctaaagcttgaggaggttgtatggctaaagtaggtaagcggggaaactacctggtggtattgaccgaggagccggagaaggagtacgaatgcagctccacttgcgtgatcgatatccgagaaaaagatgtagatgaaatctggtttaaaatattggacgcttgcgacagcagtgactatttcttcatctatgtcaacgataaagcggggttcttccatgacgatggggagttaccgtatgaaatctatgaacttgtagaggcttgccatcgtggagatgcggagttgtttggtctacggctgaaaagcggtaagttcttctaccaagacgaatgcatgaatcttcacaacttcgtagagggaacttgcaacgatggagagattctggcacactacgactaatttttaagacccccccccgcttcggcggggattttctatttggagttattgtgaaaattaaaatctttgctattattttgagcgcatttttatcgctgcctgttgttgcagcaccaaaacaaaaagtatatcacacttgtaagccatcggatactaaggaaaacattctagcatgcaatatctacagggaggctagaggggatggcacgatgggtatgctggcatctgggtttgccacactaaacaggaagtctcaccctggatatccagacactataagaaaggttgtctaccaacctaaccagttttcgtggacaagccacggcaaaacttttaaggtgacagaaaaagactcatggaatcacgctaaaagtcttgcaaagatgcttttaaaggtctacaataacaaccatgttgcatacatggcgatggatataacaggtggagcaacacactaccacacaaccaaagtgcgaccgaaatgggcaaagaagatgcaacaaacggcccaatttgggagccacgtctactataaggagcgcactaaatgattgtaaatagtaatgaaactaaggctgtgctgacagggaacctggaggttaccagaggtacaatatctctgaataaagagacttttgggctaatcattaaagggatttacgaggataaagtgttagcaagttgccgtgagccgatctttaacgccgtagactcccatgttgagtctgggcgaggtgatgtgccgatcatcattcactcacctaccgaccttgaaccatacttctttgtgcaggacgttggtctgggtatgtcagaagagatggttcgtaacacttttatgaaccttggggagtccaccaagcgcaacagcaacgccctggttggtaataaaggtgttggttcaaaggctccgttcagtatggtggacactttcgatgtaatcagtgtgcacaacggtgtggaaagcacatacctattattcttggatcagggcattccaaatgttaccaagatccgtgagcgaaagactgaagagcacaatggggtaaaagttcagtttcatgttaagaaagaacatgttctgaaatatcgcactgctattgcatcatgcctacgctatgcaaaattcccgttcaccgtcactgatccgatgacgagcaagatgctagagggtgacaaggtagaggcgcaatactattacgaaaaagatggttggaagatgaccatcttgaagggctataccagctctgacgagagtcgtgtggtaatgggccaccaaccttaccgttctaagttcctggagacattaacagattatcctgcaatttgcgtagagattcctatcggagattgcaatattaacccgggacgtgaatggaccatagagggtcacgacgatggtggattccaagagcgtttggaagcttttgtcaaagaaggtatccgtcttcgcggggcagaagttgttgcggaactggagacagctaaaacctcagcagaagcacgcgagatgatgaagaacagtggcgtgttcgggaacattttcggtaagaattttatgtatgaccgatgggaagggacaggactaggcaacctgggtgattgcgaaatcttcgctggaggtttaaataaaggccgcataggctacgcttgttacggaaaggtagaattcttacgaggggtctatttagtatttaacgacggagacgggaaatataaccgaaataagtgcaactacttaagcgagactaccggacgcaacgttttttattgccggaacacggatctggtgaaagagtttaaagaagcggcacaccacccgttctttgcagatacggtcaaattgttatcagagctacctcgccgacctgtcaagaaaggtgaaacaaaaactcgttatgagccaggttattgggttaaaaaacttgagaaggatggttacttccgccgtgagcgtattactaaggcagagttcaggaagattaaacactgcatcccttacgagggtgatatccaacgtggaagttgctggctagggcagatgagtaacatctaccagcaagattatgaccgtgtgcgtgcggcactccagattcctgaaggtgaagatctgtatctggtatcagaatctcgtctgctttggactgatcctaactgccaatatgtcaccgagaagaatgtggagcacctgttgaaagaggatgcttggaaattcttactgactcgtgcagcaaatgagacttcttatgacagcctgtataggcaattggggaaaattattcccatgcaggattttggaagctatcggccacatttccacaagtgggaaggtaacaccacgtggaagcacagtgagctaaatcatcgtgccaaaatcttaatcgctaaccgagttaagtgcgggaaggcctatattgcaagattggaaaagaaatatccacttttgaagcatgtaggcttgaaatactgggacactcctgctatgattgaataccgtgagttgattgacacaaagaataacacccaatgaggagacagttatgattttcatctacgaacatttcaaaactcgcaaagaagcacgagaccgccgtgcagaacttgagaagaaaggttttacatgcgccattgagaaaggtgccacaacttggacactagcagttggtgccccggagctgttcgaccctgaccgcgacagcgtctgctacacccgtgaggattttgaaacccgcgaagaggctcgtttattccgatacggtctggaagataacggtaagtacgccatgatcttagactcaggcgaagattccgttaaacgttggagcgtggtatatccactgtgtgttgttcacggtgtggggttcactgggggagcaatcaagtcagaagagcctttggtggaagtcaaagatccggtgctggaggtggtgagcagtgtgtctcaacaacaaactcggagcatcgaacctttggtagttatttgtggagaacttctacaaatcacctgcaatgaaggtatttttgaaattcgccgcagtgatgatgaagaggtttatcagaaagtattcaaccatatctctgttcaagaatatgacgaagcaattggtgaaatccttgtctggctggaacgtaagaatgagttcaccacactggcagataacctggttatgaaagatggtaagctctactactacggggtagagatgcgatccaccattgcaaagaaaattgagaaagattatgcagacggaacactggatgaccgctatgtgaaattcctcgttcgcctgctacgcaacccatctgcaaaatctgtaaacatgctctacgattttatgcaggccaacgatattcagattgcagaagatggtcgaatcatttgctacaaaggggttcagtttaacggtagcaagtgggtggattggcacagtggtaaagtcccacaataccagggtgcttttgtatccatgcctcgtaactttgtagaggatgatccggaagctgcgtgctcctatggcttgcactgcgccagcaaagagtatgcaaaaagctacggtactgtaatgactgttatggttgatcccgcagatgtggttagtgtgccataccaacacaatagtgctaagtgccgtgcatgtcgctatgaaattgtggtagctcctgaagcacgcaaagatggagaccctattgagtatgtagttgatcgtgacggtaatactatcgacattctttacgaggaggcgtaatggaaaaagggcagtatgatgtaggcacagatgctgccctcgttgcaatcatgagcggtgagaatgtcttcgtctcaggacctgcaggttgtgggaagacgtacctcatcaacatgatccagtcaatgtatggagactcttgcataacggttgccccgacaggggtagccgctttaaacgttaatggagcaacagcacaccgaaccttcgatcttgcagcaggtgtgagtatggagtcggactggactgcaataagggcaaaaacagcaaagcctttgaaaagcaaggcatttaccatcctaattatcgatgaaatctctatgatccgtgctgacaagtttatagagatggacaggaaactccgcttccttcgaaaaaatgacaaacctttcggaggtatccaggtcatattgtttggcgatttttaccaggcaccccctgttgtttcttccatggagaaggaggcctacttcaacttttaccacactgacctgtgttgctataccgaatcatggaaagagcttgatctccacaacatagctctagtagatcagttccgacaggagtctattcgatttgccacaatgcttaactgtgttcgtgagggtcgccgcataaaagaggttgtagcagaactaaatgctcgctgttacaaaggtggtgtaccaacagacgctctcacgatttgcgccaccaacaaacaggccgaggaagtgaacaggaggttctatgatgccatcaacgccccagagaaggtatacactggtgaaatgaaaggtaagtttccttccaccctgccagtggagcaggaaatgaagttgaaaatcggcatgaaagttatgataaccgccaatgatgttgacccaacgcacaaagtgccttattatgttaacggaacccgagccacaatcgttaagtttaagaacaaggcggtggtggtagagcttgaagatggaacacaggttgacatagagcaaaggttgtgggagaataacgaatataaaccttctcaaagatacaacattgcagaaaggaagatggagaagtttatagagcgggtggtgatcgggtcgtacaggcaacttcctctaaaatcaggatatgccgtaacatcccataaaagtcaagggcttacgctggattgttacaacctggacctcgggaagaacggagctttctctccaggaatgacgtatgttgctttgagtcgggttaagacgatacagggaataaacttgttgcgtccattgagagaggtggatattattgttgacccgagagtcgtagagttttataatacaacattccctgacttagacaaaattgtcaggaaagattttgaaactagagtagaagagggggacgtatgagtttgtggagaaatatagttaactacgtgtgtggtaatccaactcctgaagagaaggatgttgtgattcacgattttactaaaagatctcgggaaaaagacctactgctaatgagagttgttgataaagatcctgcagtaggggactgggcaggttttgcgttcacatcggacaaatacacctttagcaaaggggactatcttgttgtggattttaacgaagacatcgagggtgctgaaccttactaccaaacccttattgttgcagagtgtatcgagctctctgcaaccgcgcacagtttaattctttttgagcttgactctgaagatctttagtagtaagatgtgagtataaaggggaggcgctcctccccacaaaactaaggagagcaccaaacgatgaagcgttataaaccctatacttttgaaatcgatttcgaactggatgatatgtttactgtagaagctcaggcggttgtccagttaccagaccccgagtgtcatgattctgatgttgattattatggatttagacagatcacggatgttcatgtttaccacaacggtgaagaggtcgactttcaccaactaccaaacgatctgcgccactcgatttacaaacgtgcagcccgtgaactggagtcttatctagatgcagcgacaacagcggctgcatttgctgaagaggtaggaggtttctgatgattactgatgtgaagattctccaatactccttgaccaagctagaagatgctgaaaaagagcttgcagaagttcttaacaacggatacactatgctggcctgttcctgctcagactcctacgccgtgtggacacttattaagaaggaagagcctgcagggatcttggtgcctaaccccaagattattagcgagatggatgaatactctcaggacgggctgccagaaggctgggaagtgtgggaaggtggtgaaaaccctgcgccaggtaagtgggtaaaatacaagctacggagtggtgcacagtacgctgacttctccgatgatttggactggagtcattcctcacccggatcatctgcaagttcgtatgatatcgtagcttttcaagaatgaggagaaggagttatgtcggattttatgtggaaagtaggttacgcttctccggaaatgtgtgaggcctgttttgtaaaaataggacgagaagatattgacaaagtgatccttaagtttcgtgatgtagctgtgatcggcaaccgagtgcttaagcacttaaagaatctgaagctcaccaaaaagaagttctttgggcttttcgaagaaaaagtcgatgcttggacccattgcatccaggaagctaaatctcactacagtgctatcgttactccagaacgggtagccaagatggaaggatttgtcaacagcacagagtttgagtgcctaaaggctgcccttaatagttatccaaaatgcctcaaacaccttgacaaatatgtagaaaaggatggggaaatgtatctcacccttgacgcatactatgagatgcaagaaattttaaatttagatttgacattggtatccaccgagtatacaataggtatccgggtttaacactaggccctgcccgaaagggtggggctttttgcattaggagacagcaaattgaaatttatctataaagaacactaccacaaaggtgttgtgtggagtctatttgacgggtctggcggtgcagtcattgactgggcaaaagctggatatctgtgcctgtgctttaacgcagaaggtgctgaccacggcagttatgcagaggtgataacagatcatccaaatattcactatgtagactattggattgatccatggttccctcaggaaactttctgcatgtacccagctccggactttgttcttgcatttcctccgtgcactcacttagcggtgtccggtgctgcacactttaagaagaagctggctaaggacccactaatccagattaatgctgtgaaggatgctcgggttgcagaagagttgggagagatttatgattgcccgtggcatgtagagaaccctgtgggagttatgtccacactgtggcgcaaacctgactaccgttttcacccttctgattatggcgggtatttaccggaagacgatgtaaacccatggtttcctgaatttatagctccacgtgatgcctatccaaaaataacttgcggatggataggtaatggatttataatcccagccacaaaacctgtcccgcaaatagttgatgtggttagcggttattccatgcaacacgctaagctaggtggaaaaagtgcaaggacgaagatgattcgaagccttacaccccgtggctgggcaaaagctgtattcttggcaaacgagcctgcagtaaggagcagaattaatgggaagtaaatttatggcatctgcatacaaccgtttcggtgagccaaacccgaaagcaactaagtataaaagtgggggaagtgtgaaacgagactatcgtgatgaaaaagaagttgaaactgtagagactgttttagaaaatactaaaattgtccctgttccacaacaaaatatcggactgatggctgcacagtatttcggtgtacgatcatccctatcccaagaggatggtgtaactgttactgccacctacttcccgtattatgaccgctacggtaatctatctggctttaaaaagcgtgactggacaatccctaaagagcaaaggggccatttctcagttgttggcatagtaaaagccaactcccagatgtttggtcaaaagctgtgtgcatcgtccaacaaccgtaagcagattaacgtttgtgagggggaaggtgatgttattgcagcgtggcaggctgcatatcagatacaagtaaaaggaattctcaccaatgccaaggccccagcaaaggttaagcagtgggctaaagaggtccaggacgggatcgatgcagttatcaacgggggtgatctggcaggaaaaccctgtctaccttttgttggaattaactgtgggtgtgcaaacgcagtagatacttttgcaaacaatgagaaatttatccgtagctacggaacagtggtccttgcaatggacaacgatgcagctaacgaggtagagaagcaaaaacacgttatcaaaggtgttgaagccacacataatattgcagcatttttgatggctgataacgtttaccatgtggaataccctggtgaggtgaacgaccctgacggtgtaaaagatatccgtgacatgctgaaggctaaaaagctggaagatattgtcaacatgttccgtcacccagttaaatatgtgcctgatgctgtatctgatttagaagacttttccattgaatctcttcgtaagaagacttccaatggcgtggatatcagtgcagagttccctaaactacagaagatgctgaaaggactccacaaaggcaccttgatgatgctgacaggcccatctggtggtggtaaaacaactgtagccaagaaactggaacactgcattgcaagatacttgatggatccgacatgccctaaagccgatgattatgaagaggatgatcgcctgtgtatgatccaccttgaagaggaccctgaggaagcaataaactctctatacgctaaccagttagggtttgatgttaaagagtttgttgaagaccctagtcagttcctgaccgatcaggagcatgctgagattcaccaatcttgggccaaagctggaaaaatcaaagtgttcaagcattttggttctatccctgtagatgagctgatcactaagcttaaacaaatggtgtgtctgtatcactgccgttacattgtactggatcacctgtccatggtaatttcagggcttaatgttaaggatgagcgcaaagaacttgacatggctatgactcaactagccgcgttctgtaagcagtttaatgtatttatcttggtgatcgctcacctgaaacgcacagagattgtgcctccaaaggacaaggatgggaatccgttacctttctggtatcctgtacgaaaagagaacctgcgaggtagtgctggattggaacaacttagctgggtagttgttggggtagaggcagaagagatggtggatcgttcccgtggacgtgtccgactggtaggtcttaaaaaccgcccagcaaaaacgttaggcattgcggatactttagttatggatccccacacaggtaagttccatgatgccagcaactggtactgggacaaagaaatgcagatgttcacagacggcgagggtggggaggttgtttggagacctcaagctatgtttgaggatcaggagcacgcagttgtagaaacacctgtaggcagggttgtggctgataaggttgtaactcctactgttaaccctgttgacacgcaagaagaccttccgtatgatgatccgtcctctgaccctgttcccggttttgaagacgatgaaacacctttttaatgtttaaccaagagtgggaggggtagtacaaccgcctcccctttaaggagaactgtatatgagtatgtggtctttcgacctggaggcctctggtttactagaagacctagatctttattatcactgcggcttgtttaaagagttgaataagaaccgttttatgctgttccttcctctaaatgaccgcacacactactctgaagaggatatagagaaggctaagaactttattctggcaaagaaaactctttataaagattttgaagttcgcatagcagatttttcagagttggaaggttggcttacaggcaattctgactggtcacccacagctttgaactgccacaactgctacagctacgactttatgctgatggagagattgtccggtattcattttgatatgttccgtgatcctaagtgtatgggaactatcaacgaccaccaggttaatctgtttgatacattggctatgagccgaatcttgtggcctgaccgacctttgccaaaaggttgtccagactcagtattcaacccagttactaagaaaatgcaacctgttggacctcacggtcttatggcatggggctatgctcttggtaaccaaaaagttcaaattgatgactggcgcgagcttccgttgtggaagtatgtggatcgtgtgttcgaggacgttatcatccaggagctgctctggaaagagttggtagcggaatcaaaaggtgtattctacggcaaatctgacatgcagaactttatgtacgatcctgccaaagagaagccgaaagggttcaaaaagatcacctggaagaatgcattgcgtcgaggcatgctgcagcacttcctgatggagctgcaggcccgtcagggtgtgtattttgacatagacggggctattgctttacgtgaccgctgtgatgcgtggatgaaggagatcgctgatcgtgttgaacctcaactccctttaaaagagttatcaatatctcagcggcctaaattccctgaaaagccgtttaaccaagatgggacaatttccaataacggctggaaatggttaaaagataaacttggctatcctgtggacatgagcgctttagagttcaaagccccgcctaagcgagcatttacctccacaggagatgtcagtaaaatggggataaaatggtgtgaagagatgggctgcaaagacccagacaagatggctgatttcttgagggggtatattaaaggcacctctacaccacaccctttacctaaagagctgatggatcaggcaataagtgatctgcagcagaagcgaatgccggaatgcaagatacctatgaaaatcagcaatcaggacgatattaagcgatacctgatcagtgctggttggcttccaacaatgtggagaactaaagatgtaactaaagacagtaagaagaaagctttacctgatgcagatgttgatgcacgagtatatgcatatatggacgagcttttagagtcagagtattgtgacctgattatcaacttctggaacaaaactgatgctaagttccagacaactgtgcacaagttccgaagcttccctaactccgaaaggattaaaaaagaagtattcgggaaaatacgtagaaaagccagggcacttatcacttctccacaactgaaagatacgtttgggcacctgtgcccgaatcttgaaaaattgaacggagaaatggctaaggatatcgtcttgtggttatccttgcgaaaccgcaggtcggtccttgatccaatcaaggaggataaggttgatactggtcttcttaatcatccacgtttgaagattgaccataagcttcctgctaaaagctctggattaacaaacacttccagacagaaacacagtatttgtgcaaacatgcctaaaccatctccgaaagtggttatgggtaaagagatgcgtagtctgtggggtgttcctccgggatactttgagatcggtattgacgggtccaacttagagcagcttatcggagcttggggtgcctttgagttcgacaacggcctgtattatgatgttgtaagtaacggggacgcgcaccaaaacaatgctgaggcgtatacaaaagtagcaggaagagaggtatctcgtaatgacggtaaacctatcacgtatggggttatgtacggggcacaaaaagataaagttgcagacatgctggatatctctccagaattgggacaaaaggtaatcgatgctctctgggatgctaaccccggccttaaggggcgtaaagaggacttggagaaattctgggaagcaacaggtaagaaatttatctactcttttgatggtcatgccatctggacccgctctaaacactctttgcttaatgcataccaacaaaatggtggtgcatcgttgtgtgacttggttgggatactcatgcaccaccagatggtgaagcgtgggtggtacgatgaaggtgttcgtcgtattatttattaccatgacgaatatcagcttcaagtgcctgatacacctaagtataaaaccgtatacaccttcgacacaattgaagagctggaaacatttaaggccaagcaggaggccaaacttcacgtgttcgacggtcataagtacaaaaaggcacgcaaggatgaggatggaaacgaagtggttgacaaggatggaaatacggtatacgatcctatcctgaacgatgacggaaagcttgaacttatctggagccctgtgggtgaaatggtggtgcattgcttctggcaagcttctaaaatgatgggcgtcccgttccagatcacaggcgagtacttgtgtggtcgcaactggggtgattgtcactaatgtaaactatcagcgcatggaggcgctgttgagcagagaggagacttttatggtagtagagccaacaaaaacatttacatccatgactattcctgttattatgcaggtgaaatgcgttcaggtgtcccaagtatggccgggtactaaaataccaacagggccagatttctttcaggttgacaaggtatacaatgtctggaaagcaccggactgctaccctttcattaaagatgaccgtggaatgctgtggtatctgggaaatgatttgacactacatctcggaaatgctattattgcagtgttccagcttaataagaaggagacagatcagtgacaacttttgttaaagctacgtttgtagaagaaaagatgacagacctatcattctttaaagaaggtaaggtctacaaggtttattacgatgaggatcgcagaaacaacatgatcgaagacgaggaaggtattgcctggtttgtctcccatctggcaaatggtgagtatcatatctacgggacaactctgcttgccaagtttgtaactgtagaagaggacctatgaaagtaaagtatctggctgagggtatgagcaggtattttacccttggagaagaatattggccctttacaagtaacggcgatgtctacgtgaaagataattttggcacgccgtggtttttacactctaacgggttaggatattctatttatcgcagtgcaatgagcaacacaacccttgcagagtttgtatagaggaggtagaatgttagtaaaaggtacccacacagtcaagcaacgtattgaagtcgagattgatgactgtgaactgaagcatattctacgttcatgctctaacgttttgctccttagtattttacaggagcgagcggagaatgagttcttaaatgcactggcaggccgccctggtgacttctgtgtgcgtaagcgtggtgacaacaagccttggctgtgggagatagacgcagaatgggattaccacaaaaatgaaggcatagacgaacctattcgagagctaaccgaaaatgaggttcagatgtatgaagatgtttgtcaatgggcaaaaagtcaacaaacttatcttgatccttggtggatgattgaaaatagccgttgacaacaagcgggattagatttaagatactccgcacagatagagtgttgattttaaaataactaaggagactgccaagatgaaaattactttgaagccagaatgcgttgcaaatgatcgagcttttaaagattgcacaattggtgcaatttatgaagcagagttttgtgagaactctctggtaaaagcccttctggaagaaggggcccctttatcacaagaagagatcgatgagttggaaaactcagcacagtgccttacctttaaagatgatgaaggagactctgtctggtgcactgttaatgaagtagtttttgtaaaacctgaacattaatacttgacaacagtgatggggcctagtataatggccctatcaaaacgaaaggggaccacagcaatgaccaaacaatatcaacgaattaaagccaaggttaagccagactatctggaaaaggactctgcttttcgggactgcacagctgacaaagtttacacaggggccgtcctgttgaacgatgaatttgaagtagatgttctgggtaaagaggccactattaaggacgaccaaggcgattatgtttgctgcaccacacgtgagctagaaatcttagaatacttcggtgaaatcttcacctctcttgatgattacttagatgacgaggcagagtgatgaaaaacatttgggatattaatatctttgaagcctctgagcttgacggtgccgatggggttattatagtttctgatggaaaggccacgctgacctctggactgacctataatgacactacctacgcactgggagatcttgccttgttaaaatcgacaggtgactctctggaagaacgtctgcaaggatttgcctttaaagaaggaacaaacaccactctgatgtgcaccacacgcactgttcagttgggcaacggggtctatatggtcattgcagtgtgccccaaattcagcaacgttaataaagacgatgctgacgctgtcaacgatgtggttgtcctttttgtgggtgacgctatggcagacctgatgaatgcaggagaagcagcaaatgaagactgaaaacattacccctgaagggttcttgaaagtataccgtgagctactgtacaccacagaggatagtgttctagaatacccagagtatcttctgctgtataagtatctgcaggaagctggtgaaaatcttccgattagtgcagaaggtggtccaaactgggtctacagtgcatggagaaaggttgatattctcccagacccaggtaaagatatggtggtttggcagctaatcaataacatcggggttccaatcttcgatgaggctgttaagatttattttgaacttgacgattaatatcaggagaccttaagatggctgaagtagttgctcgcgcaggacagaaagtacgttgtgttgaagtgggtttcggcggtaaaggttgccagaacctgacacaagataaggaatatactgttattgctggaggtggtgacgagagcattgtgtttgatgaccacattcttgatgctgaaaactttgaaatacttgacgacgatggtgatccaatcacctgcctgttggatggctcttggggcacttttgaagtagtcggttaataataaatgttgtaatttacagaaggagatgctaaaatggtgtctcctttatgttgttcaaataaaatcggagattccacaatggaacaaatgaacgatcaagcgtcggttgcgatgaacgagcaagaacaacctcaagaatttttcttagggttaagcaaagatcaagtgtctcttctgctagtgctttcctctttcatgggaagactacaggagctcacacaacaaccggaggctgaacaattatttcaggctctgcgtgaagaagaaaaatatcgtcgtttggactatgccttgggttgggtagctcaacaacgggatatgctaatggccctctctgggaccacaagttttgcaatgggcctgttggctcaagtccaggacaaattgattcaagcagggtttgcacacacggcaaacaccaatgaagaacaaggagacaaataatgagcgttattcagcaatttgctaacccgatgaatccacgtgagactgttttactggctcacggtatgattaaacgtgtcagcatcaagcccatcaaaggtgctgatcccacaacaggtattaaaaccactgtgtggcaaggtaagaaaattgaatccagccataccatctctttactgatttctgaactggactcctccgacaacccgctccagggtggtgaagaaatctggatcagcatgggagataaactgcttaaacccggtcatcaagactctgtttctgtcaaaattgatgataagtgggaaaccgtaacgccgggatggatcgtaaatattcctttgaaggcaaacgagcataatggtaagacctactacaaaggctcgctggctaagatggttaaactgggggcaggagaggctccagcagccactcagcagcaaaaacagcaacaaggtgcacaatcgcaaggccagaagcagaaacctcagcagaatgccaatcaggacgttttacgcatctatggtgatgtaactcagattgttggtaacgtggttactgttaacgatcacaagattggtgaaggtgctatggttgtctctgatgagcagcttaaagacctagtggtaggtggtcgcgttgcagctattgttgacaaagacactggtaacattattagcggttttaaagcctacccacctaaagcagagagcggcacccaaggctctggtggcaagcgtaaatcctcttacgatcctattggtgtagaaacagggcatagcatcaatgcgttgcaaatcatcttggatcgcgggtttaaggtagatagtcctttagatgtggctaaaacactgcacgtggtcactattgagcttaagaaagagtatgctcaagccaccaaccgaactgaggatgaagtaggtgccagtgtcggtaatgctgtgttgaacgcttgtcgccgcattgacaagaaaacgaaagttgatgattttgcagtggcaattactgcagaagcaaaagatgtcttgactaatctagctgagccgttgtacgattggatcaagaacggtgctgggtcaactaactatcaagaacctcaagctaccaagcaggaagccgctccacagcaaaacactgtagacgctcctcctgtaaatgatgaggaagatggcccgatggatcagaatccagcacagtacgcctttgatgaagatatcccattcagtcctgtaggtctgcagtatggtaaacatagagtgtacattctttaattaatacacagaatggagggtttcaccctccattttttttttatttgctgttaaagtaggtattctaatggaaatctatacaatgcagctctctaaatggaggctcgcaaagaaacaagacattcaaattattgactgcacattaaaaagtggagtatactattgtggtgaaagatggttagcaccaacaaaaaatcttttgtgggcatacaaagagggggcaatcaccgaagaacaatatgaaaaagagtacctcactattatgagggaaagatataccagagataggcagtggttcgtagatttctgtaatactaggggtcctcttgcaattgcatgctattgtaaaggaggaggattttgccacaggtatttgcttataaaaatctttgaccggatatgcagtcattataacattccatacatctataaaggtgagttagaataaaaggagatctgaaaatgacattagaagatattattgttaaacctgagaactatgaccaatacaacctatcaactcaatctgtagacctaggatgcgccacagtcagtgcatggctggttaacggaaaagagcttgacgcgtgcctggaagcacacatgtcggtgaataaatttctcgatgaaaatacccactggctagagggtgcaggtgtgtacgcttcgtggctggagagtatgggatttgactaccaatctgaagagggatggtggagctatttagctatctgtccagagacgctgcaatgcttcatgaaatattctgaagatttggagtatcgagctgtggttgacggagctatcgctcgttatagtcgtaaacctttttcccacgacatcaaaactgtggaagaatttattgaagttttctgttgacacaggctgaaaggtgtgccattatggcttaataaaacgggaggatgtgatgaacgaagaaaactgggatgtataactgacaggagaccgctacccatgatttatcgaatccgtgtaagagaagatgcaccaggttgttactttgactggcgtgggtggtggtttctccacccaatggatggactcacagatagaatgctagatgccgccatttatacagataccgacatagagtataatctctatctgaaggacggtatagataacggtctgtttgaagcaattcctgtgtaagggactgtataactatgttttatgatcttcctgtagcaccaccacctgttgagcccggagaaccaagatgacctatgaaatgccaaaactgattcgtgacgatgtacaaaacgcccacacctttatcatgggcaagcgcatggatattatttgtcacaaagacttctggacagagggaggttacttcatcgagtattttggtaagctggacaatggtctactgatccagttctataccgatgcggaaaacaacattcgctgggagttcgaaaccgaagatatccataaacttttcaccttcctcggtattaaagttaaagccaagtttgaagaaggtgagtgcgatgattgtggattctacgaggtaacagatttctaccttccaagtggtaaaaatctctactacgaaagccacttcggtaactcaaatatgccacaaggttgggatgagtttttggaaattgcagaagaggagctggaataccgtgattattaatactgtagagggggatctgatctcccttttcaagaaaggggcaggacacatgatccacggttgtaactgctttcacacaatgggtgcaggcatagcgaaagatattgcccgtgagttccctcaagcactggcagccgacaaagagactgcttatggtaatctagacaagctgggcatgttttcttgttgggagcattttgccaagaacagggtcgtatatggaatcaacctgtatacccagttctacccagggcccaatgctgaatacttctcaatcatgaaaggttttgagcgagtcaacgaggtattcaaaggtatgtcattgccgttctacattcctaaaatcggatgcggtattggtggtctaaagtgggaacacgtagaagatgtcattaatcttgcaaccacggatattgatgtggttgtagtagagtacaaaaagtgttgacgaccatcttctgaggtgatatagtttccacaacaactaagagaggagagcactgtggagactaaaatcttaattcttgccgtagtagatacaaccgaaggggctatattcgaatctgcaggagggtatttctacctgccatatggaaaaagaacttccgagccaagtaaagattcaatcctcaaagtgttcccgtgtgctttctggctggagattttggtataagattgcaaaggatttgggagataattatgagaaacaagaaagagctttactctggtgagtggatcaacgatcaacaggtgggagaggtaacctgcttccgatgttttaccaggtataatcttaaaactgcaccaaaaagtgttccaaagactgatggttattacataaaagaacctcattgcccaaaatgtaaatgccgattatactggagtaacctgtaaaagattgacatctgaaaactgcggtgtataatacaaacatagactggcagagaggaataaattatggtaatttttaatcgagatggtatcatagttagacagcacccattccttgaatactaccaaattgagcaatggtgttacggggactgcagtcgctcctatgggcaaagttggggatatcgcacagtttttgaatcaacaaatcttgataaagtaaaacagaaagttttagaacttcttaacaacaagtgagtatcgtgccatggtaacattagaaagacgtaaagctaacgccgctacactggcagacatcttttgggattgcaatttaaaagatacccgaaattgtggcgcatctgtagatgtattatttccacgacctactattgttgcgatgggtaacctgctggatacagttacaggtgcatgggataaggagggcggtttctatatctggcaacctgtctacggagcctggaaagaggtaagaggtgctgacgactttgggcctacagctgctaagatggatggctggaaaatttatgttggaaacgatatgaagctgaaaggcgagattgtttactggttaccttaataaaacgcaggagatagagtatgaacaaagaatggacattagtagacggcgttaaaaacatgcctttaggaaagtatatcgtagccatggctgatgaagatggcgatatcgatttcggagcttgtgaagttgttcttgcaggttccggtgagcatatgtgtaaaactgggataattaacggtcagttttactttgatcacaaccctgttgtagcgtatatggctatgccagagttcaagctcccaaaggagtgcgccaatgtttaagctaaaatccgcatggaacattgctgtaggagatgagattcgcatcccaggcgggaagaccattatgaagatatctcgtattgagtacgaaggtgaccgtgtattccacatctttgcagaagatggtcgagaaatttatgtgcaggcaggctctcacatctatatccgtaagaaaggggatgacaaatgacagaaatcattatttcaactgcagggtatgtgttcctgacaatcattgcactgactattttggtgacagtgtatgggtttgttatccttcctatccttgagacatttagtctgtgtcggtgttggagaaaagcttacggtccacaaccgtggaaggactggccccacctggtacgcttagcgttctcttatgcttacgatcactccagcagtgcatgcataaccggataccacgcccacaattggagctgggaagggttgaggaagtggaatgttacaaagactatacctctccgcatgtataaacctaaaaacaaagatagctgatacttgaaaatttctgacatatcaagtataagggggatttctaaaatggattccccctttttgatattttacccagccagatattttaaaattcttagaaaatcagaaaatggatcgaaaactaaaatggattttttcaggactggcgtggcaaattgtgccaatctgtccagccgtttgcaccatatttgagatcaccattctagatttaccacacatacacacctctataacatacctttctccacctactcttagtaatttatgacggaaaacccatcaccatcggtaagttgcggtacaatttttccagtactcgatctacttttcatttcagggcggggattttctgaaaatttttctcgatagatttctcagtactcgatctgtttttcgttttctgaattggattttatggaaatcgttccggctctcgacctgaaatttttggggacgaaatcgatttttcgttttcagaaacggatttttaaaatttttatatgggaatattttataggggattattttatgtggaattgtaacggtaggtaattagcatgctaactaaatttatgaaatgcgaaaagttctcatttagaattttgaatgataatcattctcgtttgcagaataacgggcacccccggtgattgtctcccggcccctactgccccggcttgttattatagtaacacacaggacaaagaaagcaagaagtttttgcataaatttttagacgataatgataatcgttctcatttcatgcagcgcccatccccggtggttgtctcccccgtcaccggtgcctgccgtcctttcgatatgtatattgtgccacctggcggggccgctgtcaacacttttcaaaaaaaaaaaattctaacctgatgcgctaaccgctgcaacctggcggggccagcctggcaggacctaactgaccaggtaggagagaataaaggcttgcaaacctggtgggcctatgctataggataggtaacaattgaagaggaggtacaaaaatgaaaggtaacatgatccccctggaaaatgtagctattaatgacgctgaggctatcgccctggttgaaaaggctatggcgggagcgttggaacataaagaagagtacgaaaaaatgatggttaacctggcaggggcggcggctggagagttctgcccaaaaaataattttaactaatggttgacagctcggacagttcttgttattcttatcctcgcaaggtgaacaacaccacaccaattaacagagaggataaaaaatcatgaacgcctacggaattaaagtacgtcgcaacactcaccaggtggtcaccgatcaaatggtttgccgggtggatgtaaccatcaacaacgggcaaggcctttataaattccgtcgcggtcagagctatacccggcaacagcttaatcgttgcgccctgacaaaaggtcagatcaaccactggtttaataaaaaataagtattgacatatagtctgacaccaaatacactaaaagcacaaaagacactaagaggataaaatcatgaaaaccactacctttaattttgataatgcggacttttctttttctgatgtcaagaactgccgccgtgatcgtggattttacaaggcctataatctggtgggcctggacgatgacaataatttgcacgaagtagctgagatccggtattatgccgccgccagtggtaacactcactactgtgtattttggattcacgacaacaagaacaataagtacggttatacgggcgggaaggcgagcggtcacggttacgataaagctaatgcagcacttgagagcgcattaaatgctatggggatcactgccaacggctggatctatgaagaagagtttttgtcggaacttgctaaccacctgggctataaaaagcacattgtaacatgcgcccacgaataaaaattgttgacacgctgcaaaattcaagtaaactggtcacaaaaggcgggaaacatcccgccaacacagaggaaaagctatgaataagaacgtacgccgcatcatgaacgaactggcaaacgatgaaaaaattattgacatgcatttggtcaacatttgccgccgttgtgtaacatataacaaccgcgccgcaaaagcgcgtgagatgaacgcaaaaggcaccttaaagccattccaggtggttgtaaaatctatagcaggccaggcgcatgaccacaacaacgggagcactaatattgatccgtcttacgtaatgaaacggatccggacttgcaagaataaagagcaggtgtataacgtcatagattggctggactccatgggcgatgcggtttataataggttttctgcagctatcgagatccagcttgacagattggacgggaaagtactgaaaacttattaagtttatttttagatggcctttactccagggccatcaataaagtaaactagtctcaactaagcgaaaaagggggctttaagatgagcactacacgccaatacacaaaggtaactattatcgtttgcgttgtcggttacatcctggcgcaaatgttaatgagtagcgccaacagttttgcaaaatttttcttaaatttttaattgacaagctaacccaaatcagtatacttaaacacgtaaacgggaaaacttcccagaacacacaaaaggagaaaacaccatgactactatgaccgccgcagaaaaagctatgcagatcgccgagctgaaaaaacagatcgcagaccttgagaacaagatcgataactttgaaatcgacgaggacaagtacgacgaaaactatgatgaatggttagacgagatctacggcgaaatcatgatcggaaacatttcttttcttccgtcgcgtatcctcaaggagctagatcctatcgcttaccgctgcggatttagcgactacatcgacagcctggatattgatgacgatgaagaataccaggaattacagacagagttggaagaagcaaaagaagagcttgcagaattggaagaaaacgagtaaatttatttttagatggccttgacttcagggccatcaataaagtaaactttatactgttaacactgaactaatgcataggagttaaaaccatggcagcactaatcaccaaatattatgcccctaccaacaccaaaagcgcccgtatcatggtaaaaggcttcggacgtaaaaaggtttacagctgggattattccctagacatggaagacaactacaccaacgcgatgaccgattttattaacgagctgaatacgcggatcttgacaaattacaaaattaccgatattgcctacataggtgaaggcgggatctgttttgtcggtatcgtcaaataagttgttttttcggtggtcctgggtgtagggccatctataaagataatttattaacaccacgaaaggagaaagtaacatgatcagcggggcaagttttattattggcgctattgctacggctttaattgtaaacaagatccaatccaaaaacgaaaaagagagcaacgcgctcacagaatacccattttgggtattcaacgacaacgaagactatataatcaagtacaagaatgagaacggcgatcaggtaacaccgcgaccgatcccggcttacaaaatgcaggaaacactataccgcttaaaggctggcggtgcaaaaatcgtagacttttggggatatgattgcactaaccaggaagctataaaacgccgtatccgggcgattcaggcaaatattgagatcagtaaagggggaaattatgaaaattaatttcgaaaaaattgtaaagcgatctcatgattccgaagatttgccggaacgccgtcagcggaacaacaagctgaataagccaaaaaggtttgggaagatctggcggaatcactatgatcgcaaattaccgggcctgcttttggaacgtgaacgacaggcggaacgataccgccacaaaggcaaataacaaccaacgccccgccattgtgcggggctttttatttctatcctacgaatagcgcccctggttggccctgtaagcgccaaaaaggcccccacctatgcaatcgccccctttaacctgaaaacatcgcccagggccgttttatggcgttaaaaatatcattgacatcgtcaacaggttagctatactaaccacatcaaagagagaaaggagtaaacgccatgcgtaaattaaaaaattttgataaagttgatgttatcctgaataatttttactactgcaacaacaaggctatttggtggcgtgatagttccaccgataaagtcaaggcgcgctttctccaagggcactggcaaggccgcccagtgattaaaatcatggggcaattggtagcgtttaaaaattgccgccgtgttgatgacgttgaggatattttaaacattttgcgccacaacaatttaaaaaatagtgttgacaagtaaatctcgataagtatacttaaccatacaggcgggaacacttcccgccactaacaaaaaagataggagaaaatatcatgactaccgttaatattaccgcaggttgcaatttatctttcgacgtgctgaccgacgaacaaaaagaaaaagctattgaaatggtccgcgaaagagaagaacacagcggagaggattttttcgcagaaagtgtaattgaatattataaagaacaagtttttccagagtacggccttgaagataccgatgtacattggtccggcttttggtgtcaaggcgatggcgcgtcaattagtgctgaaaatgtagacttagaaaaattcttgcgtaaagtcaaggccctgaccaagttccgatcaattcgtcacttgttcggcacaatgcacgatggcgaactatcagctagtgttgaacgcgacaagtacagccattacagccatgaaaacactgtaagcggatatattgatactacctggctagatctgaccgcaaaacaagaaaacaaagtggaagatctggaagagctgatcaccgagacggtacgggagctatcccgcaaggtttatgtagaccttgaggaggcctatcttgaacagtttactaccgaaaacctgataggccttattgaagccaatgattggcggtttgatgtggatgaatatggggagatgagtttttcataaataaagtattgcaataatctaaaaacctgctatattaaaactcaaggggcgagatgacttgccccacacaaaacaaagaggataaaatcatgaaaaacactactaaagctattgacaccgttatgtttaacctggttacattccgtgaagatatgaaagatcttccacgtgaaacagtgtgcgaccatatcgaaaactatcgcaaacttattaaagaattgccattaaaacgagatcagtacgcggctaacgctatgcttaacgccatgatcaaaaagatgatccagtgtgatttaactctggcctatgattatgcaggtggtcgttttgcagtatacaatcagcccgtgcctggtatgagcaccaccgaagaattgcacgcgctcaaccttaaacaagatgtatgggataacatgccccgcgtggtggtgtgggcagaaagcggaaagatttacggcgataatttttaatcaggtagcaggcggcggcatatttgccgccttattgttaagcagaattgtaagagaggtacacagaatggaatttattattttggctgtattagttgccttgttcaacgcctggatagctggcaaaacaggtagatccgcttttctatggtttgttatatctattttcctgggagtggttgcaaccattgtattagttatccttgcaattgttgacaaggataataataagaagggtaaagtattttcagacctgtatgacgctcaaacttttgttaacgcctattatagtgatcttccggtctccttgcgctgcagcctggcgcaacaagttttcgatgaagctaaaaccagagaacaggcccatgaaatatgtttaaccgaggcagatcgcctattcgagaggaatagaaaatatgtggaccagccgtttaaataatgccacgttaattaatccctttagtgaagatttgaagccagcggcctggcgtgagggattcagcacagaaagatttattttcaaacctgaccttgaagaattttataacaatggatcgaacaacggcggaactgatttttcttgtagtgtgcgtagcgatagtactcctgggggccattgcaaaccacgtcaccgctaacaggagggaagggggagacgatgacaaccaaggataagccccgcaccgataaggtgcgccgtgttatggtatggcttgagattatcgcccttgaaatattgctaggcgtagggatgtactttatcgctgtaagtaactgataacgcccccgattatgggggcttaattttttcaaaaatttttcttccggggtgttgcaatccgatccgcaatatggataataacaatcaacggggagacatcccaccaacacaaacaaaagtccgaagaggagaaagaaaatgagcaagaatattcgcgttatcaattttaaaaaagatgaaaaactggctgttctggtcgatggtcaagaaatctttaaaggtgattatgaagatcatcaaactgcaattagtatcactcgcgtgattggttaccataatttttatcctcaaggcgctgaggcagcagtaaaacgaattaaagagattgtaggcctgtaaaatttatttttagatggcctttactccagggccatcaataaagtaaatttaaaccctgttaaaataatcagtgcaaaaaggagtaatgatcatgtttatccaggctaataatctttatttctttgatggtcagatcgtagacggcgtggaggtggaaattactgggtgccctggcggtcaggttatgacttttcggaataatgcctttgatgattctcatattgttatgagaatggaggttagtaagctggatgacaagaaaacacttatcgattattccgtcaaagatcatccagactaccacatgatctatggtgatttgtgtatcgttgaccgtgataaagttaacggcattgtgatcgctattgtgaacgatgttttctctgagtgttccggcaaatgatgcaaaataaggcccctggcagggcctgcagcgatataatcacataaaggctatgcggttgcatggcctttattattttagcgttacagcggcccccaaggcgcttaaaaattttttaaagaagtgcttgcatcaagccctacaatatggataataggacgtgtcaggggggcggccccaatcattaaccggatagataggagttaaaaccatggctattgttactgctggcgatgtagtagaaatggaagcaaaatacttaaaagcgggtatgcatatcctacgcaacgatctcgaactggtcctgacaatggtcgactataatcccggccaggattatccaagcatcgactacttttttgagtatgttgatgaagagttgaaagaggatgaggcctattgcggtgagttctgcaacttcttttgtcctgatgaggttgtaaaggttatttatcaacctggcgtagctttcccgctgcacgctatcaataaataaaccgggcggggccgaaaaggccccctacagcataaaattatgaaaaataaagataggtgaatcatcatgatggaacaaattaaacgcgctgaggctattaatggcaatgtgatctattctgtcagcaaaaacgaaaaaggcgtaccatatgcggcggtaatagtacagcctgacggcgattattggcttactgtgtacggcgcgtattctttcggtcgtccagtgcatgataaaattttgaaagtagctaaccctacggggaagaatatcacggcagaaaaattttttgaaaataattgacatgaccgcctgagagtgtagtatataaatcaaaggggcaagccccaccaaccacaaagaggataaaaaatcatggctattattgcaaagaccgagattgcaggtttagattctattctcctggcatatgaggaagctatagaaatgtatgtagtttcctatggtgagtatatccgtgaatatacatctattgatctagcttttgaatgttatatccgccaggtaaataaagcatatgatgattatcgttaaaatagtttgacaacaaacaaccatctaacaaagcataatacataaggtggtagaatgatccgccacctggaacaaagaagaggtaaacaccatgaaaagcaataaaggttataacggttacaaaaacaaaactcattggaatgtaagcctttggattaataacgatgagtcattgtaccggttggcccaaggctttattaacgccaatgctaatcgtaatgatgcggcgcgggatatgatgctttttctggagctaaccggacaagataagaccccggacggcttcaagtacagcactacggcgatccgtgccgcgatggttggaatgaaacactaaaagcacatagccgccttaccctggggccgtggcagcggccccatgaataaggttactaacagagaatagaaaacatgaaacagaaattaattgatgcggtgatcctgattattgccctgggtattggcctgattgcaaccatggctaatatgatcttgtcttccaacggtatcgggtgaggttggcaaatgatcactaacaaaacaggcaaaacagaatttttacgcaacttacagatcggcaagcctgagatctggtattgcactaaaacaccacgtgacgaaatgaaagacttcaccgccacgctgcaacgggtaaagatatccatcacgcagaaaaaagccttattagtggtggaaggggagatcccccaaaccgttgttatagttgagcgtacagcatagtctaatttataccgatacccgaaaattaaccaacaaagcataaacaggcggttactgccgccttaaacgtagcagaaagaggatagacacaatgaaaaagatgatcgcagtggttgccctggttgttggacttaatgcgcctgtaatggctaaagagctggcaaaagaggtagatctaactgatatccatgccgtcaatcaaatcggggtgacttatcgcctatgccttgccgctaaaactttccaggatggcacgacagagtactacggattcgagggcgtccggtgcggtgaacttgctcgcgaccttaaagaagatccagaccttgaggatctgccgataaccgtaaacgggaaaacttacgtgaaccgttaaccatgaaaaagataatcatcatcctggggattgtggtggcaatattggcgatctttccccttatggttaggtatgtgctgatcagtgttgttctagtggtcagcgatctggtgttatatattcactcattgttttaggtgcgataatgaccactgatgaagctgtaaaagtgttggcggtattgagatatcataatcaaacaaaggttataaacgatcctgattatgttgactcaaagcgtgaagaggagacactgaccgcaatatggattattcaagaattgcttaagcgcatgacagagaaaaaccgacctgactacataggcgaaaaaatataatccttattaactagaaaacagggcttgcgatggtcctgttttttgttatacttgtttcacggcaggcacctggtgacggggggagacaatcaccgggcctgcctgtcatataagaactataaaaaccgttgacatctgccagggggtagggtaacatttatcttgaaggggcaaaagtgcccacaaaacaaccagaagagaggaaaacattatgtcaagctggattaatcaagaagtcgaatcacgttttaatgctatttgggatctcatcgaaaaagaagacggaacatcaagcccttacctcaataatcttgaattccattttgtggaagcgatgaacgcagaacatgatcacgaaggtggcgcggatgagttcgctaaaggttatggcttcaccaatgccaacgaaatgatcgaggcggttgtactccaggctgaggaagattatcaattaaaaacgcttgaattttgccgccataagtaataagataatgacacgggccgaaaggcccactaatcataaccacacaaagaggaaaacattatgaagcgccttgaccagctcaaattagttcaatatatggcttatcgtgttcttgaggtacagaaaggtagcaaaaaagaagtttgcgaaaaagcgtacaagatctttactcgtaaaaaagatgactggatgttacgccagaccaaaaaggctgacatcttggggtacctggaagaagagatccgccttgaagagcaagaagagatccgccgcagtgaggcagattatcaggcagcttgggaaaactggatgagcaacaaataatacaacaagttacacggtcagggggtaataaagccccttgatcacataaaaattatgctatccttgttgacaaggatcggcagttttgctatattcttttttgaagggtagttgtaagaaaattaactaagaggtaaaaaacaccatgaacattaaatctgataatcctgcatatagctttgataacgctttttgtcacggtccggcggcgaaaggattcgaaatcgatggtaaactaattattgtcaatgttgacggggaagaggttgcagtatatccggtggcggacgttaaaagccgtctacaatgccgcatggatgttaccgcctatcagcttgatccggtccgagtagttgccctggtcctggaggaagagatcaaagccatgcaccatagcaacagatttattggtgacgcgcaggataatatgaaagtatgccgccataaagttaatgaagtgcttaaagagtacggctataaagatcttatgatcaaacgtgaagaaaaatttagattccgtaacgacctggcaaatcgaatctatgaaatatacgaatcattataatttattaactaaattatcaaggggcttaaaggcccctttctttttgtctgctcttcccctaccataaacggccctacctggcaagtggaataattgactagccattaatcccacatactgtacaaatatacatggaaaatagctattgcataacctttcattgtgtggtagcaatgccatttttacccgttttctctcccaaaattgcacgtaatgccgctattgcacaaaatttaacctgatgcacatcttcaatatcttgtcaataactaaaaatctttataagtcatacacttacacaaccataaagccgtgttctacgtgaaaaatcgagtataactatagccgccagatctcagaatttacgtacgttcaccattctatagtctgctaagtatttattccaaccacagaataacggaatagtcaatacctgcataaaataattattcgtgtaaactgcataacatgaatcagctcaggtgtcaacatttttcgtaaacagcccgaaattatcacggtgagttatcataaacagagaaatctttagtcgtctaatgtttactgtacattactatcctgactgaaatcattagatgactaagaaaaagataagaaacaattaacaatgcaattattttacctgtaacaataaggcaactatgcaaacgaatggcatggcgcgacggagtcgcgacataatataaaagcagtaaccatcacccccgtgatagtttgtctgcaatctattagtcagatcatagttgccttgtatttagttaatcatgacataacaagcaaggcaactatagatcttctaatagttgccctgcttttatattatgtcatagaaacgcccgaaggggtgacctggtcacctggcatagccagcgaaagattattaacttgttaattgttatcatgcaaacgaatgtcatggcttattattggtgtgtgaatggtctatacgtgaacagtgaatcatgcaatagtaacagtcgttattgtgtcatgttgtgtcatagcatatcaccattatgtcacattatgtcagacaagtttttctcctctttgtcaagtgctgcatgaaaaatttacaatctggtatggtagcatttttgcggccatgtttacattcagtaatgtatgtataatccttgttgtgtgggcgtttagacgtctaaatggctagatggctgcaggttaatatctaatctattggctgctaactatatcccccacaaatagtaagaaatgcaattgttatatgcgtaaacagtgacgcatgttatcaatccctgtatgtatcgccagtggtgcgcataatgggtattatgttaaattgcccgtaatgataactattctcacaatgataggtattctcattcaccccacacaagatgggttgcaaatgttgtgccactgtgtgaacggcctcgcctattaatttgcctcactgccatgatatttgagaatcgttataagaatgagaagtattcccattccgtccgcctggcagcactccagtcgctaccggctcctgacagggcagcactcctgtaggacaagcacaaaatcgtggcataactggacccccttcagatatttctggctgactcttcaggtctgtgtgggaaaagacaacctctccggcggcggggcaggggtcaattaaaaaatttacgtggtgtatgaatcactcttcaggcaaggagtgtattatgggatgaaaccctcttcaggtgatgatatttgtgggtgtgatatttgctggaaagccagatatgacgggactcctggcggggcaggggtagtacaggcagggaaaatgtgaggatgtggtggggtaatttgatcaggcaggtatgatatgagatatgttacaggtatgttaaatatggaggttgaatatctgcaggatttgtgtgtaaaatcaaggacttaagtggtgttgtggtattttctataaataattcaagtttaataggtaatatttgtctctatccgctttgtgtggtaaacagatttagatgaaattggtttacaagtgtatacataatatacaaattaaagatacaagaaacccccctcccccttcggctaccattcaccttttcctctgactggtacttaaacacttattcagactcttcaggttatcacccatatactatatggcagtgactggtgtcctccggcccctctttcgtcacccgtccgcttcgccaagctaatgccatagccaaaggttcggttgttcaccctgttcactcaggtgtatctccataccccttcaaaccgaagagaacagaaaacccgaattactcggtaaaagaaaagagaagaacttaattttatcaggataggcaagaatgtcaaggcatgactgctcactaaacaagcaaacagtcatgtgtgggaggtaagtagttgtggtggtgggaaatttagttggtgggtattataggtgctccagcactttagccaggcagttaattgtgtgtcagtccagaggttcatcacctgattcactgaaatcaatgttcatagtctcttcccaaccatcaatttcagcacctgagtagagatctttggggtctacattgagggcttctgcaacagcgtccatgtttaacacctctggaaggtaagattcatcaaattcaaggtaaatgaggccgcgagtgttgtcagccccaccaaatatttctatcttcatgaaatctcctctgaaaaatgagagtgtgaacggtgtttcacacgttctgatatacgtggaattatacacgtttgcctcttcaggccatgctttagcatgagaaacctgtgtgggctcggtgcttcatagtctcccacctctgaacccttcgtgatcaggcataacagagaaccggatatctacgatgcccttccgcgtcaggtcatcagcctcagaatcactctgtgattgcagtagagggtcttcagatgtgagtgttggtcatgctccgcctgtgagtattccagcaacaaccattatggacgtaatgatcatcaggatcactactaaaacatcggacaatgttttcattgtgcactccatattctccagactatgtgtggatactatcacgggaggaggagtgtgtcaacagaaacgccgcgagggtttggttaaaatccgagcgtatggtgatttgggtcaaaacggacgtgcgttctcgctacgctcgaaagaggcagtcgtgtgcaggaagctcttaaacgctctgtgatgagattacctatctaaggtatgcaatcgtgcatcagataaagaaaaggacgccacagagcgtcctaggtgccttaaatttgatattttgctatacccatgaaggtttgtccaggtttgagtagctaaaaggtgtcaaaaggtgactgtcaaaatctttcaaactctccaggtctttttcctcgtcctgacaccatctgtgcctacatttattgttgtagtgcatggaatgcatggcgttctgcaatttaacaggcacaagtgattcaggagcagataatacagtagggtatgccagaactacctcaaacagtggaaacacatcaaaactgaagtctatttctgctgaggtggctggcatgtatgagtatttagctgtctttgtagacataattcacctcacacaggtttgataataccttcaccgaatagctcttcgtatctaatcttatccggatcccactcctggataatttcgaagacaatatccaacccaggaataatcacttctccagtgtcaagtttggcaagaacaaaaccagaaggctgaatggtttcccagttgcgacgattggaatagaagacctcgaaaatatcaccgaccttgatctgttgatcaagatgttcaagattctctttcatatagacacagcgtatttttcgtgcaggccatagaccacctgcatcacgttcattcaattcttttacagtaatcggcatacccatctcaaatctccttcatagatagtaaaaagagggacccaagcccccctctttgtcattattctacagagcgtttgaacagaatgtctgcctcagacatgtgttcaacctcttcttcgattttagctcgacgtttttcagcctcgtagcgaatatcgaactcggtagccaccagagatttgatgaatttaggggaatacaggtgatcctgcttctcaacaaggatgatatccttgatagcatctttcagatctttaatctgaagctgaagttccaccagctcttcaattgtcttacggaggcggtcacgctctgcgatgtcagaaggaagagaggtgaacagttcaactttagatttagccatagtaagggtctccttatattgttttaaattaacgttctacaaaaataccgttcagttcgataaccaagaatttctggtcttcgctatcgtcacgtgccagaacctcacagacgtagcggtcatccccatcatcatcacagtcaaatacaagactaaggactttatcatgataaaccttcgccactactgcctcgtaagtattgccgattgtgaatccaagatagtccccgatgcatttgacaacaacatggtcgccagcatttaagtcaatcttcgtcattactgcgctccttgggtaataatatggtatgtaaaactttaatcagagatgtgaataacgccccaaaacacaccgatagcgctaaaacagacaaggccatcattaaagcttcagtaaaatcggtcattcctcacctcttgttagtcactatactatcatttatctttgccgtcaagaacttttttaaatctctcagggatatctcccgttctcagatagttcatgacctcccaaggttcccacttaaacttcttgcagagcagggcggctgagattgtttctttgcgaaaagaaaggatattgatatcccactccgagaaccccagcttccgaagagtagctatagaaatcctcacagcaacccagcaagaaaaacatgcaacaaacgctactgctacaacccacatcaggatgttcatacaagcaccttattgaaatacgagacacagtgccaaggttgctgaccagcaaataattaacaaggcggttgcaaccttggcaagatttatcatagtgtctctaggatttcatatccttctggtcggaagacaagccactccgctgatccgttagggcgatatgctttatacagaacaacctgatctcggcacatgcacatggctacatagttttcatccacacctgcagcctgcattgcatcctcttctccggcaacagctttgctaacgacttccttggtaggcaggtgtgcgatcagctcgtcaccatcattaattccaaaatggctgagttctccatcggtatctttaatcttaatcttaaccagatctttcattaatctttctccaggttcaaagggcctaagatctcatagcctagatttgaagttaccagaggatcttccgcatcttttgtattgtaccacccgtggataaccagagttccactacgtttcatgtctaactgaaactgttctgccatttcctcatccatctctaagatctccatcaggtatttgatgttaggaaggtaggcagctgttacagtcccctctaccaggccttcgggccaacctacatctggatggcaagtaggaactaaagaggtcagtttaatggtgtatgctttttctgcacgggctttcagtaacggatcaatcttcattattcgtccccctcttcggtgcctgcttccaggagcaggttaagaatatcttctgcacaaggctcatagaaagcttggccttcataatctacgacttggtagtcatctccacgaataatcagtggatcactctcaaaattatcaagacctttaacaactacaacacggtcgattgccatcatcgtaagaactttatctacattttcctctgccacaccatactgcagcaggatgtctttggtaggaggaacagcatcaaccacaacaccgttaccaaaacctttcgggagtttagctaaaatatcttccggaaccgcattcatatcaaaacctgtgatctctactttcatttacagcacctcttcgtcaactacttcataaaaatggctcgggattgcaatagcgttctcaccttcacctacaaatacagtcccgtcaaggatcaacattataagaatgtctgtaatatcctcctccggaacgttgccaaaacctttaatcaacttatatgtcgggacattcgcctctaggatgtctccatctttagaacggaaatcaacaccttcctgaatctctgccgtttcaaggtttttcaatttaatcttcatcaatcagtctcctgtcttgttaagatgaaggtattattgcacacagggttggtgttgtcaacacctgtgtggcataaaattactgaaacagtgcagataaattaccttctggtgggaacttatctgccaagaacggtgttagaacagttgccttctgaatatctggggtccactcgttgttcagaacatcccagtagtacgcaatgttgctgtgtgggtgccgcattacgaactttttcccctcgtagtcagttgaaacctctacagaagaaataacaacagaatcttcaagggtttcttcgtagaaagatcctccctcaaatttccaacgagatgcaagagaccctgccttaaacgctgcagatagtggactgtcggcaagaacatacatttcttgcactctgtcactgcgatctttgcttcttacgttgtatacagtatctgagctatactcaacacggtatagacttaccattaccgcacctcctcgataacttccacatctgagcctaccacaaatgcaaaagggcaggtttccttaaagatatccggatcaccgccaagtttgctaactatctctccaccattaataaatacaagctcaccgatattcatcagattgctgaaatagtatccataatggttaaagaatgcggcggggtcaggaagactggtagcctcaagctctacatcagttgaggttactttcttatcataacctctcgccttttgagatgcaagatctgcagaatcttcaggagaccggagatgtataggaattgtttcaccaataaaacgtactttcatattctcacccaacaaccatagcttcaaaaggtgtcataaacgaataaacggcatcatcatctgcttcagggaatgctcccaaagactttatatctgagcctttgacaaacacaaggttctgatcaaaagcctcttgaggatcaatccgatacatatctcgtagggtatcgcttacctcctcatcaagaggtgagtatgctgtgcacgtttttccgatcaagctttgagaatcggggtatccccctgaagttttaaaatagacaatcatatggtataacctctggtaaggaatggggactcctttcccacaaataattacaaacatttcctatagagggagtatgctaacccaagtagtattactcttctacaacctcatacacatccggagttacaatcagctcttctccgttacccggcgcaacaaacaccaccaaaccttcaggagtgtgctttttagccatctcgataacatcttctcgcaaagctggctccatcagatcaaaaccctcacctagggcatcacgaacaaccttcatgtagtccactggttgtgcttcaacgatcatgccttcaaccagtccacagtttttgtctgccagctcagtttggaataatttaattttcatttagaggtctcctcaattatttgatattaatagccgtaacctaacacattaactacaactgcgattgcaaacataatttcaaagcatgcaatctctacatttgggactaatttcttaatcatgcccattgtagcacctcaatctaaaaagtcaatctttactttaccttttcccttacctttctttccaccgcatttagccaactggcgtgctgcaacatccaccatacggtcagttgcctcgtaagcatcgctacctttagctttggcgataacttctttcccagaattgtcaaaaatgaaagccataacttcctggtgatcattttcaacttttacactcacacgtgcatagttggcagaggggtgcaaacgctccagcttggacattttgttggaaatgaaagacaccataccttcagtgatctctacgttgccagtgatttcaatttgcataatgtgctccttttaaagaagagggaaccaaccccctctttgaaaacaatgatactaaatctgaagcgttgtgtcaacagtttttacaacttgttgtcgatagtttttaaaatatctactgcaagatctgccattttacgaacatactctgcaaactcaacaggatccttgatcaatgagttcacagggtcataccctaaagcgtttaaaatggctacagcatccacgaccttctcatcatttgcgaagatctcaccgtcaaacttgtaggtccattttgagtcaatcttggcagggaaggattggtcaatgcttattgcaccatcctttttaaacgctccggtgttatcagtgtccagaactaaatccatcatgttggtacctcactgtttcagtttagcttttcttcaacaataccataacttggggtagagtcaagagctttctggtttaaaagaggtgtagcagagtctgcaaacggtgtccaagtttttgttctggcgttccagtaatgcttcactctggaatctggatgcactataacaaaaactttttcacttgtcaacacattgatttcttccacacccttgctaacaatttccccatcatagcctccagtctggtaaccttcgtaccaggtccttgcataggcatatccagcctgccagcatgcagcctctttagaggtggagactacgtagaaatctttctcaaattcagggatacgcccttgctttacgctccaggctccgcgaattttcatggttactttgaaaagtttgttcttcacactaccgctccaacaatctctgcgtctgttcctacaccaaaggcatagtaagactcttccccaaagtaatactctggtgcacctgccttaatcaagtctgatccgcagataaataccacactgtggggcacagaggattgcagcgtggagtgcagctgacgaacaggatcatcatcaggcaaatcttcgaagtatacagcaggaacgaccttcccttttaggaaggattgtcccaagtagaggttagagtcaagaattttaaccttcatgatcatcctccactatctccacatcctctcctagggcaaagttgtaagtccactgactgtcaaagcattcctgagatgcgccagcggcaataagatctgacccttttatttttaaaaggtcagggtaatcttcattaggaacagcggtaaacacttttccaactaaaggctcttgaccaatatagaagtttgaatctaaaactttaactttcatcagcggtctccatcgggcggctgtggaacgtaaacactgttacgaatctcgtcagcagtgtagtaacaagttttcccctctctgtctctggcagcaatgtattcagctataccaataagtgccatagacttggtggcgtatcttttaagctcgttagctccccagcaaaatctctgccaaaacggtatgaaaccgaataggtacactttctgtttcactatccaataagtgcctttacagatcactttaaactctgcagcactgttgctaacaccattgctcattattttctccttttatttttctgaatttggcaagtattgcacattggcaggaggaacaccggatagctcccaaacaaccatagtgctgtatcctggcacacttctaacatttaaaagagtaggggcaccaacacatttaaacttccttttcccaaatccgttctccatcataacccagtatccggtatcctgatcacctggaatttgtgttccatcattgtccacccagcggacggtccatttcgacacagcaacagctctatacttaaactttttaaaccactcaaagagtttcataattcagcctcacttggcaactcttccaccttaacatgccgaaaagtgttaccgtaatggttgatccatgccatcagctcactttcttgctcttcctctgggatgaactctcgaatgctgacaagttttaagaaaacccaatcacaatctgcacccattctaccggacagacagtagtgcttcatagaaccctccccaccagtttaaaatactgcctcttttagcgatccaagtagcagcaggcgtgaaatctgatccacattcatgtaagattcaatctcctctcctttgaaaggctctcgacaaaacagtactgcatttgggttttcgctacgcactatataatacagatcgttcaaatcattctcatagtatgtattaaatttaagaattttgtcactcattttctggtcctcttcttggatttttgtggagaaacgctttctgcaatacgagacaaacgttcttccgaagccttgcctattccaggttttttgaggggattatctttacgaccgcaatccaattggatatcggacacctctcccgctttgtaagtcaattctagcaaaaggttgtcgtccttgtcaaatgtttttacgataaattttttatcgttctcctgaacttcatatctagtacctgcagtatacagcatggtgccatcagcgtaagatatccagatcattgcacctccttctgctgcaacagcatcaactctttgttggaaatctttactgctgtctttattgtcccatcttcgcggaaccacgaccagaattctacagtgtcaccactatcaagcaaggcatgaccatggtaaaaatctttgtccttagatagtttctcatctatatctgcatcgacacattcgtgatccatagcattctgcctgaatgcatcggttatgccaatgcacgccttactctcaagactggtatacccaatatcttttaactcagtttcccaagtccagtagcctataaaagctacaacagctacccacattaataatgttttaatctttggcattctctctacctctttcttagtttatttcactatggcacatcctttgtgccatatttcacccactacttaaatagtagttcaaaatagtgcaaaattagcagaagttgaactacacccagtgcaacggcgagtatgttaatcttagaatcgaaaaacttcttaacttttactctaaagggttccttaatatcctttacgattctatttatagatgatctcacatccctgattgccatcctaaacattggagaaggatcttccttctctgtaacggaatcgaaaacatactctcttcggtcataaggaccgccagctctgcgtattaacctctccacagagacctcgaacgacacacctgtaacgtaatcgtctataacaagtaatgacgggtcttcaccatcaagaggtatcaaagttatcttcccagattttgttgaaatctctcctttttcaagcaaggtgtaccaatgctctctaccaagactgttgaggcacgtttttacatatttaacaaacatcgtcacccctcatcgcacgtctgatata

SEQ ID NO: 6 - DNA, 349740 bp, Unknown
  Myoviridae
aaactattttatcaggggagtttttcgtgtgccttactcctgggctacttaacggggagttacttatttcgttccccgtcctgatgtaaaacattatacgcctttaaacatagtttgcaagtactttttaaaaatagttttcagtactgaatattaaaaaagtattgacagcattatcaagtactggcataatataccccatgacaacagctaacccaccgggtgcacaattgtaactatactaaactaatttttctatagatacactcccgcaccctatgggctacggcttatctgccaatgaatacattatgccagtactgacaaaataagtcaataccggcaattgtaaagatttgtaaactgcttatactgcaatcgcgtccaggctataataataataagtgccgtattggtgtactttattaccttttatttcagtactgaatgaatccgaacggtttgcatatgatgttaatttaaagtactttgatttgctgatacgttgccatacaccacagatccgctgtaagtaagtagttttattcgtggtagtatcttttacggttttaacttcagtcatatacatattagtcatttttattactccaggttataggcgggaagagttcccgctctcgatgtaaaacattatacgcctttaaacatagtttgcaagtactttttattcaagtactgcaatctttttagtacggtacacggtcacgcggttgccctttcggtcgagctttatttctaccactcgacgcgatacactatcgggactttttaaggccgctaaccagtactgtaatgatctggcggtactacgctttacaatggcccaacgtttaccacgttccgattgtacgcccatatctttaaacgttgccccgtcctggcgtgcggcgatccgagcttgttcacgcgtcgcaaaatacttaatattcatgctgttgcccttatcgttggtgtatgaataaaacactattataaagtactatccccgtgcaatagtactttaaataaattctattctattacattccaaccattgccgcacggatcgcagtagtgctatatttgaatccgtccggtgttttatcttgtccagtctgttctaaaaataacatcatatgacgggccgcatcattgcgattagtgctatcgttaataaagtcctgggccaaccggtataatgattcatcgttattaatccaaaggcttacattccaatgagttttgtttttgtgacctaagaacatttttgatttagccattttttaatcctcttatatagtggggaactattccccacctgatagaaagtattatacttgttttaacttagtatgcaagtactttattacccttattcgtaaattttgccactgtcagcccataccatgaaacgaggcatattatcccatgcatcttgttttaagtttaagccgtgcaattcctcagttgttgccatccctggtactggtttactatacaccgcgaaattttcgcccatatactgataaaccatcgttaaatcatttgagatcattatatggatcattgaatcaagcatcaaagtagcggcgtattgttcacgcttaagcggcaacattgcaataagttcccgataagctgcaatgtgaatttttacagtttcagccggaagacctttcatctcatcgcggaagtttaccaggttaagcatgattttagtgatttgagtcgccatcgtattaatctctcttaaagtgtagcgggaagtgttcccgctctcgatgtaaaacattatacgccgttaaacatagtttgcaagtactttctacaaatacttttaaaatagttttctttctatataggggaactatcattcagtactgaatcaatccaccaaatcatccctataccccgtaaaacggcctcagccgcattctaacgcattaatacacctaagctatacatttgcaccattccaatcattccagggctttacgggccgtttaaacgcgttaaattattttcaattattttgtttttaggtattgacttgatcctgaaaaagcgtataattactacatagacgcgagaaagcggaaaccccagagggtgcggaattacgcccaaaattcaagatataaaaaaaggatacactcccgcaccctagcaggtaaacgcactttctcagtactgaaatatagtaccatagtccggcccaggatagcaagcaaattaattaaaacttttttgcttccagggtattgctttatttttccagtactgtataatagttccatcaagtcgagaaagactcaagcccaccgggtgcatagttacgcccaaaattcagtactgaaaaaatttttaaaaatatccgtccaggcggttgacattgcccccagtttataagataatgattccagattcagaaaaatctaactccagatactgcggggaaactatccccacgcggtaggggaactattggaaaaaacaaaataaaattttgatttagccgtctatacttccagacgtgtaaccatctagccgtttagccgtccaaacgtctagccatccagaaatctagccgtttagccgtctagatggatagccatctttacttccagacttctggagggctagacatatctacgtccaaaatccatccagggtaactacacccaaaatccgtcagtactataccatagatctatcttttgaaagggagtattcagtactgccatcatagccctcactatgttaccctaggaggatgaagaccatcatgtagtactgaatactgttagagggaatccaccagcacaagctggtggcataatgctttagattaaaatcagtactgacaccattctgttaatatcagtactgttattacgattttcatatgaggttcaaaaagatgtaccaccacaggaggaactatcttttctgtactgtctcacgacaggaggtagagtaaatgaattgttcgcagcaactcatctctctatgtagaacattatacagtactgaatcataatgtcaatagctttctttcattattcagtactgatattcttgagaactacccgactacaaacatcattatatcccacaaatcataaacgtcccaacgtaaatttcaactttcgaagatccaacttttatttcataggtactccaaaatttttaggatcgagatttaggatggagtactaaccaactttttgctggagcctcaaggggtaatggaattttaccccgaagggtaaaggggtaattgaaattaaggtgaaagtaataattcagtactaatcattgcgtgattacttttgattacatttgatgtaatttgaaaaatggaaaaggagcttggaaactacaaagtacggcagacttcctctgcctacttagtggcatatcagtactgaatccttcccgtgcattcttgagcattcttgtctatactaatcagtactgaatcatatataatcattctgtgattctacggtgctcatataaatgtttatatatgattacttatgactacctatgattacggggtttagcctggggagaatcctagtgatcgcatttgtccaggctgaattttaacaattcgcctgtacataaaggttgttcactaggagcttcccctgtctacttgtgtttaattacttcctatatataagcattaagatatagtagtactgattatactgtacattctctttaatattataagggtctatagcaatctcggtacatctgttaaatgcatatctattaaatgccagtggaattatagatctaatccatacttgttcattttcttttagtttacttatatagaagtttttatacatagtattctctattaattaatatgatagtactagtgttagtactgagcacaattgttctttgtagttcttagggtatatagaatcttttatgcactcattgaagtgccataggtataatcttgggtcgcattctttatatattcttacggggacgaatgttagttttcgtatatagaattctttatgttctttattcatattagtacctgaatataagtaggattatgttatagtactggttagtactgcaatgattctctatacatcgattaacagttatggaatagctatatctggcgtaagcattatccagcgggattttacattgagcacttagagaaagtacagtaggtagtgtattcaaatagaagtctttgtaattattcatacaggaatagtatacctatgatacctgagtacaggttagtactgttaccatcttcgtttgcgtttaaagtcatttgaatacaattattgtagcatactctgccgaaaaatgtattagtacttaaaggtggagtagtccttagaaacatttgttctgaggggcttatgtatttggagtagaattctttatgttctttattcatattagttagtgtctgtatataagtaatagtaagaatacgtactgcacatcttcatctttagtattgagtactgtacgtattgcgtcatggaacaagaatatagtacttgggtcatgaaaatttaaaggggttctgggtacggcatgtttgtagttccctttaacaaattgtgtgtagtattctctatgcatattagtacctatatattagggcgagaatgtagtacaattcatatggaatgtaatttggggtgatcgcacactgtgtatggtaaatgaattgttcggtatttttcttatccttgatatctattgggattagtggtataagcatttgggagtttagatccagatggcttaagtagaattctttatgcatattgttctcttagaatacgaaagctaggtacagggtatgatacagtactcgatggtagctgtcaaaatctagtatacatgctttagtgcacatagtaaaatacactttatcattttgtgcattgataccgcgaggtttatctaatagattagttctgaggtacattgggaaatattttgtgtagtattctttatgcatgttagtacctgaatataagtaggatagtgttatatagctggtcataactactactattttctatacttcgttctatgcagttattgaatcccagtactgccaaatcgttatccagggggactttgtatctggcgtagtgttcaaaaatgctggggagaaattgtgtgtagtattctttgtgcatattagtacttatatattagtaaaaggatgtgatacagtactcgattatagtcttcaatatatatcgaggatttagtgcactgaatgaagtagtctttttcgtagtttttttctatacccaatggttctgttggtacaaggtgttggagatacattgggagtttctctatgtagtattctttgtggttattcatattagtacctgaatgttagcattactacgtagtacagcatatatggattatcatcgtatatgagcgtgtacttagtacattgttggaacattatctttgcgtgatcttttattcctattggttctgttggtatatggtgctggagatgcatagggattttatccctgtagtattctttgtgcatgttgttctctttagtacttatatattaggagtaaaatgttatagtactggttcattgcgtcatcattttctatagcacgttttacgctattcatgtagttagatcgagcggcacgagttatgagaagaactttgtatgcagcaaagtatttttgctgcacgggtagtttcgagatatagtattctttatacatagtttgtaatatacgtaatgaggtgatgcattttcttattagtactgataatttcctgtacatgttttgtcagattgtacgcgtttttatagagtactggattatcgattacagtactgtacatgaatagttcttcttcctgtagttctttgtgttctagttctttgaggaaatctacaattgatttagtttcttctgtacgttgtgcttgccagaagtgcatattctcgtgtactttttttgaacccatattgtatatgccacccatttggaattgtgctgtattgacatcgtgggaggtgttacaattcccgaagaagtatgtattcccgaagtatagcattaaagtgcacggggtattatccaactgcatatggatgatgaaggatgcgttctttagtacctttgtgctcgtattagtactcaatacttttaaatcagtattatagatattcatataatgaacagctatattatttttcttcatgtacaattcaaggttctttgatacgttaactccatttgtactggatttttcctttttatttcgtttctttagtacattcgggtgatacgtatatgcagatgtaactgattctgcctgaatactattgaggtacttaaagtgcttaaggtattgtttgctgtgtgcattaagtttcatttggtttcctttatatagatgccagggcgaggatttccctgtagggattatcttgtgttagtacagcataaatgcagttattgagattaatatttttagtactttttgttcctagtttgtagtacttcacgaaggtgtcgtacatgaaacggtcttttatggttatacgttctctatagaattgttgcatagtattccttaaatagcgattagtttcattacttctctgtatgtgtacttttcgttttgtgcatctcttgtgacgacatataggaaggtgtgtttatcttttttgttcccgcaattgtagaaaatattgaacttattgaagttgaatctttcggcgtgttgtagtttagttaaatagaattctatattcattttcttccttacatttcaataagtttaagtactgctcggtacgtgtacttagttgttagtgcttctttaatagaaatacagaagtaatgttgtttgtctcttatactgccgcgtttgtagtaccacacatgggagttgtgactgtacttgtctctgtcggatagttgttggtagtagtagcttatatgattcattataatgtaattagccttactatattaaagtactcggtccttggtgtaccttttagaacttaaagatgaggttcaggatagagcggtacttagttgcagggaacgtatgttctattgcataacgtgtcaccatcctgaaatcgtaattataatacagattatcctttctcataggtggtgctaaagagaatgatagctgttcttgtttgggtagtttactacaatagaaatctttatgattattcatagaaatatattagtcctattaaacctgagtacataatatttttgttattacattcgattgcttctatagtactacgtatacaattattaaagcaatctctggcgtgtggtgtatctatacttaaaggtgatacactccttagaaacaattgttcttcgttgctaaggtatttggtgtagaattctttatgttcagtattcatattagtactcgattaatagtgttaagatgaaatagtactgcatagactcgttaccttcaaggaaattccttatgaggttatttctgactgagttaagcagaagtgccgaacgttttgcatttgcaagtataatttgttgatgctctatgctattctgttcaccttttgacagagcacataggtagtactgcataatttgttcttgggtcatatagatgccagtactaaaaggttaatgaatcgtttactttcgtcagggttttgaagtccctcaaagatgtcctctataaagcaattcaacataagtgcacttgttggggtagtactttttttgagggtattgattgcacagaattttgagaggaagaatgcgaaatcttctgcgttcatgtagctcatatagttcttagtactttggctaagtgcttggtagtgatctattacattgttcatgaaattctccttatattttttctattataaatgagtccagaaaggatgtcaagggttttctttttgtggtaaatatgatataacaaataaaggagggaaatatgttaccttttggaagaatggttaagtacgcaaatattgcaccaggtccagaacctgtagagttctcagatgttttacaacaacattatacaaactgtatgtatctacataacccaactaatactttatatggttatggtagtaataacatgtatcaatttggtcttgggaattcagcagcagtttcgtcatttacagtacttgcaaggaactgtgcagccttttggcttggtgttcaaggttcgttgatgattgatttggataataaaatatactacactgggtcggttggtgcattttctgattatggagatgcaacacctgttaatggttatttgacaacatggactgatgttactgttgcatttaataaaataggtgttatggctaatatgatcaagagtgtatatataggtgaaagtactagaatattattaaccgatggtagagtaattgcgtgtggaagaaataccaatggtgaatgtggctctggtaataaaaattccatccctacactcacagttatgactaatatgggtgaagttacacatatggcatgttcattacaaggaacgcactatatcaaatcaaataaagatgcatggttttgtggtaaggataactttggtgaaagtggatgtggtggtagttctgttgtatatttgaacaaattcgtgattagtaatgtagaacatattagtactacatacgatgttacttggtggtttactactggtgggtctgtatattatagcggggctaacagtactggacaagctggtaatggtacgactacatcggtaaatcagctaacaccaattaggaacacatcggtcacggttgatgtaagtaagtacagtacttttatttgtccaagtaatatgggaaatgcatcaattggtgcacctatggcacaatacgcaccatatgttagaagtagtggtgctaactcatatggtcaagaaggtaatggaactaatacattagttagaacttggaatatttttaatcttagtgcaataagtggtggttatgacaatgttcttatggcatctaaagattggagcagaaccataataattactaaagattataaattatatgcatgtggtggctggaatggaaatggtggtagattacctaatggtacttatagtattactacactaacattaatgccaacgcagttatggcaacaataggagggaatatgttaccttttggaagaatgattaggtatggaaatattgtccctggtcctaaaaaaataattaaagttggtgcttctacccaaggccaattcttattgactgattcacatgatttatattacataggtagaaatcaaggtggtgaatctggaaatggtaataccaacacggtgtcttcgtggacattagtaagtgcagatgtttctaattttttcgtgggtgatcgtacacttgttattattaaaaatgataatacgatatggacatcaggtcaaacgtactggttctcatcttctacaactacttcttacagtactgtattagttgaaagaactaattggtttaccaatgctataccagtaagtgaaattgctaatattgtatgtacaaatggtttaatatttgtacttagcactaattcagtactctatggtgcaggagataatggatatcgtggttctttgggtattggttcctcatcaatttacacattaactcaatgtgctacgaacgttcgtaaagtaatgaccaatgcgaatgatagtatgtatcttacattagataataagctatatagttctggatggaatagtagtgggcagcatggtacggggaaccaaacacaaattaacacttggggattgcgtagttctggtgtaatcgatgcagccattggtggtaatgcattaaattactataatggtacatcatatttcgtatgtggtcaaactccaaactttcttagttcaggtacgactacattccgtgcagttcctgtaagtactttgcctaatagttctccattgtttatgacgaattcacctgccttaaatactgctacacaaatggtaattactagtacatatcagaagggtgttggggcgaaccgtggtttgggattaaacaattctcaaactggtgctatatatagtgctaccaatttacaattacccgttgaagttagtgagattagggatgttctttttagtgatggtttgacatcgatattaaccaaaaatggagatgtgtatagtactggatcgtattacgccattccaggtgcaatcgaggatgttgcagtctttactaaaattgatttaccaaaataacataatgccagtacactgtactggctttcttatttgtattaaatatagtataacaaataaaggagggaatatgttaccttttgcaagaatggttaagtacgggaatatcgcacctgaactgattctacctaaaaacaggttacaatgttctgctgatgccaaattttatttacacacaaatggcaatctatattggtttggttcttcagcatatggacaaagtggtaatggttcattggactcttcaactgaatggactcttgtcaactcaaatgttacacgatattggggtggggtacaaggaacaattgctataaagaaagatggtactatttggtacactggtagacgtactgttattccaatactatcttcaaacactaacggcgtttgggttgatataacacagaactttactgatttcggtgtcagtgcagatgatattgatagtgttgtgatatcttcgtgtatgcgtgtatttttaaaaaatggaaagtggttctactgtggtgctggtactggtggtgtttttgggaatggatcaacttcaagcgtttcacgattcacctatagtacaatagaaaatgttatcagtgctggttgtgcaatatatagtactggattagtactaaatgatggttcatattggtatgcaggtagaacgtttgtatcaggaacgacgacacaaaacttgctcacatttacacaagatacttcgattagtaatgcaattaaagcagtcaatacaaatgaaacttcttatatatttcttaatgatggtaatgttaaagttgcatctattaacgactatggacaagcaggtacgggaaataggtcagtagccccaatgagtacattaattccaaatttatcattccaaggagaagtggagttggtgggtgagcttgggacaaaccttaccggaccatcctgtataattaataataataataagttattttcatgtggccttaattcaaatggtcaatgtggtattggtacaactgatatgtatataacatcattcgctgaaatggttcttactgcattagaaggtagtaatcttagtagtttttgtaagagctattcttatacgatgttagttgacgaatataataatttatacacatgtggtgtacccaatcttactggaatgtcttcaactactgtaccaacaagggttcctgattcacttctaccgtggaaataatataatgccagtacactgtactggctttcttatttgtattaaatatagtataatgaataaaggagggaaatatgttaccttttgcaagaatgatgaattatgggaatattgcccctggtaaggataggcgttttaaaatatattcaagtgattctatgtatcttcatgatacttatactaataagttgtatgcatcttctgcgacgaattggggtactggaacaggtgtagcatcgagtaaatttattctttgtgcagagaatgttaaacgagttctattggaagataacagtagtagttgtcaactgtatgaagagaaaggtactggaaaagtttttatcactggtaacacgaaggcattcactggtgtaactgatacaaaaactttgtggacggactgtactacatggataacatcaggtggtattaatgtttctgatataaaatacatgagtagttttaatgatatgaaggtgaatttgataacaaacgatggtacgttgtattgttgtggagttaacaataactcgaacctatcatcatttggtgatggtacaaacattaattcttttaacacattcaaaagggtagatactataacttcggttaaaaaggcagttggtaacatatacctaaaagaagataatactttatggggttgtggttttaactattactatcagttaggtacaggtaatcaaacttctattactggggtgacgatgattgcttcggatgttatagattttgatgtaagttatcaaagtacattttttattaaatcggataataatttgtacgcttgtggtaaacagttcggtgcacaatacggaaacgaatttggcacaggtggtacttcttcatctaccgatatacaatacaaaactccgacattattgagttcaggagtttatactctatatacttgtgttagtaacatggcatcacatatagctaaaggtgatgaagttctatacgcatctgggtcgaatggatttggtcaattaggtgttggtaataatattaatcagtactcatatactccttcgtatacttcgtttaatagttcgtgtaattttgtacgcactccatctggttcacttatacttacggacactgagcaattatattattgtgggtatgctatggtagtaatggggggaattgctggacaaaacattcttagttatacagaagttgatatgtcatttatacaatgatttaatgccagtacagagtactggctttcttatttgtattaaatatagtataatgaataaaggaggaatttatgttaccttttgcaagaatgatgaattatgggaatattgtcccagtaccacttcaaattaagaaaataatcccaactgatttagatgttgtggttctgtatacggatggtcaactatatgcacgtgggaataatagttttgggaaattcggtagaggaaacaacactgcattaaaatcatggacattaattagagaaaacgttaacgattgctggcttacacaaggaactttattagtaaaagacaatgactcaaattattattactgtggatatggtagtcatattggtttaccaacaagtactactacgtttttaagttataaccaatatattcaaaatttgtacacacaaagttcaagtacttcaattaaacagatgtatggaggtactacgtggtttacggtattaatggataataatacaatatggagtacagggtggaacagtgctagacaattcgccgatggaacgggaactacttatgaaataaccgatggttcatttgtaaaagcggtcacacctaatgttgatattgcacaaatacagtcaacaaataactgtgtattgttgtttgataaacaaaataatttatatattggtggtgttacatccggtataagttccgcgactacatggacttcatataatgaatatactttatatcaaccaaatacaacatacacaaaaacgttacaatacacaggatgctcaactggtgcagtaagtgctttagttgaaaatccaaatacaggagcacgtcagttccttgtcggtgggttagctaataatggggcatggggaaataacactacatctagctctgttaatggagttttaggaaataacagtacgacgttaccacccggtactttgtattcaattcatactggatacccaccacaatctagtatactaattacgagtactggtgtatatgcaactggtttaaatgccagtagttatgctggttcattgggtattggtactagtgcaactgttggtaagtttactgcatgtccaatgcctacacaaataacatattctatgtatgataaaataaaaatatatagaggttcatatcgtacatttctaactgatatgaaaaatatatattcaaccggaacttatgatgatggtggtcctagtacaactagatatgtactagatacaccccgacaattataatataatagccagtacaaagtactggctttcttatttgtattaaatatagtataatgaataaaggaggaagtatgttaccttttggaagaatggtaaagtacgggaataaaattgaatataagccagatggtgaacaattaatcacgacaataggaacaacacaatttacagttcctgctggcgttaccgaaatatcagtatgtgttatttcgccgggtggtcaacgtggtgctggtggcggcttatcgtggcgtaataatattccggttactagtggtgagtacttaagtgtttctcttacacatcccaacactactacagcagttgaaaacggtttatatcgtggaactgaaaaactatgtgttagcttcactggtgaatatagggttggtggactaggtgggaaagctgctaacgctattaatgatggtggtggtaatgggggcaacgctggtgtaagtggtggtgcagtcattggtggtggtgctggtggctacactggtaaaggtggtaacggagatgcaatcactggtgaaaatggtgctggcggcggcggtggtggtggtgcattctataatacctcgttcattggtacgggtggtggtactggtatcattgttcaaggtgctaatggtattggcggtagatacgatggttcatataatggtggtgctggtagtggtggtgctggtaagatgtatggtggtggtggtagtatatgggataatttttcttatacggctgctggtggtggtgctgtgcgaataatatggggacgtgggagatattatcctaacaattcagtctaaaatataggccagtacttgatactggctttcttatttgtattaaatatagtataatgaataaggaggggaattatgttaccttttggaagaatggttaagtacgggaatattgcaccagttccagtagttcctacaataaaagattttaagattggcttttcacatgaagtgttattggacagtgcaggtgatgcatggggtattggatacaatacagatgggcagttaggctttttggatgcaaataccaattcactaggtgcgtggtctaagatatatactgatgttcgattaattggagttactgctagatatacagtggtagttactaataataatagaatcctttacgcaggaaataacttaatttctagtactactactcttgggtggaccgatataactgccagtatgggtccggttgcggtggatagcatcgatgcattatattgcacagatggtatgatgcatattaaaacttcagatggttctttatatgcatatggtcgtaacatgaacgcaaacagtggtgttactggtggtgttattagtgttgcaactaaggttaatttgccttctgctgtaaatgacatgcgatatacgtttagttatggttcagtactatgtcgattggatacgacttctatatacgcatggggacgaaacacaaatggtgaattaggccagggtaatacaacagctatcgttacaccaaaactattgtctggtgcttctattgcaatgggtacttcgtataatgctactgcaattgtttctggttctgcatcgttagttacgtgtggtggtcagaacagtggtcagttgggtaatggtattactactgatggtaatgtttacgtatatgctgctagaacataccctggcgatcttaatactataagaagtccagtggattgtagtacaacgtacacctctgcatttatgagtccagatggtatatattacactggtgctaaccgaagcatgtttggtggtattagtggtgctgctaccgttggtgtatatactaaatgtagtgatttaccaataacatattctaatataattcagtggggtagtggtactattggtggtgctatatgtagtagtacagagttataccaatgtgggatcggtcgatacattgctggcgatggtgcgagcacaaccaggtatggatttaggaagacaccattaccttgggatgtttattgaaattatgccagtactttgtactggctttcttatttgtattaaatatagtataatgaataaaggagggaatatgttaccttttggaagaatggttaagtacgggaatattgcacctatatatgaatctagtgtaattaaaatgcaagcaccatcggcttttaccaacaacacattgatgattctgtataagaacggtgatttgtggggtattggcggtaacaatgctggtatattcggtcttggaaatacaacgacacagaccaaatgggttcgcttaatgcaaaatgtgaaaaatttttggtgcacaaggaatgcttcatatagcttagttcagaccaatgataataaattttattatgcaggttggaacctttggactggtacatctagtgcagttcaaagtactacatttgttgattgtacgtcttatttttcaggttttaatgtggataatatcaaggagatatatccaaatgttcgtaatatgtttttactaacaaatgatagtgttctttacgcaataggtgataattcaacctatgagttgggtagtagttcatctacacttacatcatttacacaggttaatattaatgttaaaaaggttagttcatttttcaatagtccaacttggataattaaaaatgataattcagcatggagatgtggtaaaactagtactggtacattgttaactggttctgctactgatactttgacgagttggacaaagtatagttttcctacaggccagtaccccgttgatataatttcatataacaatatgttgggtatagttcttaatgtagataatacttatccgctatatggtgtagggtcacaaaattcacggacaattaggaaatggtgttctatctaatactaataagatatctttaactccacaaagtacttatttacaattaactaatgtttccgattttgaatttatacaaacatattcacaaaatcctaggggattattatatagaaatggaagtcgtatttttggaacagggtataataattatggacagcttggtaacaattcatctaataatgcttcaattttcgtccaagcacaatttccaaattctgtagtttatgatccgtcaacatcgttggttgctgcgaatgacaatgcattatttgcatatgtgaatgggaaattatactacactggtatgtctccagtagggacagttgttggtacatggactttaactgaataccaattgccacaaatttaaggagaaaattatgttaccttttggaagaatgttaaagtacggaaatattaaaccaactcttcctgaaataaagaaattggatggtagtcaattacatgtcggattactttatagtacagggaatatgtacatgcgtggttctggttcgaactataaattaggtacaggggatgctagtgatgtattaggtggttgggtacatgtaccctatgaagttgatgatttttgggcgtgtgtatccggtacattaataaagactgttgataataagttatattgtgccggactatacatgggtggatattttggggctagtggttcatatgttaactggactgaagtaacttcattatttgtaggtattgacgtgtcgcaaataaagaatatagaatttacgtcagcaggtacgtcaggtagtacactaatattgatgttagatggtcgtttatatgggttcggtatgaacagtagatctgagttaggtgttaataacaaagttgtatctcccattcttatagatactggggtaagtgaaataggagcacataagttaggcggttcatcgttccattatataaaaggcggtaagtactacagatgtggaacatcggttggtagtaatattggaagttcttctttaactacttttacggtattgagtattcctgataacgttatatctatgcaaattttatatgacaacgtacagttattatgtttaggaagttctggatatagtatctatatggctggttctaatgattatggtggaagaggtgttggtggttctactgtttacactacattcaggaaaatagatcttacaggatttggtgttgttcccagtgaaatactatttgaaaatgccggaaatggttatgttaatatatcaactgatagtactggagtatatacatgtggtggtggagcgggtgttaacggtttaggtagaccaactaatgtaataccaagttcacagttgggggtagttcagttcagtactggagtagaacaatcaaatataagtcgtgtgtattcacagagttcgagttctgttatatattgtatagtcaataatgaattgtactgggctgggagtaattcatattttactgatcaaaccacaaatactggtacacaattttcatttattaagatgaagaatatgccttctgcttagattttatgccagtacttaacactggcttttctttttgattaaatatagtataatgaataaaggaggattttatgttaccttttccaaggatgataaaatacgcaaataaaatgaaagttcctgaagtgaaagaaatctttatttacaatggttatagtgcgtcagttattccagcaacagcactcttactattatataaaaatggagacttaatgggtataggtggaactagttcacaaaactatggattcggaaatggtgtacctaatgcgaaagtaaaagagtgggctttaatataccaaaatgtaaaacgttttagaacagcccaaggttcttttaatttaatccaaaccgaagataataaattttattacagtggcgtaggtagagctattggtacaggattaagtactgtcagtacttatactgattgtacttcatattttacatcagtattcaatgcaacacaattgtcgcaaattaaggacattcaaattgtaggggagggtatttttgttttacttcaaaatggtacgctatatggaatgggggccaatacacagggatattttggtaataacacaaccacaagattatcaacatttacttcaattaatacgaatgtggatagtgtaaaaacaggttcaagtgcagtgattgtgcagaaaattgataaaacactttgggtcactggtcaaaacacatggggttcacttggtataagtaatggtgaaactaacattagagtatggacacaaatgggtgcattagccaacaatactgttatacattatgaacttggtgggagtgcatcatgggttgtatctaaacacaacacgaataatacatatacagttcgtgcaagtgggattcaatcggaaggtaacttgggtaatagttcagccgcttcatcagggacagtattatctacaatctccactctaccaatatcagataatatggaaatgaaatcaaattcattaacatatggtgggcttacggttaaaactaacaattcactttatatgtgtggtataaacacatatggtaggctcggtcgcggtaataccacatcaagtactacatttgtagttccagttgatgcacctaaagttggcagcatcgagttattctgtccaagtgaatgtacaaatgtgtatatggataatcaaggggatgtttatttgagtggctatatcccacaagcgacaggtacaacagtttctgattattacactaaatttcaattatataaaatacccagtcgtggtatataaaataaagccagtattttgtactggcatttttttgtcctaaatataataacgatttacatttggaggatacaatgctaccctttggaagaattatcacatcatcaaaaaagaacatacaaccttctgttacaaaaatagcttcatctgatacaacagtttttgcccttatgtcagatggtacgttgtacagtagaggctctcaagagtttgggcaaatgggtataggtaatattataacacaaaccaaatgggttttgtgcaatacaaacgtagaagatctatgggttcgggtatgagtcaacattaattaaaaagaaagataatacgatgtggtatgctggaaatggtgcatcattcggtttatcaactgataagtcaacaacgtgggcttctgcaaagatagtgtttgatagaataacagcacttggaaaaacaataaaacaaattgcagttagtgcaggtgcattaagcgtattatgtacagacaacacgatatggaatacgggttatggtagttatggacaactgggaaatggtagaagtaccgattcactttcatcatttgtacaaggaacattacctactggagtaacaccatccaaaatactggcaaattttcttatgcaaggatttattggaaccgatgggagattgtattatactggtgcaatatcaggcgtaggtacaaccgacatgacgttatattcaaagtacacgttatgttctcaaataactaatacctatacagtaaaagattatacaacaaactcaagttactttgcttttgctatagcaaataataatagtactaataaattatttgcatatcatggtggtggtcaatactttggtcagttagcaaatggttctacatcacaaacatatatttcgttaagacaaacaacacaagcaccaggtgatataataagaagcagtgtaggttattcatatttttctaatcatattataacttcattgggtgtttacgcaactggtaataacacaggcgataacgcaggtcaattgggtataggtacacaaacagatgtgtcggcctataccaaatgtgtactaccaatagagatgaatatgaataacgtatatgttacagcaactttatacagaacttacttaaccgatggtatacaaatttacagtactggacaatatattacagacggtggagttgccagtactgtatttgtcaaagattcaccattttaggaatattgtacaaagtgtatgcggttattttagaactctttttaaattcatcgtaaagataattcaaaattttggaacattcaatatacttttcaatatctttatggattaatgagtactgaaacattaaatcagatgatatattgtaggtactaccttttaaactgtttaaaatatcacagatttcagggtttacgggtacttcgtcaaaattatcatctaaaacatttatttcaaaatcaaagccatctttgtttttgattaatttgataatagaatcaccataaacattatattgttttaatggatttactacaatgttaaaaagattggatgtattacaatcaatatccataaagtatgtattatcattatacttaatattgaaacatccgtactcaataaaatcaccaggagttattgatgagtttcttctcgtttcaacataagaagctttaattttgtttttatttaaaagagtaataaatttcttagactgtttagcaccagctaagtaagtattataacttggtcttttaaaaattataggactagacttctcaccagagaaatatttttttataaatttacgctgtttaacgaaataatttttataaaacaaacctaattttgttttcatcataactccttattaatccagtactatcaagtactggaattttattatgacatacgcttattatgaatggaattatgaatggattttaaataattatataattttatcaatccactaccagtagctacaaacagtagtgctgttggtatcatacatccaaacatggttattaattcatgtatttccataccatcactatttggtcccacatcaaatataacaaccaaaacaacacctaaaatgcttagacaataatatcccataaagaccataaaagtgatatatccggcacttgatttaatattacataacatattatacactggattaatacagaagaagtataataaccataccagtgttccagtactgaacataataattgaaataatggaaaatatctcacggtaactcatattatttcctcatacccaaacgttggtggatttcagagatctttatatataatagtaccacaaggtgcagtactaaacaacatataattacggctaataccaatgaacatatcataagaccgaaggttattgtattcaaagaggatgtgaacagtccaattattaatacaataaaaccaaaattgaatactgtacccaacacagtatatgctggactatatctcttttggattacatcatatatatttgataatggtcgcttatggaagtacttcccaatgcacacgaatgcattcagtgagaagataaatgtatacgccattactagtaattgaccaacgaaagataattctatcccgttcatactaacctcgtttacgttttttaattgtactgtgcatcttttcgaaatagggaaccaaaacatattgaacagtttgccagataaccattagattatgcactgcaccaccaaggataccaaacactagaacaataattgccataataggatcaccgtctaccataccccatttaaagatatgtaaaatccaagcaatgactagacaaaataaactaagccaatacgtaatgaaaaatccggcttgtagttcataatcatcagcaatttcatcgtataccgtttctaaaaatgatacacaaaagaatttaccaattataaccacagtactaataaacagcatagcagttaagataataagagcaatttccattacatccctcgtttacgcttttgattgcgtctaaattctgttagtccacggctaatcggcggcatcagactacataaaaaagtaacagttgttggtagtaacatcaagtcaatcattgcagtgttatctggtggatcaaaaaccaaaaaatacacacaagaaacactaataatggttgaaccgataaaaggaatacaaaattcttttatctgtttttcaacataatcaaacatcttgagtacaaataaaaatccaacccaacacataatgaaatagaatgaatacaacgtgtaaatcaatgttactatatccattagtacctcgcatcaggaactttagcacgtaacttatgaacgactgggaacaacaacaaacttacatatgcaatagttgaaccccaatagaatactaatacaattggttcaccattagaacggaaacctctactaatcattgagtagtgaataataggcataatcatcgccataccaaaccatgcgtgtaattttaattgcagcatgttatcagcgatgaatactgaaattggtcgtttaaagaaccacatcagaaagtagaatccagcactaataatatagtacatggtactaactttcatataccacggcagtaaatcaataaagtactccatcattcctccggtatcttatttcgaagttcaatcataacacaacaaattttaatggtcaatataaaagttaaacatatcatcccaagtgtgccgtaaactgcggaaaaagctggtagtacctttcctgtgagtgttgctacaatacatgcaatcaatgttgatgcaaacaacgattgattaatgacagaattcataaaatcttcaccattacgtttatagaattgtcgtttaaaataccatcctagaaacataactacccaaaatgatacataagttgttagaataatccctgcaagtgaatgtgcaactggactactccttaaaaactcaagataagcttcaaacattagaagtctccgcgaattttatctctaccatgaataatgagatggattaagtatgcaactaaccaaatgaacaatccaaagaatacaatatattgtgagattgagttcaagtgaggattagcacaataaattaagtgtgccataagaccaacaattgcaaacaaaccttgaacaagtgtgtaaagaactagtgatgaattcctcactggatacagtttaaaaacaattttctttttaaaataccatagtactacaactagtgcatgataaaagaaaaaaccaaaaagataaatcaaagtaatactaatcattgtatctgatttaaaaaattctaacattagaatccccatttaaagttatcacgagctttaataataaagtacatagtacacaccaataaccagacgattagtcctgaaaacacaacatattgtgtaatgtgtggtgtgttatcaatttgtaacatgtaaatcacatatgtcatcacaccaaataaaataaatccaccttgtataatgctatatacaaccaagaatacattattatatgaatacaatttaaaaacaactttccttttaaaataccaaagactaattacaattgaatgataaaacaagaatacaaacatgtatatcagtgtgataccaagcattatattagattcaaaaaactcacgcattgagtgtctccagtgattaaacttttgttatagtactacacgttgttagtactgtcaatattgaattaaattttctcaaggaacaagttttcgcactgttcttcccaatcgtatgggttgttgttatatactgccgaaatcaacagtggcatacgcagtgaaggtgaacgaagagaatcttcgtgcttcaacatccagttcagaattgctttactaccattacggttaatacccttagattctaaaatgttagtctgattcatcacgttctcaatatgaatcatgatatcacttttagtctgaatctgtaaatccacgtacacagaacgagacataagagcagcataatgagcagacattttagttttagctttagcatctaacgctaaatctttgttagtaatgaatacgatgcgaccattaaaatcaaagctattaggaattccgttagtgctcaagtacttagagctagtcatataagacacggtacgcttaccactatccagtactgctttgagcaggttcataccgtcttcagaatcaaaaatactgtccatatcgtccagtactaatacgttagtgctgtgacgattcttgtacagaacttcgtacagagcaagagtagtcatcttgccactgatagtagctacgttccattctgctgcgtcatgagctttctggaggcgtttagagagggtgtaagtcttaccaacaccaggagcaccactgacaaccatactttttacagtactgctatcatcgagcaaacactcaagagcaaccatcatggagttgaagtttttctgaatttgaatgctgcgtgcttctctggtcatttcgttatcctcatcagttgatgaaataattatagcaaaaagggctgaccgaagtcaaccctttttataaacatatttaatacacacaattacccatatcaatatttttaccattataggtaattatatattttatcttatttggttttataacaaaaacttttaatttttgatttaatttatcatttgaaaaaatagtatatgaaccactcccgtctttaaaaacttcttgactttcgaacataaatttctttccatcaattttagcagtttttgttgaaacatccaaatacagttgataaatcgtatcagattttgaagatttacaagtagttgatgattcattttttgcattcactgttgttgataaacacattaacataactaacattaactttttcattttaattaacctcttttattttataaaattacttcaccaaaaataccattaatatcacgttcaataatgtactcaccttcatgtttggctaagaattgttttattacttcaattacattttgacgatgtatgttgttgtatgtttcagtataaccatcacctcttttataatagccaatatttttatgtggttttccacacaatgcaacagtatggacttgtgtttccaactccgatgccaaaaatcccccttcttcggtgtgaaaaaaaataactaatacattagtccaaaaattatcaacaccatactcttctaaaaaagatttgttaatttttttaagtcggggtttgatactgttaccctgttgggttattccgaatttatccgattcgtttgtttgatcaacgttcatatatgaacgtgtaggtttgtttttcttaaacccgtactcattatacattgaaaaaccatattcaaaactgaaaaaatctgcaatattaattttttgttgaattgaactatcactacgtgaatataaaaacacactacgggaattagtgtattcaccgtcccagccaataaatgtaaacatcacttcatcagttgagcgattacataattcttttttaatttgatattcacgctgttcttttgtccaacgaaacccgccagtacagcgacaacttaaatgcccctgtttgagtgtgtgcatttcttgctcaaattcaccagtacataaaccattttttgtatattcatcgtttgcacaaattggacatgagtatacaagtttactaaatctcccataatcattaactgtatcactacgcttgaacgtggtctttggatgaaacttaccagtattcattatttcgttaatgtgattttccaatccgttattactttcacgatgatactgtttctttctttcattcccacatttaacacatccatcatttgtaccattcgaaccaaataaaataccatttatagttgcactgttcatgagttcatctgggtgatgttcacatacaagagttggtttatatgtattacttttaattataccagttggtattgataataatttctttccagtttttgaaatttttctttctattcgaataatatattgataacgagtccattttggtatctcactacaaccacatggaattattgaattcaaatatgacgattgtgcaataatatacacacccaaaccatgcaattgaacatcatttgcacaaattttacaaattttaagatagaacttagctttggtctttggatttcgaattaatcccaacagactttcatcacattctgtattagtatcctgctccaattgatcaaatgaatcaggaattggcaattgtggatgcttttcacgaagaatgaataacgaaattctaaatgcttcttcactttttgccaagcttaatgcattttcaacttcaattgaacgatatactttatacatttatggttcccattcattatcatatgatgaataacaaaaaatttcaaattgaatttgataatatacctttccagtactgaacccgtccagcaccattaatcttagcctgaatcttatctttttcgacaagaccttctttgaaatcgattgaagtattatcgcactgaattacatctaagtcaagtacttcttgtatacttaatgaagtattgtctgcaatttgttgtaaagtaatgatatcagtaccgaagaattcagctaatcgtataaaagatagtttcatttgttacctcttgtgttgatgaaataattatagcaaaaagggctgaccgaagtcaaccctttatgttattctaattcactcatagtagtaatagttaagcccatttcttctgcaatgttgcataacagaccaactgcattacgaagaatatcagtgttgtccaccgagaatgatgagttttcatttacagttgaagactcaatgtagtactcaaaataacgagaagttgaacgcacaactttaacaccttcatacttctgtagttcagagttgatacgctcgattagtgaatcttccagtactcgatagtcaccattcattccacgtttccatccatcagcaggacggaaataaaaagtttttgtacgttgaattgttgagattgttagtgggttgtattctgcgatttcacttaaagatgccatgttgtattcctcatttggtgatgtacataatacagaaagatataacaggtgtcaatgtttatatctaaaatatccaaatactttggtgtagcacatactacatcaactaaacctcgctgaagacaacaataaggaatgacacgaacaatgccgcataacaaggagctatcttcatgtaccacgggacttcataataccatgtacccaattcatcccacgaaaagagtatactcaaaccgaagccgattagcgatagtacaataaaagaaatccagaaacgcgttgaatatactaataacatgttatgttcctttgtgtaaccgaagtcaaccctttcctttaataattattcatttcatctttgatttgttcttcaatttcgtcgaacatatcagtactagattcgttcttactacttacgttctgcatatctttaacgtactgtggacattcaacatcagtaaacttataccacgtaggcttcatctggagcttctcaatcaaacgatcacgagacattttaatctctgactccgttggtacgtagtcattacaaaactcagcagggaagccgctaatgtcgtttacttcagtgttttgaatcttcataccacgacgcagacattcgttgacaatatcaatatgacgcttctgtaagtacaataacttgtcgtaaaagaatgtcacatgacctgaacctaacagataagtactattaattttgaaatcacgtacacgcttacgtgcttgaacgtgtttttgtacagcaccaaatacacgtgggagttcacgatattcagccatcagatgttggtcagcaagttctttaacgtgtactaagttaatgcgtgtcatgtattcatcctctcgtcttgatgaaataattatagcaaaaagggctgaccgaagtcaacccttttctttattcaatgatccccaacttcacaatctcatacccgtccagatagccgtaggaacactcaggtgtttcataagatgaaccatcatggatgccctggcattgacttttggaattctcaagcaatcgttgcagtactgatacgtcatcaagaacgtaatacaagttagcatataggtcagttacaatacagtactccaacatatcaaatgtatcaatcgaaatttcaaccttagcaaatcgtttcttttctttattatacagtgcgtacatattaatctccataatcaagtttaactaacttaccacccagatacccaaagttttctggcttcgcatctgaatagaagaagtcagtactcaactctgatttagatgctaatgcacacaactccacccaaaataaacccctatgttgcactggcttacaacgtttctgtacagttactagtccagtacatgatgaccacaacgtaggacagatactactatcactacgattggagtactgcatccacgaacgttcattgaggttagctatcatccctgttaagaatagcttccaacttttaaaggttggaatcttgatagcatattccccaatgaggataacagttcgtgttgcacctttcaaatctatattcatatttttaattagaagaacacaaaccaagtccagaacaaattccacattacaaataaagacatagtggttttatgtacaatatcagcagtactggtccatcctccaccgtgtcctattccatttatgaatagaactaagaacaagataccatttactacaatagtacatactaagtacacaaatacattccatgcaagtccaggggatactaaagtaaatggtaaaactattagtagtattagaactaataatattttcatttatcgcctcacttaattaacgtgacatatcacgtaatattagtacgaatcagattcccagtactcgattgcttctttcagcaattctttagcacgttgttttgcaatgcgagcgggaaactgatatgtgtacattaactgacgcttcacttcattcagtgaaagctgttcatggtacagtgcatccatcagtcgattacgagtacgtagtttcatataagttatccttatttcaaagaatcatagtaagcagtgtcaaagattggagtcataataacatagtcaatacggtcaatgtaagttgaactccacatttctggtttgtcatataactgacgctcgcgttcattcatacgagtcagtacttcttccaatttactacgtgaatccatcaatgtattactcgaaccataagtgaagtactcagtccaatgatattcatattcagtactgatagattgaatagtaccatctttgaaatgagctaaggcataacctttctctacaaagttatcaggtggaagaacaccatctggattagttttcaatgcttgtgctaacttttctttaatttcagttaacgtgcatactgaacgaatgttcttcaggtttgatacttgaaaatcactgtactttccaaagaaaaagacacgccaatctttaggttcattatcagatacggtagcatcagggtgatgggcgagtaaacgaagaaggccagctttgtgaccgttaatgtagatttcatggatgtggttagcagttttcttaaaagtaatcatggtagttcctcgattgtagggatgagaagttcatccccttgataagcattatacagtactgaatgtgtttgtcaactcaaaataaattcatttcatgtgcgtattggggttcaagataagataagtttttgaaactgtctttcaattccgcatcatctacgtacacagtaccaggtacattccccatagtgaagccaacccaaacagtcatgtttccagttcctaagcggggcattgatagcgtcccgtcaggtgaaacatcaaacgctacactaaagtcatccgttacaacttccgaaccattttccagaataatacaaccacgttctttaagcttctgaatgtggatagcagcctctacagcacgtttaaagttatagtaagactctttatcctcaaacatagattgtttgaccagacgcttgtttagctcggttactttgtacatttgtcgcattatttcaacacccatagttgtagaatttcataagagcctggtggtgctggattgataatctcagggtattcagtactgttaggattaccaccagcattgaactcagcaagtaataattcgagttcattcctatcatgtacaacaaacacgcaatatccagttccttcttcaagaactgtagttgaccccgcacaatcccatacggtatcaatacataataattctttagtgtttttattacgcaacgcaaacatatatgtctcctatcgattcggcatattctttcgtagtcgcaagagaaattcaaccactgaccatgttgtaatgaaggcaatataagttgcaaggaatccagtaagaataaatgcaaccagcgtactaccatttggtgaagcagttttaatgccgatgacaccatcgactacagtgaaacatgtagccattaatgtgtaacatacgtacaacacaaagaaaaactcattctccattgaaggatagaaacggttaaacactttataaaatttaaagtacagtaggattataccaacaaaggcatagaatgtaaacagtgttgttataatatatgagattaggttcaaattatacatatcaacgctccggtagattatcacgtaatgttttaattcgatgatacattttcataccaatattaccaaagataccatatccaagtactaaaatgtatgcgataagcatagtaataattactatagtaccaaaactataatgtacactactgatacccattgtagtttcaacgattatttgagaaactgaaagaatcaaaagtacaactacaattggatgatttgggtacattcggttgaacaacgttttgtacttaaagaagcacagtactccaccaaataagaagtaaacaatgtaaatgcaagcaacagcataggcaaacatgttagtgtaataaatcattaccaatccttacttttcagggatattagaacgccatatatcaatgcgatgaactagtacaaagaacaaccatactggaacggcagctatcataacaacaaatgaaaacccagtcaagaccgataccagatttaattcatcagtactatacccacatatcagtacttctaatattccccacgtacatgcacaaaacatcaagaatgaaattggggcatcataatagatacgttcatataaagtagtgtatcggaagaatgcaataatgtagcaaaacatataatacacccaaaccaaagatactacataaaatgatactttgtttataaattcaaaatattgttccatttttaccccaatatatattcagagagtaatgtattagcttcatctttgttcttaaggtaatacatgtaatatagattcggttcaccatctttagcactcaaatcgaagtactttaaactatgtactttcatagtaaaaacaaataatgacttaaaaccaatctcaccgtacttaataaacagttcatccaaatgaatgtaactttttgatttggataattctttaacgtctgcatcaatttcagataaaagatgcttacctattaagttttcaaatgaacgcatgattttatcctttaccgcaatttttatggtttattaagaatacaccagaacatcagttctgtcaataaaaaactggatcttcttcagtaactggtatttctctacgtacatcacacgaaagaggatcagtaatgaatacattgccatctttatccatcatgacattactggaatgaatgtctggtacaaaacgcccgtgaaactctttcatgatgttagcagcgaccgtcgcaatagcaatctcttcagaattaccacgcatatcattcactgaagtagcgtactgaccagcatgtgcataagaatataaatctccaattttagtactaacaaagtcatcataattatttttttgtttaattataggatagtacttgtccatctcataccatccaaagtttccttgttcgtttgcactgtagatcactggaagaaacttggttcctgcgttttcaatgcagtactttgcataagcacgaaaaccatcccagcgtgaagtggttactttaaatgcacgtccaggatagtttttatgttcaactactacagagtacatccccattccaagcaaagtaagtccagcagctttaacttgtggaaagattacgcgttcagcataaggaatatcaaactccatcgcacaacgagtttttgatggacgcaaaatgtcaattaaagttttgaatatttcttgcttagtcattactttatcctctgtagttaatatcaacatcataacaaaaaaggctgaccgaagtcaacccttttattatcatttacagttttctataactattgcacgttttagtattttactttcataaacatacttaagatgaccttcttcacgaatacgattgaacacatatcctagtttatcttttagtactgaagcggtatcaatgtcaagattaacttcaacccctcctgttaatttaactttatatgtaaagctaaaagcatcaccagattcaaccaatgggactacttgttcatacgtattcaacataactcgttcatcattaactaaattatatattacaatatcacaagtttttaccccaatttcctctaatgtaggagcattatctactataacatcttttactgtatttgcaacctgtttagcatctgctgcatatacattaaaactaaaaagtactaaaataatacttaaaaaaatctttttcattatatatccttattttattttacacgtcatatcgggttgtgctggtttattatttttaaacggattaggttttttatctttctttttatcttttaaaggttttttgtcttttttatttttatcaggttcagagggagtattacattgtgctgggggttgattagttggagtacagctattgtctgatgggagtattacttctttacaattgtaaaatagtaaacttttatttgtggttaaattatgaaaacgatagttacgttcattattataataaattgttttagtactttcaatgtcattgcacattgctactgaatcaccggaactctttttctattcccattacatcagtcttacgctcagatagtatacctgaagtatatgaatctttgttgtcaaacgcattaaatccaatagttctgtcggtgtcgtgtattattccttttgtgtatgaggtagtatagaactccccatttctgaaatcctgccttgctacggagcaatgataatctgcaccataagcagtactggaaaataatacaattccaaatataatatattttttcattgtaatccctcttcttaattcctcttttgtatttacaaaaaaaggctgaccgaagtcaaccttttgttttatcatttaccgtatttgctcatgatgtccttttcccaaggagttacatttccattttcgtaatcacggaaagagtcatcaagtgtagtcaatgcataatcatatgcctcaccggattcaacatcaatatcaacagcaccattcactacatcagtccacgctttttgtagtttacgagcgttgttaccaactttatctttaatccaactaagatttcggtttatactcttcttatcagcaccagctttttcaccaacatctgcaacccattgcattaatttctgtagttcgttatgggatttttcagtcatttggcggtcttgtgacagttcagcttccatgtcatcaatttcttcgtctgaatgaacatcgttctgttctactgcaccttcttcatcatcacgcatcagataaccatctcgtgtaaccttctcaccatgttcagcttcatactttttcatagtattgaatgcagcatccattgcagttacaaaacgactcttttcaccttgtacataagatttaagtgcatcgttaactgcatcagatactaatttaatcttatcgtctttaccttccagacggttttctaacttagctagtacattcttaacttgttgagcattagcacggtcttctttaccaatactatcaaatgttttaagtacgctttcaagacttgcttcctcttgtgcaggcacatcaccttgttgcgtaccttcaagtgcacgcattatagtactgaatacttcagttggttcagtgctcttattacctttcattacatcaagtacagcttgtgctttacctttgagttcttctttaggaactgcctgtagtgctttgacaataccctgaatcaactgtggtttgttagcaaagatcttacctaagttatctgataactctttaacagggttagcagctttaggtacttctgcttttggttcttctttaggaactgcttgttctttctcagcacgttccatatcagcaaggcgttgtttttgtgttgcgttaagaagacctaatgagttaacataacgtagcttttctagctcagtcatgttctcagtactcttaacttcacctgcttctgcgtttgctttaccagctagaccagttccttggttacgtgacccacgtgaaccttgacctgcttgataactatttggacggcggttgcgttcactccatttatcagagtgaccagccatgttaccaccatttttatcagtaaaattacttggcatttgatttctctccatagatttcatttttttctctatgtctatatttatagtataaagaaaaggctgaccgaagtcaaccttattttgttacttagattgttcttgtgcaggtggatttactttttgatccactacatagaatacaccaccaaccagtactgcggcgatgagtgcagcaactacaaattttaaaccttgcatatatgatacctcagttatattgagaagttatgatacaacaaagggctgaccttagtcaaccctttttattacttcttgaacttatgtttttcactttcgattgcattcacgatttcatcatgaattttacgaagattgtgagttttctttagagattcatgtaatgcacggaatgcagagtgtacagttgctttaaagtgctctttaggagttactttaagtttctcgataatatcacgtacatagattgggtgatcctcaaacacacgattaagctcatgacctagtgattctaggctaaatgctttttcacgggatggacgatcatgtgcaagactttggtctggttttagaagacctagtgaatctagatacttgtgcttatgtgcattgtctagaccagaaatatcaacatcatgtgatggatctttcttattccatttatcaaccatttttataactcctataagagataaattttactataatatttatagttccgttgtcatttatatcgaatgacataaaacattatatcataataagaatggttgtcccaaagttaaattagtactgttcaagttcagatgtaaaaatgaatgcatccatgtcttccaacgtaagttttaagtctggtacatacttaagaataacgcactctggcttcttaatagcagcttgataagcagcaatggcaagggattccaattgctgtgctgtataatttttacgttctgcattaaaaactttgtttttgatatcaccacctgggagtttttcaaactcacgcataactgcggtaagaacatcgtcagcagtgttactatatacccattggggtaattgcattacattataaatcacaccactatcatccatcaaagagatccatttgtacccatcactagcactgaacaaacgcccttttagtactgtgttattagttaaatttacaaatgcaaaaatatcttgttcgttaagttcaatactattaacatttacccaactcattacgattccccattcataaatcacgaacaatattcattaaacacaatttaggttttatagcattcaacacccatatgcattctttgtaagtagctattatatcatctaaatgctcagttacaatgctttcttgaaaatattcttcatcattgagctttgctaatttagtaacatcacacgtaggcactataggtctggattgtacacccattccattattgatattagtgaaatgtacaaaatggtacttcacaacacctttatctagatttattatacatgacaaattttccaactcagttagttttttattacaagtaacattaatgaaaccagcattataggctctataatcatctactgatatctcaaaatcattacgttcaaatataagtgaaatgagttggtccagtggtttgacattcatatattttaatgaatttacgtatgatacttcaatcttagatgaaattatctttttactaagtgcagttaaatctttgttagatttaactgttaaaacaataggtttaaacctagaacttttgttcttttttgatactttaaaacgacctttacgattcataatttcctcaattaataatttcacatttaacgtgtggtttatatagcataattaacccatttttaagtacaatgattgttgctctgttagtaatcgaaacttttttaattatactttttttatatgtttcaacatatttctcttcataatttatacatttaacatattctttttgtttagcacttacaacagtactgaataatatcagtacaagtactatatatttcattactataccttataaacaaaaaggaattcatttaagaattcctattttacaatcatttatctaacataccattgtgcaaacgttcatatacttcagttcgacgcaaattaacaatatcttctgcgtattttaatgtaaatgcccatgcttttggatgtacgttaagcttcatacgaattcgatttttcatcaactctccacttaaacgaataaattcgtgtacaccacgactaccgtattcagtaattaaatcattaatgtacatatcacgaagagtttcatctgcacattctttaaccatttctacgtcagcgacgatgctttcattaactgaagtactgatcatttttaatttaccttatttaaattcgactgtaattttatcaccttcaactacgaacttacagttgtagcgacgtgccatatccatgtacatatgctcagagtaccaaggaacatcaataatcggatgctctgcatattgtagaacttcacggtcgcccactgtagtaatgatgaaaggaatgttcatctctcgtaaaaacagttcagcaccaggagaacgattaataaattcagtatcattacgtaaagtaaatccattatattgtaatttaagcttcatatgttatcctctattcaataccattctttaaaaccattaagttcggctacgtgagtgattataacacatataacattcaggtcaagtataatttgatcataatttaattttatacgatcatcattatatgctctaaaaactacatcgtaatcaaagaaatttgcgttttcatcattcattgaaacgattcggtatctacgtcttccatctgtattgaatatagttaaacactgttgaaactttctcattaactgtttagataggatattataatattcaatatctttttgtgaattacgtgggtcatcaggaagatagaatgaaacaaatttctttaattctatttgagttttatccatatattacctcatgtgtttctcttttactttgtcggaactcatcctttgcttccttaactgacatgatacgaactaatttagcactaccgcaatagtactgaacctgattacgaccaatgtctacatggtggtctggaacttcatatacagatatagcaaacccagcacgatgcaatttacccaagtccatagtgaagaatctgaacaaatctttcaaactttgacagccaaatacccatccacttttgattgaatagatcccatcctcagttggttcaggttggaattgagaaggtgtagtcataagcaaacggtcaaatccatttttagtactgtatctggttgaataccgtgcaaacggacctacagttcgtgcaggatctaagttaggttcaatgtaactaaatttaagttcaaaacgatatacatacataattaaaatcctctaatttattaagagaattataacaaaaaaggctgaccgaagtcaacctttgttttgaagttcttgaactaattgtcgtacttcgttaatatttttacactgctttacagtgaagtaatcatacttacgaccataggttcttgggtcatcaccttccatatactgctgcacatcaaagatttgtaagtagggatgctgcataacacgaatattatcactttgataaatcaacataatatcaatccttatatttacacaagccaccaaaactagtttctttagcaccacgacgcatcataactaatttagcatattgtgtgccattactatcttcatatacatctacttcaataaacgctaagaagttagggtctgtgtcgttagaaaactcagtgaagctaatgtcgcctactgtatgctctttaacaaacgtatatgattgtccatcaatatatacaatatctctatcgtcactatcaccttgatagatatgtttaatattaccatcggtacaaactaaaccttccaatggttcagcatatgacaatccacacattaacatacatacaaaaaataaaataattttcatgattattttcctccaacgttaagtgatttcttgtactgatattctttataagtactataccatatatcaccaacgtaaatcaagtaccacgtagcaggataaagagccaatccagtactgatgtatacgaacttttggtcaaggacatcaaatacatacagaaggaaagttactcccataatgcaagaacaaattaaccacaagttataagcaatcgaatcgcaagcaaaaatagaatcaagcttagaaattaggacatatttgtttgttaaaatgaaatgaattactgcaactaaacaatatcctgccataaaaatagaaattaaaaaagacagaataattggaatattcaacaacaaaagtaaaatagtgtttaccattttttaagtcctatatttcacagtgtaagttcaatttatctatatctaggtcacggcgtaccgatgagtccaagtaaattactatatagatatcaccattaccagttcttgggtctacaattaatattacgtttgctaatgtaccagaatcatctctataagtcgagatttttttattaccgataatactttctactttaaaacgataaatcacaccatcaacaactatatttttaccatttctagggtcgttagtcaatacatgccacgttcccttagtactacgacaatatgtttctgctgctgcaccataactaaaacatgaaaataatgcacacacaagtgctattaattttatataactcttcataacaaacctctaacgagaaatacttctgtactatatatatgtacagaagtatttaatactatagagatattttcactgttacatcttattcgtgaacttgaatttgataatatcaatccaaattttaacatttcctgcaaatagtgctttgattagccacataattgcaacaaagttctcaactaaatccaaagttttaactactgcaccgagtgggaagataaaactcaaaacccatacaattactgaaaccacaacgactgcatagaaaatacgcacaatcggtgaatcaagcataaacaactcagagaactcttttttatcattatcatcagtaatgaagcattcgtaaaccagaagccaaatcagaattaaagacggaattgaaattagtactgatagcatatttttttacctcaagtttaagtgttaagtttcagactacaggaaccattatacagtactacgaacgtttgtcaacatttgtttcttcaataagcataagataacttaacacgaagagtaataccgaaataatatcaataactgtaaagctcactggaatgataatagaaaccagtactaatgccacgtttagcaagaatacagtagtgagatctaccatcgttcgtctagtggctaatgccactagtgtaggatagaacataaacaatagtgcaacaacaaaacttagtactagatacatttctttttcaccttaataaaattataacacaaaaccacatcaacatctggctcatcatacaagtactcaaaacgttctttacttcgtttagtaccgatatactcaccattcttatgccaacgccatccaccatcctttggttgttcagacttcagtactgggtgatagcacaggacaatttcttctggaccttcaattaggttcttgtacttattcataatctgttcaagcgtatctgctacaccataagatggatgcataagataagactcaggacgtggacgtccacttggtagaatatcatcagtactattaaagatagcacggaagtcttcagatgtgtatagacttccatcttcatggatcattgggtattcatccacgacatcgtaatcagtgaagtgttcaattgcatgtgcaggtcgataacctgcaaggatacccgcatgtttagtctggacaatagtcataacagatgtattgttgtttacatttggatcatgaatttcagcccaaaacggatgatttggatcaaaagttgcatttaccaatgtacactcaccaatgtagtcaaacatagtttccttgaagtttaaagaaactccacgtaatgcccagtcaggtgaagtgatgaaattaagattaactaacataagtatcctcagatgcaattttttttgatgtggttattgtatcaaagatgtatcgatttgtacaacatttattgtaactatttcgtacatatagtcaggtgcattgaactcagcataccactcaatgatctcacaagcagcatcaacttggttgttcgcattaacacgtcttgcataggtactagacattttatatctaccatttacatacacgttatatacaccatgacaccaccacatcttagtcatttatactaggccatactttatattgtaagttctggtattgaaatttaccaatttcatttttcttacggaatgattcatctacttgaatttccgcatcgtactgaccatcagcctgtacaacgtacttaaattcttctacgtgtgaaaaacgttgaccttcaccttctggtttatagacttgtactaaaccttcaactagatataaattcatttatcattcctcatcactttcagttagcataatgctatgtacagtttccacatagcggtgtgttttaggtgtgttatactttgtaatttcatcaaacaatttaaacagtgcatctacttcactaagagcacgaatgaatacatccatcttggtgactactctggaaaacccgcgtatgttattaaattcagagacgtgttcatacacaacatagtatctattcatatattaaaaagttccatgaattcattgaataaagaagttctaatgcacataacaaattcaaaatcaacatctatggtgtcaagtagtttgaacaactttggtactaatggatcattcacctcaaagttatgaatcaaactttgttgaaacacattttcttcagtactataatcaataacaaaatattcagcaataccaggtggtgtgtaaacatcatataaaatatggcggtgatgatttgttttagaactaggggaatatataagttctatttcataagatttatcagcactgcgtgcgtaacaaacaatatcagtactcgttatttctgaaccatcacttctctctgaaaaacaaacatcagcatagcgttttccagagagattcaaaaggtcatgagttgttttaccataacagaaatcagtttcaatgcgtatcacatcttgatattcaattggtcttgtatcgcggcgttcacgattaaacactaatttcaacaactcattaatatccattatttcgcctcgataaccttaaggttaacaaaatcaccttttactttcatgcatttgaattcagtgcgagtttcatccccactatcgcgaggccaatgagtggcagagtagcactggtctggtgttttatatacaccttcaccaatagtacgagtgatttcaccattggtgagaactactgcgagatataaagtaaacatgatattcgccttagaataatttattaataataatagcacccaacgcaagaactgcaataattacagatacccacattactgcattcactgtaccagtaagttctttatcaaactccctgcacttcttgcggtaatcttcccactctttgttattcacactgccactcctaataggtcggtagctttcttgagtactacgtcaatggtttccagtactgcacctttgtgttcaattgatacaatattattataagtatcaaggtccaagtactccatatattcagttttgaatacacgaacatcagtactagtgattttaatatcacaacctttatcccaaataacctgcatcatttcattggtagtcattattcaaccttatcataaacaagtttgtgtgtgcttaatactttgttgtgatgtccagggcattcatatacatacaatcgctcctgacgtttttcccaaccaccacagatacgacctgattgtgtacatatttcatactcgttaataaaagacttacctgtgaatgtacaatcctgacgaactaaatcttttgcactaaacctgccgtcatcattacatgctgtaagaaacattgtactgcacacaatgattccagtcaagagttttttaatcatttaacatcaccccaacggaatccattcatataattcaaattcacctcaacgagttcatttgtttttgtacaccaaattgatagagtttttgtaacatcaccaggtgaactttcatacttcacacaatacccttcaatgcgaagagttttgttagtccaatgttgccactcaatccaaatttcattaggataataaaccatatcttccttgaacctatggtattgatccatcggtaagtgaccttcaacttcaattacttcagcacttcgaacaagtttgtcaagcttgtactttatctcagcaagatattcttcatcattcagacgagttaataaatctgctgcacgtgttgtatcaaggctcattgttattctccatgaattacggaagtgttgattcgtgttttaccgctagtgtatccagtacttgtatttgcattaggacagtacacagtgtataaagtcgcaccagcaccatcttgttgcatacgataaatcttacaccctgcttcttttaattcagcaggtagaacaaaatcacttgtacgttctttggtagaagcatcacatgcagtgagtagaaatgcgacgagtactgctacaatgtatttcattaacgaacctccacttcttgagaaagagcatgagtcagtgcatttgaattcgaaccattcatttcacgctgacatacaaacataatggcatcttgtactgaacctgcgatttcatactcacgaccttctggatcagttaccagatgttcaacgatacaaccacctctcagtacagaagcaccagtacttacactaattttgtaacctaagaaatcaaactgcatacatgcgtcagtaggtttcatccaatgaccgctgttttgattcaaatcgatgattacaaaaccttgagtgttagtttgaaacatagttaattcctcatttaatttaaaagggcgggaacgcagtgacgagtacgattatgctgtctttcctttcactgcattcccttttatataaaacataatactgctattattcagtactgtcaatcgatataagtaccttttttaacatcacagacttcttccatccaatgtggattttcgtttttatcagtgaagatttgttctgcttcttcttttgtttcagctaggacaatacgatccccttcatccaaatcacggatacgatacactttcagttcttgtttcttctcaaggatattacacagttcacgtgctttttcttcatcgcacttcccttcattagcataaaaccaaattgcttttttaataaggtcacgttcttctttagaaaaagacataatatttcctatcatttgttaaagtggatttcgtttgatataaacattatacagtactgatatcttatgtcaagtattaatcactaaaaatcatcagatacccaaaccaacccacacagacgactaagctaacaataccaaagacaatctctaaagtcatgttgtatccttaatcaacgattttatattcacgatgaccatagaatccagcctcaaggatgcgattaccatcagcatcttccaaatcccacccacgggatgtttcggcaataatagtcatgatgtgacctcttgggaaaattccactcatggtggatacatcttcaagtaattgaactttcttaccaacattggaattcggtttaaacattttatggcccttattcattgatcacatcaagtactttatccagctttttaccaatgctttcctttggtttctcaccattctggaatacattagaactgcaatactcaggacgcgtattaggaaacttctcgttcatccaggagtgaccgtaaacacccagcatgatgccaacgataagaatgataatttgcatgataatttcctctgattaaatgttagtagtatagtacttgatttcgttttgaattgcaagttctatttgtttattgaaaagaattccaaactctttgattgattcacaatcgaattcaatagaaaaagtatactctggtacacgtacattgtcaatacccaaatactcttttatgtaaattttaatgagttcacatagtgcagtactaagacattgaatttcaaaatgttttgcacctttgtcaaaatacttgaatgcatcaatatcacctacaataaaactattctttaatgtagtgaataggttctcaggaaacacggtaataggtgacattgatttaagaatgtatgtatctttggcattcttaatgtactcaatgaagcagtagttaacgtcaggctcgattgaacgatccgcgttatgataccagtgtttaaactcactgtattcagcaaacttatgctggcgtaatgcgttacaatcttcacacagtgcagtcatgttctctttatcattaccgccctgaagacagtccagtacattatggtctaacgtcatgcgtacaaggcgtttccctttaagtacataaggtctgaatttataacgatctttagtactgtgcttgtgtaaagtgaatactacattagattcaccgcaacaatcacatttaaagccatcacgtgacattacatgaatgagttttcgagtatttggaccaaactctgatttggtaatgttacctacaatttctgatggttggtaatattttgaattccgtcgaatcagttcatctatagtgctcattttacattaatccttctatgctacaaccaataagtacttttttcacttcaataactcgtaccaaatagaatccatttgaaaagttaaaactatacatttgtactaaggcatctgcttcagatttcgcacggatacatgatagataaatttcacgtatatcaccatccaacgatacttgtttctctgcattgatgacaatagaacgaatctcaaaacgaacgccataactcattgagtttgtcctacaataagctttgtgttagtattactattgtaacaccacatttgttctttactaactgtaatccaaatatctttgtttacttgttcgtatgtactatcacgtactgctatgcattgattcatggaattcattggggttatttgtacaccggaattaacagagaaagcgactactaaaaagattactgaattcatttgatattccttaatggttaatcatccatctcttcgagatgtctgttcgcttctaatactacgtattctacgcgaatgattaataactgtcaaggacttttaatattgacgggatttgaggaagggatttttcttcccccccacaaggagggaaatttgacgctgatggtatcagagctattgcattgaagattactcataacgagtgcgaaagcgggtcatcctgtttctctctacttcagtttcatatgacggtctacacttttaaacatagtgtatcttcattaagtatctatgcaatcaaatacttaatgtgagtactcaaattttggacgcaactttcctgtacaaaattcgataactctcccttagataattcgtaaggtgttatccttatatgtctatcaaggaaccaccagctatcctaacgtggttctttatacagccgcattgccgtgaggggttcaaactatgcccacatctaacgggtttcttttgctgttcgcactgtcggactgctcaactgccctctacgttttcgagtggatcaggtacatgaatatcatgccaacagaattgtacaagataattatatcacaaacttttacttcatcccataaaaaaaaaggttggcataagccaacccttgttctttagaaatcttcgtattcgtacccttttgcaagtactaacttcttaagcttttgcatagcttcactgtactttcggtgtattgatgaacgggatttaacatattttccattatcatcaacaaaaccattatcagcaatctcacgaagcgtttcaggttcatattcacctagaccatgaacacgctggataatctcacgttctttagtactcaattcgttagtcagttcattgatagcataacgtaaaggtgcacggatactatcaacattgaggttaaaatcagaagcaggtgaatgaataatgtcacctaatgtaccatctgtaacaccgtctaatggtgcatccagtgaagtgtattcgctttgaaataataaacaattattaacatgctgaatctcaatcccagtaccctctgagattatttcaggtgttgggcgaacaccatgtttacgcatatattcctggcagaatctttttactttgatcttatgaacactcatataacgtgggaagtgtaccatatagttagcgtcagaactttcgttatagactgtcatgtaaatactagaagaagcataggtaatgaacttaacattcttattaagatcaaaggtttttagtgctctcatgaacccctcaacaccatatgaaatcttatcttcaaatgggatataacaagtacatttacttgctacatcaataatcagtccataattgtaacgaactaacagttcagtgtttttctttacattgataccagcttgaatatcacgaattagatcttcattggaaacatttggtggtcgcttaagtgtaatattatatttgaaactgctttgtactttaccttcattatcatctttatcttcaacgaaatctaaggcttctagtgtgttgacttcttcattagcaaaacattcatccagaacttcttcggcaattgtatttaaatcaagctttttcacttacatctcctaatgacgaaatcaaaatcgatatacattaatattatcatctgtgaagcaatcatggttgtgcacatccatgaaagtactaaacactttatcatataaagttgtatgttcttcatgaatagcagcatctagcatgtattctccaccacttcccataaagaaagtgtagtcttcatgtagatattcaagttttttaataaactttcctttagttaaaatcatatgaataacataatctttagaaagaagcacacaatggcaacttaactttctgtcaggtataactggtactttattaattaaccaatccagtactttatcaatttcacttactaccccactagcactgaataaacggtcatgtacatataaagttttttgattaacaactccatattgatattttggtcttagtgggaaaaaaccaaataagtttcgtggtatagttgacgtaactctagaatcggtaatcaataaatttaatcgtttatcaatataaacagttgtcatattaaaccttatctaagaatttatcgtatatataaaattctttatcggtgaatacattaattctagtatcgaatctttgcattgtgttcatatacaatgaactttttaaataaaaatacaaagcaacaaattctgatatatgcatattctttttattgttacataaattcttaagcattttgatgctatcaaattctttttcatcaaatctgtattggtaaaaattgtatctattggaacggcactcatagatacgaagtgccattatatcaatacatgctttagatttacagtacttattcaatacgtcataatcacccgtacataatgctacaaagattctatgtgcgagtgtagctttgccttcaatcgtataatagccaaaaaatttaatgattaagtactgaatgaatgtaatcatttgatttagaatttctccgaaattactagagtgtcatcataatcttctgcaatctcatgaagaacttttaagttactttcaccagaaacgctttgtacttcgttcaaaagatagtttagatcaactttagttactttttctgaatcaaatacacagaaagtcaattcagcgtttggacagatcttcttcagattatcagcaacaacttgtttgaagttgaaagatggggaagcaaccaggttaactgcaacgagaatagatttcataatgttttcctttttagctgataattaaattaggagcacattgtactccatattatttgttatgtcaaatacttttagataccaagtgcagtagataactctttacgtttgttatatgaatcagattcaatcttacttttcttgttgaaaagggattcgatatccttatagattgcttcgatagatttagttactacccattctgattcttgaagcataccttggagtcgtgcgtactcaactttgatagtactgcgaagttcttcacaaacttcttcattcttaattagtgcagcactaagttctttgaccttatcgatgttcataagttccttactctaatttgtttttaacaaaataattatatataacatactaaattatgtcaagtatttttagtaccttcttctgccatttttgtgatataccaattaagtactgatttgtgtaccataaaaaatgtgaatgcaaatatagcaatagctgctgatgtaacactattagataatgacccaagttggatgttagtacctaaaataacaataaatggatacaacacaatcaatctactgtaaggttcgtctccagtatcacggagaaatccaagcctttcatgatcagtatccatagtgacaattggacagaacataagtgcagacataagagcaataccaatttgtgctacattggaaattgtaaaccacaaaggatttaaaccatatgaaatattattttctgtacagtagtaaccaaacgaattgaatgcacaaactaaaaatacaaaaatacaaatcttattatagcctctcatttgtttagctccgttaattttcgtttaacttctagatcatgaaactcatcggcatatgagttttgaacagttctgatgtattccaacataacaaacatagttccacatacccatagatatgtatagtaatcaaatacaaatgcatataacatacacggtactaaaatgaaagtgtaaacaaaactatatcgtgtagttccaaatactttcagatataacaaacgtcgataatcacgggcaaatgtattgatgcacactgaaaatataattaatgtataccatgaaataccctgaattaaacctgaaacatttaaaagtttatgttcatcggaaaaccccagtgcatttagcactggagccataacccaaccaataatactaataagaaaaagatattttgcattacttagtgtgaacatattactttagtccccatgcttttttgattgcatcaacagagttttggtccactacttcctttttttctgatgtagtttgaagtttattaattacatattcctttgcatctttttctatcataaatttaccatcaaccaacacaccaaaaactttagaatttcgggctggatatggattaatttcatcaagagtacggactttcttatcaactataatggctttgatgtaacctgtttcaagtactgttgtaatcacagtcatttcaattgcaactggtgaatcttcccaatacgcaatccatttagtaaagctacgatcaggtgaatcttttgtgcattttaatttaattgcactattaaaaatgtattgtttaaaattgtcatcgacaacttcactaatactcaaataaccttcacgctcttctgtgttacgtttgaaatttgtagctaatacatccattttccatcccccttgggttacttggtgtgttaattataatactaagaatctttgttgtcaaacttttccctcaaatatttttctattaatctaatttgtgttggtggtaagataaaataatcgtacatagatttactaccatgtatcgaacaacctacactaatactataatcatatggatataagtatattgggtcttgtatatcaggtatgaaaactattcttgatatattaccatttcctattcttacttggacgttatcattattattaatataatttcttatacagtactcaattataccatttactttagaatcataaccataatttttatattcaggaaaaatgaaatagcgttcatggtatagatatgagcatagtaatgctgggaaaaaattccaaaaaccttcatgctttgcaattgtttgtgcatatttaaaatgattagcattactaaaaatattatacagcacaaaatacacaaatggactaaccaacaacactattgttaacatcagaagcctctgtatttttcatacacttcaacgcattccatgattttgtcatcgtccatcatatcatagccttgtagaaattcttctttatcaaccttccctgccatcatatctgtgtcagaaattctggagtcatagaaggaatacatatctttatagtactggtttttgtgctgctcaatctttactttagcatatccagcacaaaatgaaggagatttaacaacttcccatttatgcttcttgatgggtttatcattagcatgtttttccctgtatgtctgacgataacgttcacgcatttcaggcatgtattcttcagcagtacgtttagggggagttttaccagtcccaatagttttaatagtttgacgttgttcttctgcgtgtactggggaaatgaaacatgatgtaccaaacagtactgctacgataaccataaaattcttaaacataatcaaacctcttttacaataatatcgattgatactggaattgcaatttcactattacatgaatatacatcagcacagtactcaatatctagtactttataatatttctcaaaaccacaaatggtaagattcaacgttgacccaactgctgggagtacaggaaatgataagaacgcaattttagaatgaaattcttcattgatatcttgatatacagttgcagtaatcacaatggtaactcctgtagtggtttcataataccgagtactgggtgattttcaatcattggtcgccctggtacaccagtgaggataactgggatagaactaatatcttttacatagttgaatccctcaaacgtgaactcttgttttttctcattatacaatacccatagtattacgtcagcttttttctggatattttttaactgtcgagtactaacacatggtccaaagtcagtccatgatttatacttgataccttttacttcaatacgaaggttgtttaccttaatatcacattcaccgtcacgtgcttcattttggaatgctggatcgatattaagtttaataccagtattgttttcaatttcattaaaaagtactaaagatgcgtgctcacacaccataccaacaaaatgactatgtgcatgattaaaaccatatggcgatttacttgctggagccaaaagtttatatcgttctgatttttcaatcgcttttgccataaaagaatcagcttcatctttatataacttaacagtcatttttccatttttcagtactaatctattatcaataacattcataaaaacacctcattattcattcactacatgataacaccaaatcatacaccagtcaagctcattttttggatatgcataataaatacgttataataattataccaatggagggataaatgtcaaggtcaattgctgcggctggacgctataagtttggtgaatgtggttatgttgttgatggtgcaatcctcaacgatggaactagactaaaaaatattagaatctatcgccaaagaagccatagattatatgatttagttgatccaagaactaatataatatatcgtaaagtacaaataacaactaaagataataaaggttatctattaaattacaataaaactaatgaccaactattaagtgaaattaataaaaattgtttctttgttcgtggatattctgaagagccacaagaaactgatactggatttgtatataaatttatgctacataaaacaattttaggtagttcacaaaccttgtatcatatgtatacacctgaatgtggtattatagatcgtgatatagataatattctcatttcaccagtatttgttggtaatgactcaattagtggtaaattattcaacactggttcagaaattgatactaacggtatggtaataacaatcgtattaccagacgggacagaatactttactacccaatttgttaatgatgcatttacaattccagttgatgttatcacacaatcagggaaaggtactgctacgctcacttctccatattataacactaaagtggtggaatttgatgttcttgaaagtggtgaggatattgattttgttacatcagttcttctatcccaatttgaacctgtttcggaaggtgtattttctgcggttgttccatttgatgttcatgatcgtggacagtacttagcacttcaagcatacagtggtgacttatatcaagttggtgtagatctttctgtagacgcagaaggtaatattactgtgtatcaaactgataatttacctgtttctttgagtataatcggaaaaacactgcatactactcctttccataaagaatatactttaagtgagtgggttctcggtgaagactctatgtactctatctcagttccagtaactgaacatggtaaagcactaccacaagttcaattatattcttcagacaatcatgtagttcatagtgaaatacaagtggatgaagatgataatgtaattcttaaagtagtagaaccgcttgactgctcagtcgtaatagttggttacaacgcataataaaaaaagccactacattgtagtggctttaattttatctaattatttgaaattgtcacgtagaacttcttcaagtgttttatctggattgctaatggctacattataaatcaattctttaaatgcagttagtgcctgctcagttgcttctggaccaaagttctcactaatgcttttaaacatactttgtgcacgttctgatttgatacaactagttacaaacttgtcaatttcattacgaagctgcttagttgtcatgtcaccaatgagcatctcactaatttcttttggttcatctgcacttgttcggacattcgtaaaaccaaacacatcatcacctgagccaaagctacgtttttcttttttagtttcttttactggttcttcttcaacttcttgttcgtattctttagtaaagagatgagatagtacatcatcaagatttttaaccataccgtcaatacgagattcagcattcttggatacatgtttgaatgcttgctctagtgctttttcttgaatctggtcacgaacattattaactacattacgaagtttttcattacagttgtctaaaatttctaatacttcaccagttttgattttttccaaaagtacatctaaatcagattttacatgttgtttttgacttacttcaccattaagaattgaattcaattctttagcaccttcaactgcttcttcatgtgttttaaattcaactggtacgtcaacaccatccagtacaatattaagcactttaccatcaacgtaggcgtaggagtaagatgcttttttgaaagaaatagttttgaagaaaatgttgctcatattgatatactccttaatgcccactagctgggaaggttttaaacatatagtgacattgtactaaatcatcgaacttcaagccgaagtctttagtacccatcagtgtgtggtaaaaataatgcgaaattgtattagtttcagcgtctttaatatagataccaaattcggtacagcaaaactgaacaacttcattataactttctaacttggaaattacaagtacttgatcataagaatttttatcaaatccaatgatgtacatttcctctgtttctgggtgtacaatcatcccaccgcgagaaataattttctcgaagttactgctcaagtactgaattgttgaacttaagttcatttacaactccttacgtattactcgtccggtaagatgttcatctgtacagaacttcattataaatgcttttagatggaagtcttctaaaattctatatgcttgctttttcataacgacttccttcttctccacatcaacaattatatcatgtttctcgtgaagttcctggatcatttgatatgaattcaaacttagtacgctcataaccaccaatgtcctccatctcccacaaaatttgaactgccacttctaattcgtggtgaatttgaaaataaccattacttgcagtatagatgtagccatttttagtaattgcataaccccactttttactttgagaatgcatctcacgtttcaacccataaggtgatggtggcttcttgactggttctggttctcggttttcgttgtaaatctcttgttcgattcgcaacgctttatgatatgagtatacatgaatcaggcgacaaagtacaatagtaatgcaacaaataattgtaaatgttatcaagctcatcaatttgccctctgcctagatacatattcattaattgcatcttccaaatcataccctgacatttttacattatcaattgaaacatgatattttttcagcactttttgtccagcagtgttctcccatatagacccatcaggctcaatatgaactttatggttcaggatgaaatcgaacatttcttcttttgataagtttgctttacgggtttcaatgtgattagtattaagtaattcacgagtatgtttaatgccatattcagtgtgcacaccaacactacgatgcaaaacttttaactgctcggaagcagtctcttcatcataaacatgaatagtttcagtactatataaaatatcctgaatattaccagtacttacttctgtccaagtgtctttgaaatgaattttgattgttttcatggaagctcgtattagttatatgctgtgaataggtcaatgtttttatcatctacactgattaatttaccagttgaactaacaaacacaatattaccaccaggggtgatttgaacacgctggtttactgaatattgatcactaaggttataattagcccattcaactacataacgctgttcaacaccgttagtatcatatagataaacgtgtgtaacgtcacgcatttttaaacggtctaacagtgtagagttgtccatgaaatccgatggtgtattgctgcgtaatgcaataccgaactcaccgataacagtactaattgtcagaccgtttgaaaaacggctacaaagagtcttctcatcagcaatatgcatccataaaacattctttacatcaatatcaacaaattcacagttttcaaaaaccaaacctactttggaaactttaccattaaattgcattagtaactcctatttttttatattttaaaattaaatcactcactgctttcattagcttatatggaatagctaactcttgaacagtactttccataaaatgttcttcttctgtatcataaaatgttgaactatagtgttcacaatcatctatactatcataaaaagaagacgtaagtttatcaacaatgacagtgatttgtttgtcagttttggcacatcctacctgaacggttaatccaatatcatcagcctctacacgaattataaacgaattattagtatagttcagccaacaatcttcaccaaagtatacaacactgtgtttcttctgaaatgaagttgcggtgttaagaacaccaataacaacatcaactgttttttcatttaaaatattagacatttttattcctgcttcgtatgtttcgtgaaatctcaaatattccattcaactgctcaacagttaaaccctgtaaatcgtaaactgttgatagttgaaagaacatctctgaatctatagtatcatgttcaattggaagactcaagaggtctttattaataaaataatcatatgttcgaattgtcaaagaatcaccaaagatatcaatgtaaaatttcggaacattatgtaacgaaacatctattaatatgttttcagcatatctacaagaaattttagaattatttttataagattggtatgaaaaattataaggctcatcgaccaatgtgtatgatgaggtatcaccttcggaaaatattacaccacattcaataagatgtgttaacgacttaggtggaatttttaacatttcacttcccatccttactcatattactacggatcaccccactaagaaaacatattttccttaatgtatcataactgatatttgtaagattatgtacaaaattcaactgcaagtacatttcttcagttaattgattaaatgtatcatcaacatgaatgttagtatgttccgttatatctatttctatattattttcccaaatatcaatgctaacagcatagtctgatgtatgtctggattgaactgaaataaaaatattattactgttgtataatgtctcggtgtatccattcaaaaatgatccaacgacaacatcaaaaatgccatctctaattgggttttttgtttcaaacgtatcactacaaacttgacggtatacaatgtcaacatacttatcaattaaagtaaacaaataactcattgcattcacctatataagaaaaaaggccgattcatcgaatcagccttaagtataacacagtagaagttaaaaagtcaacttctaaattacagcatccaagaggaataaaaagatactgttagagggtaacgaatataatgaatttgagggtaatatcattatacgtaaaaaagtgatagcttctatacataaggaggaatcagtactgactagaagctatcgggttaaacgatttcagtactgagtgtttagtttaggatgagtatttccatcttcgatttgttttagaatcgagtcacgaatttctactgccccttgataactatatttatcttttgggatcacccatgtatattcgccatcagtggttttaaaatcaatacatggattatccctgtattcagatgcaatgattgcaataacatgtaatgaattcaatgaatgatttgtataaggataattgttattatctctgaacgtgaatgttttaagttcatcaggtgcaacaatgaattccattattcatcctcgtacttcttgaatggtggaacatctaccttgaagtctttgcacatcttagttgtacgaacttcagtattgttgtgataatttttcttaaattcataagaaacataattacgaataccaggtgtatgaataatagcaagaaccaatgtacgaccaaacaagcataataaattccagaacatatgaatctcctaattgtgggttttaaccaaacgtgagacagctagtatagcattaacctcatccaatgtcaacccaccaatgtcattaatcattgagtactgaaatagtgattcttcagtgtaatggtaatcatgagaagcaataaagattgctggtttagaggcatccaaaattatctttgtcattgtactatatatatcaaattgatacaatagattttcacctgtatatgctacgtagatattatttgaataggatggatgtaccattgtaaaaccatcataacataatatttttatgttcggatcgtcaaaattgcctgtataaaggttattacaaacatcttgcattatacgtactattagactagtcatttaatggatttagtacctcttctggaatcaacttttgaactttaagtatagctttaatgtcctcaaatgttaatcctaatgtgtcgttaaggaggcagtactggaagaatttttcttcagtatcaatatcgttaacattcaattcaattgattcatcatcataatcataatcttcattatcacattcataacttctgaatataactttttcaaaatacacatcaaatgaataaaaatgattattgaattcataaccaagaaaaatattaaaacatttactcaaatctgtggtttgattcaaatctggatcatagcaaaatactctaacttcaccaatatcttctaattgtacatcatgcagtgaccatgcgttgttttttaatacatagttcaccattttaacaatgttgtatgtcatagtgtacctttattttgtgccgactaccggaatcgaactggtgacatttcccttacaagaggaacgctctacctactgagctaagtcggctaattgagaagtaagataaccaacaattctctatactctcatgatatggaggggaggtcatcttactgtattatttattattttgaattttgcttatttcgacgcatcaacttgattaagccaagagtcggcataggtgcagcactacaaagttcttcaagctgcttggtagtttctttacttactttcatttttactcttacttttatctaatgctgcgttgataaatgttgataactgttctttcgtcattgtcggttgtagtttcttactaagattctgtttacgcttcattatacacccaaatgatgttatgtcaattaaaaaagtagtactggatactgttgcaacaatatcctacagtgaccattttagctaaaggtgaactgagcatactcgaagtacctctcactgtattgtaccataataagtccttcagctattcagaactgaatacttacatcctacgtctaggttttaaatgtgcactagttgtaatgtgtaggcacatacgggtctgcttttaagctactgattcgggaattacaacctcccctagtgattcagtactgaatacgaccgtctacatttattttaagagagaatgattactggaactaatagttttccatcttcatcaaatgaatctgaaaaatcttcaccagactcttcaacatctgtgtctcctgcttgatatgaatgagcagtttcgcatttaccaatcgcatagtcatcataaggcgaagcatgaataagaatatctgcttctggattattctgtaaaattttaattaggtctttggctttcatttataatacccgctagtagtttaagtctgcggcgttgaatacaccaagtgaagtcttaccacgtagtttaggtgaaaggacatactttgtcaatttctttttaccgtaccagcgattgaattcgtcttcagtgacatatgggttctggaaatcgtattcgcgtttcttatgcagttctttagcacgttctgcaatcttggttcgttggtcttctggaatgtcgaatgtattgttacgttcacaccattcgtgctctaatgcaccctgaagaaactgttcggtttctttgactagagtgattttagtcaagcctttttcgatgttcatataatcatcgacgtatccattccaaataacaatctctggattgccgtcaatttcttgaagcattttgatcaagtcattctttttcatttaaattcctagaaatgattttcaatagttaagtacatagtttcagtaataaaaccatcttcttcagattcatcacctgaaatggataaagattcaaccttgtactcacccgattcaatccagttcttaatttgttcacgattacctttgtgtcgaacatcatagtaatggatagcttccagtactgttcggtaatcagcaatgtcaattttagtttttgcgattaattcatcatctgcatcgctttgaatcaagaaatatgccatttatacctcgcattgttttgcgactctggagggattcgaacccccgacaaccaaattaacagtttgacgttctaccgctgaactacagagtctaattggtgggccatcggtgagtcgaacaccgtaccgaacgattatgagtcgtttgctctaaccacgcgtgagctaatggcccgtattggcagtgagtgtgggattcgaacccacgatacgctttcgcatatgctaccttagcagggtagtgatttcaaccactcatccaactcactaaattaattatatcagtactgaactatttagtcaagtacttttacaaatctggacgttcatctttaaacatattaatatcctcagtactgaattatttagtcaagaattaattcgcatttttttgaattcaccaaccaagtacttatagaactcataagtgaacaatggttcttgtacagtactcatttgaaaatattcttcttctgtctttggtacaggtgaagtatatgaaatatagggattataatcttcttctacataagtagaaacttcaacattaattgaactaagatctttatgtaacaaaatgtttaatataacagttcgttggtcaggagtttctccattttccatccactgtaaacacaatctcatcagttcatcccaaatataaaattggaagttgtaatcttcaaggttgcgttttattgcttcttcatattcactaaacatatcaagttgccatataagttaagatacaaacattatacagtactgaactatttagtcaagctttttttatcatcggtgcacgatatgcatcagtacttcttcgtcgagttcagtacttaaatatgctttgtacatacacttaacacgtataacatcccacattctagaatctaatggtagataataaggattccactttattttttggcgtttcatccattcttcatgtgtcataatcgtaccattatttcaataaagaaccacggatacacttcatgattcataagtttatcgtattctgctgggtctgatatgatttcccaatgatattttctccaactaccgatacccgaatatctaaaattaatgtcattcatccattcttcatgcgtcatggtttttaacctttaattaaaattggccgaggtagagggacttgaacccccaacctagagattagaattctcttgcactatccaattgtgctataccccgtatttggcggtgaaggtgagatttgaactcacggaggactttcaccctcgcttgttttcaagacaagtgcattaaaccgctctgccacttcaccagtactaataattatatcacatctttatgttatgtcccattatataatgaattaatgatttatgcaagtgttttagatacaccgacaccaataattccagtgatatcgatatggatattggcaagttgattactatcatatgggtttgtttctgtaataaccaatgttgtatcattgactaaaaccacagtaccttttacacgataaccatgtagtagtacttgaacctcatcttcaggttttaatgattgaataacttctaataaagttgtttccattttttgtattccttgtttagttttgattatttgactttctaaatgccagttcgcatataaaccagggttttctggtatccaaaacatatgacctgaaaagattttcatctcttaatatatcataatgtacctgacgaatgccattcccaaagcagtcatgttctttatgctgtttggacatccattcttcgtgtgtcattttatgtatccagtacaattaagtgctgcatctcttcttttgtaaagaaagcactgtcatgaacaatagaaccagtctcatcaaccacatagtacaggtttccatattgttgaacatcaattccgtcaatttcaattcgtggaaaattttgcacaacacagtctgcaccgaaaacctcaccaaaaaagtttcctgctggattgataatgactttcatattaaatcacctttattatatttttgagcaggtatggggatttgaaccccacccccagaatcggaagtactgtatgccgccatcaacactttacctgcaccgtaataactattatatttatcttactattttttatctctaatagcaagctcgtagatgaaccagtggttggaatcttcgtccaaaaccaatgattcgaacgtttttttatcgttcaaaacatcataatggccttggcgtataccaaatccaaaatgatcatgtttatattttagtgactctatccattctttgtgtgtcattttatgtatccagttcaattaagtgtttcatttattcttctgtaaagaaagcattgcaatggacaatggaaaaggttattatatttttttgtctctaaccgcaagctcatagatgaaccaacgatttccattctcatctagtacatatgattcgaacttatatttgtctcgtaaaatatcgaaatgaccatcaataaatccatttccaaactggtcataacgttttttcatcattgccatccattcttcatgtgtcatctcttaatatccataacggctatactaaaatatgtaccaaaatcatcacaattgataatgttgttatagtactcaattgggttacgcaatgatatatacaattcaagcttaaaatagtatatatctgctgcatttatattatagtgtagattaaaccactcatcaaatgtcttaggctgcattatatttatctttataaaaatccatgattttagtcaacagtactgcaatcgtataatctaaatcaggataaagtaaattgtactgaaattcttcctcaacactatagttagtggtacagtactggtaatctttataacctattgaaaaataattcggatacaatgtacaacgaaagcgataagcttcatctgtcatataatcattgtattcaacacagaagtatagtgattttgaatttaattcgataagctccacgaaaccatctggtaatgaatggttataaattactgaatcttcattaaaccattcatagtatttttccaaaaaatcactaatggatacatccagactttgtataggtggagttatgataatttgaacttctttattcatttcgaccccttactatatttcacgtatgggctatcatacagatcataacttttttgtgcacgttcttttcggcgttcatacatgattctatcatactctttagctttctgatttgcttcattatacaattttaaaattagcaaaaatgcatcaagatcgggatagtttgctggattgatagtactcagcataaatcgttcttcttcagttctagctaagtcaaattcatacttaatagttttatacccactccatttatatatatgcgttactttattagtaagtacattatattcaacgaagtcagtactaccatcaagtacacgagtaatcttaatagatgtaccaatgacaatctgcacagaactcatttctgaagttttaaagtaataaatgttattacggcgaagattaacttctcgatctccaatgcgaacatgcttaataacttccattaatggttctgggacaccacgaatcggcatgttagtattcctcaataacggttaggaatctatcccaaccagtataagtgaaatgatcaaagtattgtttttcgccacctaccatatatacttcaattaaaccgtggtctaaataattttttggttttttaacttcagttacgattgctttatgtctgaaaccattataatcagtatatgttacaatatcgtgaattttgatattatcaggtgtataagtgttggcgttattattgagaacatgaagatgatggtctacgatttctttactggaaattactccaaatatgttaccagaaaatactttattaccattacaggtcaatgcccagccatcaccaacttcaatagattcaaatacataatgtgtgcaaattttagatacatctgacgtatcccagtaatcaccatcaagattggtgaatttataaacagttttgagtttttcgccatcaaatgaaagcaatgatactccgataacaaccgttccgtctttaagaataatattaaatttattatttgtattaaagtatgcttctgactcatatgtgttgaatttaataaagttcatatgttctccttagtaagtcatagtattatatcagagtttcattgcacttaccagcatgttttcataacttctgtgatgtaaatcattttatcttttagtgtgtaagggatgcaaatttcacctgggcttaacgttgtgttcttttgaaactcatcctcttcggaatcagcaaggtaaaatgggtgcgtcacaaagttatcatcaactggacgattatgtggtttcattaatgcatcatgattgacaaaataataagcatcaatatcaggacggaaatacaaacaatcaaccttaatgcacgggtgtaaccataaggacaaagaatatgttatttggttaccaatttgtcttggaccagatgcaattgtattgatgttatttttatcttgtaccatttcataaatgaaatctatcatttcacgtagttcagattcagtcattttatttccttaaaaaaatacccagtacttgactgggtatttacaaagtaacgtttaatcagatttcttttcgtaatctgtaaaaacagtcaggattgttgcacatagtgaatcaactactgatgcacgtgtgttatcaaggtctttagctagtgcttgaatctcttgaagttttactactaagtcgattttttgattactcattacttctcctattggatgttttttagatattaatttttataccactaaggtctagaacttttttattagatactgtttctgattctaatttagtttcttttacctcagtgttaatatttacgtcatctttgagaatatcagggataataccatgttgaatatcatcgtacatagaaacaacggtttcggcacaagataacatttcacgaactttgtactgataaccctgtggtaactcattgatgatttccataatatctagtaatttagtttggacatcaataagaatttttcttgatttttctggttccattactccaactccacaacattactttttttggatttaatcactgatggtggctcattaacgcttgtttgaccacgaagtgatttttccaacgcaatgatgcgttttaaagtttttattgatggtcgcttcttcgtcaactcagcttttgcttctgaataatattttcttacatatccataggcataatattttgaaccaatgaaaatttcagcaactactggatttgagtattgtgtatcaatcccattctgttctgtctctacagtgtaaaatgaaatatttgtatcacatgctgaaattttagccaccaaaagatttgcatcgaacttatctaaaattagagaaattgttttttcggcatcagcactatatggcatagcagacattaaaagttggaatgtcttaaagtacttacttccactaatcatggtattgaaaatcaatccaatggtgattaatgcaagtgtaccaatacacacaaacaaaaaccaatattcaacactcatttataaatcctcttactttatatgattaaaatgccccatcaaaaatgatgaggcggtaagataaattacttacgatttgctttacgcagttcagatagttcttcttgaagacttttcttccatgcaatcaagtgagcaaaacggattggccttgcaccagtaccgtggaatactgctagagcttcttctgcttgatgaatctggaattgaatgtagttcacagtgcggtcgaagtcggtgatatctagtacttgtgcgttagtttctttagccattttaatacccttttatttcttttttatgaaaaaccctcatcattgaggaatggtttgcattttaatatctgccgataacaaacattatatcacaatatctgttcttgtccaatttttaattattagaaagaacaatttttgaaactggtaaatctgtattatttacacgttgttcattatatccattctgtacaagaatgtcaataactttagacttatcaattgtaaatgattctaacatatcatatcggtaataaccaatagtctgactgaactcatattttcctggctgttgacgacaacacgtatttgtttcagccataatcttattgattaggtaatatgtttcagtactatcaatatttggaatatagatcttatcatcaaaatgaattacttcatgtttattcatagagtgattcaatctccgctttaagaatggaaataatctctttctgaaggccagtaatttcactgttcaaagatgatagtcgcttcgataatgccatgaattgctttgcatcttctttagaacggtcatttcgtactttatcagaactccagttagcatatgattgctcatctttcctgttaaggatatcccagtctaaacgtactagtttacgttctttcttcagttcgcttaagcgagatttcatttcttctttagtcattaaattgttcctttcatgaagtctggaataacgattacgataggaggattatactctacataaccattttttgtcaatagacttttaatatctgaaatcacattatcatgctgttcaatatctttatcacaaaagatttccaattctttctgaaacggttttttaaccgagatgttttgagtcagtgtttggattctctgtaacatatcaattggatctggactgaactcattaccaacataaagagtaccagatgcatctttttctagcaagacttctaaaattttcatttcttatccttcaatttactaaagttttctcgtgtaaatccaggaactggaaaatatacatcacagtcaacatcaggattaataattaccatgtcattacatattatatcacgaattttactaccgtccacgattttttgcattaaatcattccattttttacgagaaacaacgaatgtactaattatacataaatcatgtccacgttttgaaatatatcctaatacttcattatcgtaaacaacacgtatggtaacttttccaattgttacccctcttactggattaatactagtatcttcaaaaattaattctaatttaagtttaccatttgaaataagtgatgaagtatatttagaaaccattttatcaatttcttgagtcaaatcatctctacctagatattcaaatacagaataagttaattcgtctgcacctaactgttggatagttggaagctgggcaaccatatctaaagatacaggttcgatatatattctttcaatatcagacgattgtataaatagacaaccatcaggtgtcgtatctctaacaatttcggcataatatgtataaagataaaaaacattagactctgatgagtcagtttctacccaaatctcagattgtttcatttcatctttatgaagaattcgttgagtaaatcctatgtaaaaaccaagatataaatcatcatcagtttcaaacggattaaacatcaaatacggatatttgtcaaggtactcattgaacttacgctgcacatctctatcacaatccatgatatactttcggaattcagaaatgattattttttctaatgacataatcaatcctcaagatgcatgtagtacataaacatcgccaaccatataaaaaagccaaaacaacgaagtaaaatatcaattgttggatctgtcccaccattaacttggtaaacgattactgggattaaagcaatagtaagagacacagcacataagatgaatgcaacaaacacctcaaacataaacttaatcgtttccattattatccttcagtgtgtagtgtagtacatctaaaaagttatacattgattcattacgcataaccttgattgttaaattacgacaacccaacatacgtttgaggcgacgcttcaccgcagttaaatcatgtgtactattcgtatacagaccattaacctgacctggaacagttggcacatgaagaatgtaatcataattcattagtaagcgttgattatatttctttaatgcttgcttgtattctgaaatattttcaaagaatgtacaataacggtcgtaacgattcattttattcaaaattgaaatacgaaaagcgttaccactattccaatcatcttcagttgggtttgggttgatatgtgccatgttagctgtactgtacccaccacttgtgaaaacttcagaatatccattctcaaaaacatacaatgttgctttgtggcctcggaattctttacggtactttgacagtacttgaatgtgattacgcttggacttgtacatctcgtaaccttcataatctgaactgaattcacaaattttatcaacaccagccatttcgtatatcctcgtttaattaatataggagtattatatatactccattttcatgtgtcaagctttataatacggaagactttttactaaagattcagacgtattattttttacccatgtactaccgttgtcattagatacgtatccagtaccattaataaatttacgcataataccagtaaaaatgttagtgtataccattattcagtatccttcggtttagaatgcaaaccatacttttcatcataacgatcataggtagtgccattagtactggctttgatgctttcggttcgattgattttttcaatcttaacaccacgataaccaatctcttctttaaattgttcccatgattcacgtagactcatttttagtcccctttttgttatttcatacactcacgtaggtcaatcttttctactgacccaccgagtactagatagtaaaaattagaatctttgttagccatattcaaaagatctgctttctgttgaagcgtaaagcgtgaagtactgttacgtactggcatagttactccttaaagtagatatcacgaatttgcttaatcatctctaactcttgaagtcctatcataccaaagttttcttgtactgtcaactgttggaagtacatttcctctaaattatcataaggaatatccactaatgataaaggaacacgttcaccacggtatagcagatcttcaactaaaagttttaaaatcatgatagaaaatgaatctttttggatatgaaatttgtaaaatgtctggttagtactgaacattgtatttgatggattgaaacccatttcaacaaatactgtatctttatcattatgtgtgacatatgtacatcttgaattcgcaagaactttagattttgggaaataaaaatcacccatcaacttctgtcgtttccaatcctcgtatacaactggatgcttaaccttcttcaattggtgcagtactgtcatagttttttccagtccaatgaatcgaaatcgatttgctcaggattatcaacagcgacaactcgtgcattatgaagagtttcaaagtagccgttccacggtgttcgtaatggaactgtcacatcgccaactttaaccaagaatgaatattctggtgatattgggtcaaaccactctttttgtttagcattttcaacgatagtttcgtgttctttagtatagcaattatcttgcttcatataaaacacccaatgctcttttaggcactgtaaagcagcaactgcttcctctttagaagaccattgaatatcaattgtattaagaacgtcataacaattttcagtgtcccctgtagtataatgtacttcaatgctgtatttcattaatcatcgccttttagtaatttacaaatttcaatcatatgataataacatgtattccaaaattgtccattagtacttccaacatcatgcacagtactttgctggaacacatattcatcgttgaacatcattttaatatcatcaatgtaaaattctggttttgaatcattattgtattcaatactcgtttcaccatctggatcaagtgaaattgatgatatgtcgtgaattcctctcggatttgttggataaattctcaacgtaagaggatagaagtctggatcggtttcataggtatattcgattatgtaataaccatcaccagtaattgattgatatttaaatgtagtttcaattgaatttgagatgttatatcccagtttctttatctcatgtagatgtgataatattttatgtaaagatcctaaaacatgaatcaaattatcaattttcatttacgatcctttgaaaagttcagtttaaaagttttaccaaattccattgtagctttacccagattgttaatattttctttcaacatttcttgcatcttcctaatactttcaatccaggcttcttcttcgatacgaagaattggtcgcaatcgttcctgaatatcgttaaaacgtgtattgagttcaaccaatgattcatatgtgaaatctttcatatcgataatagtacttctttgaaagaattcttcttcagacaaattacttaaaatgattttatcacgaccaatagataatgtcaattcatcatctttattttttttaattacaatactaataggtgtttttaatgtaatgcaaatatcatgattattaaatgtttcagtttggtttgacattctgaattgaagtttcccagataaagcatgtactggtgatggttgctttttaccagtaataacatcttcccatgaatcgagaatattattaataattttaacataaggaattggcatatatgcacctatgaaaaatccacgcaatgcgtggatttgtaattattcaagtatagtaatttcaattaaacgaatttcgataaactcgttttcagtttcccatgacgtgccaaatttcttttcaagttcagatttcacatcacttttaaattttcccatagtattaggaataatttgtttggttaatttgtcataaccacaataaaacataggtttctcccttcgagatattagctgaacaaaatcttttggatatgcaggtatgttatgcatcacttcatgaatacactcagtacttgaatcttgtactttgtacattacattaagtttacctctgaaatttgcggtcatatcaacaatagttcctttacccgatttaagtaaagttccattctttgaatgagagcaataaaatacctcatcaccaatattaggataatacaaattaaattctaattcagattttacagccagccgtttgaaactttctgtacgttttatataagtttggtatttgtttatgttcaaaagaatatctctcttagtaaatgtgatataactggcatagtccatccattcccaagcattttgtatgcttgtgtcttactagacactttaaagaaatcttcaggaacaccctgtaatttacaacattctactacacttaagtgtctatagtcaatatttcttttgccattctctaatagatattgacgactgatcactgggtcacgaaacaccaattgtcgtctggatttattaaagtactggttacaatcaccacctttaaaatagttagcatctatacagtacgaagcggttctgtcagtgtaccaaccatcttcaataatatcttgaagtttaggtgcattggataatgcaggtggtataaaaagcttatcagtactgtaccagtaatatctctgcctgaagtgaggcgtataatgctgggagtttatcagtactggcgtgattcctaaaatactattaatgtattctttgaaatcttccttcattttaacattttcaaacagaaatttcaagttaggattgagacttttgatatgatcaaaaatttcaaccattactaaaaataactgcccacgtatatcatttaaaccaccctgtttacctgcaactgaccaggcttgacatgggaaaccacccattaataaatctattttatcccactcaatatcccattctctccacttagttacatcacccaattggataatatcaggaaagttagcttgagattcagctattgcgtacttgtcaatttcggatgaataatatttttcaactgggataccagcatcttgcaatgccatatatcccacactcattccattaaaaagagaaagtactcggataggtttcatataaaatcctttttatattgttaaggtactataatatattatagcatcttatttagaaatcttccaaacttttttcatcacaccatcgtgatgtacagatgattgcagatgccagaattgaagcacttgcacgtcctccaccaagtaagtactggctaattacaccaatcatattgaacactttatcatactcggttagttgttcaaaacctttcttccaatgctgatattcttcttctgtgacattaaactcaccatcaagttcctttaaaatctttttaagcacagcactatgttcactcatcatcatctccatatcgttcgtcataaaaatcatcatcacgatctaatggttcttttggcttttcagacatatatttcctcacatggtaaaggtattatcaccatccatatcttcatcagttgcttcagctaatgtcttgattgtaagtaatccacgcttcacgtacaacatgaagaccttttcataattaccaaacataatctcaggtgacatgtaattctctgttacaatgacgattggacggccctgtgaaagcatacgaaacatagtacgatatttgtcaaatgtacgaaattcatccatgttcatcatgtggcgtttacgaactactttagtcatcttattacctttagttaattgaactctacttctggataatgattatagaacatctcacgaactgcgtcaagatgttcttgaaattgttttatatcttctaatgatggtgcatcaataacagtactaagttgaaacaacgattcttctgtgttatatagtgacatatcaaatgagttattgttgtcatcagttatgatattatcacaaatttcgtaagtgtcaatacaaacatcatcaagtgttgtattatcatatacagtgtatacgaatacaaaaataaaagaagaatgttctttaccataacgcggtgggtcatatgtcacatagcatttgtggtcaaatgtatcgagttccatagacaccaccccagcttcacgatattcattagtttcactggtaagatccggtattgatgttatcgaaagtaagtggagaaatttacttggatttagcatttcaccaccattggattttgcgactgtatattaaaaagggataatacaaaagtactcaatttttcgaaacaatctactaatacatttaactcatcataactaacaccaatttcacgaataagcgattgttgaaagaatccttcttcggttaacgttaaactactaacctcagttatgttataataactgtgggatgttgtggttgatattagttgtattgcaatcgtatctgatgttgtgttgtacagatataaatattttgtttttctttccaatggatctatacatgaaagatcgatcatgtcataggtttttccaataaaaatattacaatcatctgacaattcacaacaaatgcgtatatgttctttcgggtcatgaacacgttgtgtgtcaaattcacatgacattgcaatttcaaaatgattttttatttcgtcaacattcatctgcacccaccattaattcttataattgtatagtttaatgcttttttaataataccaatttctgtaattcctattacatttttctcaatcaatgacaattggaatagttcctcttcggaaatatcaatactgtggattcttgtacaataatcgttgaagtcatatacatatcgtattgtatagtcgtttatagaaactgatacaattgcaatcccatcatggatgtaagttagttcatttgagtatctattaaaaattaacctatctggtgaacctattggtagttgaaatgtatttctagtatcttgaacaataacaaaatcatcatctatatttctactcagaacacccaaaatatcatatatagtagtcatgttattctttaccttcagcagttctgataattttcataacttctctggatagtgcgtatatttttttatagtactcaaatgtaactgaaccaaaatcattaatagtactagccatgaagaacgattcttctgtatatagttcatttgacaaagcaaccagttcttggtgaaattttgcgtccttccaataacgaaattcaaaaacaaattgtccgtcatgaccgactctacaacattcagaacgatcactgtctacacagctaaacacaatatccctttcagagtcgtaccagatatttccaatatttgtttcaataacagcataatcaatttttttagaatttggaattaaaccttttttcaccagcactaaactggtattatcaatatctagtaaacttaccatatcaattccccattactaaagtgtttttaatctccaacaattcactatacatattcttcaattgtaatatatcttcaaaagtaataccaccaagatcatcaactaatgaacgttggaataaagattcacttgtttgtaatgtatctaaatcggtgatttttaataaagaacttggattaagtgtttcgactagtagtatgtttttgtatggtacatatgtgatcttgatgttctttttataattaatcttataaaatcgcataattgacgattcatcacttagttggataattgggtcgtcttgatcattagaccaccatacagtactagtcatatgattgacgtggtggttcaattctgatatgtccaaatctaaaaaatattttagttcattgtgtaaatctaaactcataaatttatcctcaatgcagcatcatcatgtattgtaggataaacccacaataatgtcaagatgtgaaataattataccagtaatatagttcttttaattcttcagtactgaacaatacttcttctattgtagattgttgaaagtgatattcatcatttagatacatagaaatattactatatactttcctattgtattgacataaaaaagaagttttttgattaatgtattccgtaaatgttaatttatctaactcaatatcgaatgataatttaataatatgactattatcatttacatacattagtttctttgaaaaatgatcaattgtaatatattctttatgagagaactgaaatatattattaaatttattaccatttgtgcttctaaatttttcaaggtaataagaaagtggtttaattattgaagttccaatattgttcttcatatatcctcaattttagataagaaaaatgccccgaagatcggggcagtactaaaatgattttgtaccaaaaggggaataagaacaaaatgaaaatataataacgcatcattattatgtaagggaggaaagtaacatgatatgttaaccatttctggtatatttatttatcatttaattctttaagttgggtttgtatatctttagttatatttcgaattttcttaaagcaataaacactatcgtccaattcgattttaagttcatgtgtaaatgcatacagaagttcagcaaatactaaatcttgacgcatccagtttccatctttatataaagtcattacacaatatgggcattcactattagaagtttgctttccaataaaaacactttgaattgattcatgcttaaagccaataaaactttcatttatttttttaatttcagtactgatatcgaatttagcactggtgttgattgcaaaaattttattcccactttcatcagtattgatattgagttcaatatcactacctagtttacgtactgctagagtataaagaagtaattcatacatgtcgtaacttgttacattaccatttggtgcaattacatcaacactaacaccgtgcatttttacttctgtattaaatccatctttatcagaaagaaaatcagtgatttgctttgtaaggattttaatttggtctatcatatttcatttccttatgtgataaaagcctccataatggaggcttttgtatttacttagagagattcttcgtattcagcaacaatctcaaccatttcattaatgaacttgatgtgagaatgtgtcactgtacggaagtcgtaaacaagtgactgttggaaaaatacatcttcatcaagagaaccatcaaagttcaaatcaatgttttcatcgtcattgcttggtgcaactttaatattcagaagattttcatcaactgcaagttttacaacacaacccagtgcaatggcaagaacatatgctggtttcttagctttttcattacggaatggtgcacgtagagcacaaaaagtactgctaatctcatcatttggttctttgtatttaacattgaccattagttcttcgattttgacgctctcaataacacgaccagtttctggagcgaagaaagaatgttcacggatagtttgttcgatattcatatattattccttatttagattgctaaaaatacgaagattgcggtttgctttaaactgtttcaaatcaccaaatctatcatcaacgatgaaagttgctgatttctttgactgacatattgtacaaatcaacataccttgtattgtatactcagttgagcaatttgtacagtactttttttcataaagttcagtactcataaaaccttcacatcagtacgtttttctctttgttcttttttaacctcatcagttctagtatcttctaattgtaacacaacttcttttagaatgtcaacatcaattgttgcttctacatattgatagtcgtttacaccaaaaacatactttactgcaacccatacacggttataccattttaaaaaaggatttaaacgcatacttatcagacattgaccaagtttatcatctccatattcctctgtcaagtcaaattgtgcaatgtgaacgcaatgctccattttatcgccacaagaacaacgtaaaatatactctttactatcttcactcatactggataagcctttaaaaattgtttaagaactccaaacttagatgaatcgtaatcgtattgatagttaagctctcgcttatcattcatacgatacaccatatgaaaatttggataaccaattctaacaggttttttaggattagcaagtaaaattgcccattcttttacaggaaatacgttttcagacagcattttgatatttgtttcaaaatacttcatggcttgctttccgtgcttgtaatcttcttcactaatctcttgacaatcaattctatgtgtttctgtatctaacacccattgttgatcttcggtatataaatcaattacatcatcaatagtataactatcaggtaaatcataaaatacccaatgagataaaccagaacttacaccaattcgaattttaaagaacttcattctttatcaccttttacataattataacacacgacacagtgaattacaagaagaattatttccacaatattaagagacaatacatgactctgcggtgtgaaaagtgccaataacaacattatagcaggtattgtgaatattttccaagtttttttcattttattcctttgtatatgcgtatggtaaaaataaaacctctgcattaggaatgcattgtgccaatccttcaacaatagatttgtttttattacattgccaaactttagtaattttatgtctaaatacttttttatcaacgacaatccagtacatgtccattttaacagtactgttatcagatggtgttagtaaagtatcgatgtcatatgtatcaaagattttgtcgttcatataatctcctaataaaatattctcgattctctcttatatacccagatacacagttagttgtggcttggttagtgaatgaaatctcactattggacacgccatttgcatcacacaaaggacatattcccatgtacttgggggtcgggtaggtgtccaatttgtatttttcattacacaccatgtactgctgtggcaatacatctaatattatttcatattcttcatcaaacaccttgaagcatacccaacatttacccattatagttttcctttaacaccgttcttatatattcgaatgttttaacaaaccaatcatgttcgtcggatacatctacaactttaccaccatatacatagtaatggtaaaaaggtaacttgctttttcttaatctttcggctaactctggattttgaattatcttagcacaaatagcatcttgaataatagaaatacaatcatccgtcatttcaattcgatcatgcatatatttgttagcggctgcttttgctgctgcaccagatacttttctaaggtcatcatgtttttgcccagttaaaaaccaaaagtaaaatgtttcaactgaagggaaccaaccatatggttcaagtgtgaagctatgtgaagaaaagttagatagatctctacctaacttagttctagctttactataaatgttaatgtgtcggtatccatcatcagtagggtcaataaagtcaaatgactcttctgggaactcaaacataattattcttcttctcctgaaggagttccacgtagtttgtcaaaatcaacccaaataccatgctgatttttaaatctacatttctcatagtaccagctatagtcagtttcaacaccttgtgatatagatctaacactacaatcatacatattatataaatgatccctgacaatatacgtattaatcagaataacaaacaatacaataataccacagactttaggatgatccataatcaaatctagaacggaactcgtttcagtactgtcaattttactacgaccgatggcaacagctttcagtactgctaatgataccagtaatgaaataacaagaacactcaaataaattagcataattagactcctacaccaaaacgtaaaaggatgttattaacaaacacaaaatcaaatggagactttggttcagataccgagtactgaaaagtttcagcggagaaactttccctattgtgccatgttgatgaatcgattagtaattgtttatcaccaattgacgttgaatgtaatggaacgtgtgctgatgaatttatggaatacgcatttagttttccttgttcatctaatgtgatactaagataatattttttctcaatatcaggaataagttcttttgtatacgaatagattgaatcaacccattcatcatgtacattttctgcaccaatcaggtgtccgaatgataaattacgtttaactggctttgatcctggtcgagttagaatgaattgttttgttaagtaaaaattattatgttttacttcaatattaacatttttaaaattcacaactttatcatatacatttcgaaaaactgttatatcccaagtactaatttcatccataatacttatcaccagttcttctagttcttggataaatggcaaatcatcctgatgaaatctagtcatggttttcatatacctttttcaaattcataatttctagaatgctgtattctttatcaccaatcaaatcttcagtgaatgcagtggggtcggcatcgctatacaacttaccattgatgataacacaaccattactaagatacaatgcactcatgatctgttgtccttctttcacattttgtgctagacctgtatttgttactacaaatccatttgttgctaatgatgatgttagttctgaccattcaactgatattaagtcgcgatagtccttagatacttttatattcacaatacaagcaactcgtttaataggtggagtgctaatcgtgtacatttgtggttgttggtaattagagttgtatgtttgtggtgttttaacagcagttcctgaattttgagttgatttggtaattactggttctacactggggactgttgttcttagtgatataatacgtccagtttcatccaatttaaggactaaacgatgagtttcatcctcagagtaatagggaaacaagccaccggaattcatattttgaagcattttaattaattcataagtattttttaaaaacatagtacaccccatagaaaaggggagtacaaagtactcccaacatttaattatagtttaattgattcttgaataccagtatccattgctttcttggtacgtgtatcagatactactgtacaaaggtgttcaatattttcacttggaaacgtattcgaatcaagaattttggaattccagaagcctttgcggaacttagcataatcagtacactggtcaattttcattttctgaagattgttgaactttgtacgtcctgcttcaattgtcaccatcaattcctgataaattttaggatcaagatttggaacctgttgttgaatctgtgacattacaaacttctggtcaacaccttcacgccctttaaagtatgactcaatcgtttctttcaacgcatttttgtacttatctgctacttgaaccttatcttgaatagtaagagtataattgctaagttgactttcagatgcatcatagtactttttaatgtttccttcaaactcaactgcacgatcatgtgcaccaacatacatactaatagaaccaaacaccattagtacaataactaccaaaataccaattaacgcaaggagtttaccattcataaatcgttatccctcatataaaggccaatgaaaatagacagaatcaacaaaacaatggaagcaccaataagaacatcttttctaggttccatttttactgacaagtactcaaactctttattagagagtctctcaaactgtgtgtcaatattatgtacttctttaactagtaagtcaagagttaatttttcatttaatgcatcaatacgcatctttgcatgtaactcttcattcttcattccttgtgcaaatgatgtactgtaaaatttgacaacgttaccatcattgtcaataccaaagaacataataacatcattcttcttaccaccacgccacgatgcaagggtagcatcaacaaaatccacatctttgtaatcataaactagtacttggatgtttacctgctttcgtgcacccatcgtttttagctcattacgaaggtattcatcgtaaccatcaacgttgtaatttgtagtgttaattacgtgatgtgttttgtaataatcaactacacttgggtattctggaatagtactaagatacttttcatcatacatgttgtgtagttcttcaggactaaacaatgagttcttatcagcaaatagatagttgatatatgaactctctgcggcggcatagtcaccaatcataacttgctgccaacgtggtggtgtcattgtaccttgacggttcacacgttcaatctcaaactcacctactgtacttttcacataccaatcaacttcatatgagtaatcaaaaaccttatatgattcacacacacgatgtgatttacctttactatcatatcgcgtatggcacttctcatgccatgtatagtgcttacatgaactagattgtgtgcaatattctttgtggctgtattttgaagttacttgaccattcagaatctcaacatcataaagctggctatagttgattgcgtatgaaataccaagaacaagagccgcaccaaccagacaacaagcaatatgaatcaatagttctttagtactgatatgcttatcgtacatgtatttcataacgaatacaacgataagagcaggtattaacagaataatgaaattcatgtattaatccattttaagcttgtttagacagaatgaaatctggattgcttcacgtgctgcatcaaacagtgggtgatgtaactccaacccattaatcccacacgtatttgcatatgtgataaatttatccaactgtaccgaaacgatttcatccatttcaatacgagcttcttcattcaataaacgtttcaatgtgcgtgcattttcaggtgcatcatacttccacaactcaccagcgttcattagttttaaatggtttgcttgtaaaatactacaatcgaagttacatccgttgccccatactgaatgaggaacttcttcaccataatcattgtaacgtaattctttccagaaatcaacaatactactgtatgcaaaaaatcgtcgtgattgaccattcggtccatacagttcaggtgctttgagtttcatagtactggcaacttcataatatgcattagggtattctttctgacatgtattcatccaaaaatccattgcacctgcgtctgattttaaaccagtagcaacttgatcctggtatggtaatttaatatataagaactgacgaatgtcattttcaggtttacttggaactactactgctgcgtaatttgggataataatatcataaccggaaagttcaggtgttccaagagcttcaatatcaacactaatatgacgacgtttcataagttagttccttatctgtacattaaaaagagtgcgttttcaataagattatattaaaaacgcactcatatgtcaactattacttgttagctttttcggcaatttcacgaagagtgtcttccagttcataggaaagttgtgcaatttcctgtttagcacgttcacgttccaatttgccttttttctcttcttcaataactgcttcaatactgtcaatcatcgttttatgtacattacgcaaggttttaatatccacaataccacggttgtttgcctttgctgcgtccaacatatttgctgcaaccattttagagttagtttccaaaagacggtttgtctcattatcaattagattgcctagttcattatccttacgttgacgctcggaaattaactgttcagccaattgagacttccatgctggaataacaacagattttaaatcttcaaacttagaaacagtgttcaagtttacttttttcatactcatcaaacgtggaccacttagctcgcacatcatgataagacgacgaatcttatcttcttgtttagaaagtgcttcacaaatcatcttttgctcttgaatagcaaaagagtctacatttttgtctgcttgcatttctaataataatgcatcttgtgttttagttacttcttctaaaccaactaatgtatcacgtaattcaaacaaatattctttgttttcattatatgctttatcaagccattcacattctccgtgctggcgattaataccagtttgaagagttttcataatttcgtcaatttgctctttactgtttttgtactgatcacctactttctgttgagcattaacaaagaatttcttaatacgaccaacaattgatttatcttcttgaagactgtcaatatcaactgcacgagtcaacgtaagaattgtggtgattgatttaccaaactcggtattgtcatccgttacattaactttagacataatttcatcagccaaacgcccaacagcagcaccagcagttgtaccaacagtattgatgttttgaactgttagagacatagtatttcccttaacatctttcagtactggtagtgattttgtagtttggttaaaaatatcacttgcatcaattgtatgacctttagacgcagttttagtagtgcgttttgctgatttagctgcggtggatgcttttttaggattgatttctttctcggacatttagtattcctcgtttaatttaatatgatgtgctgctctgtgataaacattatacgggcagcacgtatgatagtcaagtatttttttactctttgttaccatatgccagattacgaataatttctacagtactctcatccacagctttacctgtctgtgattgtaaacgattgataatcaaaggaatagtaatagtttgaatatctaccatacgattcatatcaacttgatattgcttacttgttgcaataatgctcgtttcagtcatggaggtggtgattcccattttcataatacgttctaatgttaattcatattcaaacgcatcatccacacaacgtagtgcgtattcacaacccaacttaccatattcaagttcatttttgatttcattaacttcgtttctaagttctgaaaacatcgtactaagaccactaaacttattagtgtcatacttaactgcttcatttagtgctttcatcacttttggcaaatctgatggttgcactttgatatcagttttaccaaacaatttctgtgtaaaggtcggcttcaatgggaacaacgtctccaacgcaacagtaaggttattcataagcattctaatataatcactatgctgttgtaatgctgagttaagatccaattgacgttctgaaatttgttgaatcttagttccaatttcttgtgcacaaactggtaagtttacaaaccagtctagtacttttactgaattcttttcaatagtactagggaattcaacccatctttcaatgtcatcaattctgctatcgtctgggttgataggttttttcttaagaacaataggtgcaggtacatctggtgatgtttgtaccaagtctaaacgtggtttggcacgaccttctttccattcacgatattcacgctctaatggcggtactggcatgttaggatcaattctaatattactaaaatgaattttatccttcattaaatcaagaactttcagacgtttattatcaaaatagatttcatctaatgacagagtttttacatcaaataacggattacccagcgagtcataggtgcgacgtacaattacattgtaaatgtattttttgtttgatgaacggtcatattgtttcaataaagagttcagtacataattatagttaaattcttgaatctcaacttctttgccattttcaatgaaaaaatatttacctttcattataaaacctcataatcaattaaaatttacgctatggtgatattgtacatacttcgactacacatgtcaacacctgaaaagaaaaaaggacgcaccttagtgcatccttttgttacttttatccttgtaccatacaaatgtcttgacaggtggatatttttcattctttggtggttcaggcatgtcgtatacagttgcatttctaaacttaagaatgtatgtgtccattaaacggattatacaatagtttaaacatttttgtgctctttctttccaaaaatgtttatatggttctggacaaccaagataatcaagtttatacatactcatagcaacttgcataaatctttgggccgagaattttcgcttatcaatcttacttgctctgtgttggtcacatgtccaacttgatacaccaggcaagtgacaaaacaaatcaaaactaaccatactatcaaagtatttgttatgaccatgtaactcaccataaaatacagcttctgacacagtatcatataatgagaaatttgaatgtatatgttcattatcaaaaatactttttaaatctttataagtttctggaacaggtggctcaggtaatacttcaccgaatacttcaacacaccatatcttccataaaccttttgtaaatttattttctaattctctatcactatcaatataaaaagttttttcatttatgaaaacttttctagccatgtatgctttaaaaattgcatctggatcaatgtcttcacgatttacatcatcccagcctttaccaattcttgaaatttcaaatctacgcatatacatacgacatgctaaatctttagtaaggctgcgacgatacttttcatcctgatgtaatttggttgtttcgtgaagagatttaagcatatttaaaattctcatcgcaacaccaaatatttcccgtttcttccaattacatattgatcaccacttcgtagtactgtatagctttcccctagtatggaactaagacgcgaagtgtctaattgtgtatcattctttaataactttttcacatatgtttctgaaacaaaaccgcttccagtactgtaatgtaatttaccatatgctgtttttaatgtcaacatgtttccttctttgattactgaaacaccagcataatcaaggaactcactaattgaactaggaatacccaaatcaattctctgctgtatttcttcaaaatcaacatcgattgggtcattaacaccatatagttgtattttccaacctgggtctggacaaatattttcaatagttttaattaaacgtaaaagtttttcagggaattcggcatttcgttccatttcaacataaacttgatatcgaccatctaaatttggtgtttctgctgcttctgtatcagctacatcaataggtgatttttcaataaaagaagataaatcatatgctgcatcaaaattgttaagtacctgaaacataataacaatattactatcttcaattttaggagtatattcatcaacactaatgataggatgaatcaaatctttgagaacttgcggacgtaagccttgttcatttaatttctttttcattacattccaccttcttgtgtctcatccgttacttctacatctaaatccacatcatcaccagttacaggttcttcaatattctcaggagaattcattggattactattgaattctgctgccattagtttatattcatcaaaactttctggattaatcaagtttcgtggaatctgcactctaaccaatagtactgggattctttcattttttggtatacgtacagagccagattgtgtcgctacacttttcatgtcagcttgacgatttggttctttaataggagttatttcataatcagctttaacatatactttagttccatgtttctctaaaatagagaatgcggtaggatcgggaaaattttcacgatagtatttaaatgtaacagtacaccaatacttacttacaattggcccctctaccaactcaccctcaataattcctttatacgcatataaatcattatcatcgaaatatttctctacagcaagaagtatatctaacataccactgttatcatacaactgctgaatagcattatctgtataatctaaatcgtccatattttatattatccttaaaaactagcacatataatactatttactacttttaaaatacaacaaaaggggtttgaatcaaaccccaatttaaaagttttatttgtaatatttacctagtactgaataaattttcagtctaagttctgtccagttttcgatatattcaaaaccactatgattcttatacatagtattatgagaacatcccatcataactgatggaataccaagacccatagcagtttcaatattattgatataatcatcaatcattagttttacatcatatcgtgtttgtaaatcctctaatgcttctttctttgattcattcatttctatgataataatctcatcaaagcagttttcaccaaattcacgcattagatttacatttcgtaaaacttcaccatagccttttttaccacattttgtgagtactacgaatttttctttatgaaaacgatcacgtagctcttgtacaatatcaactgtatttggttcgactggctttaacaacccaaacaaatatgattgttggttgaactgttcaagaatctttttaacttcaggttgaggaacacccaaccagtctgataaatcatattctaatgggtatggtgttgatggtgtgatattataagtttgttttacaaactcagaaagcatacccatatggtccaatagaacttcatcacaatcaaaaactatacaacgtggtttcattacatgttccccgaacaaattaggtcaatctcacacagtaaagcactaagattcatttcacggtctgatactgttgcttgcttaacaactgcatcacgaattttaactttaatcttcatcagtgtgatttcatcagtactgaacatttcagcattacgatacagataagaaaagaatgcatccatctcatcatcagggatattttgtacaatttgttcacgcatttggcgaatgtttcctgcctttaatgcttcaacaattgcagtacgataccctgctgaattttcaatactatcttcaagttttactagcttaccatcaacaactgaactttgcaatacgtttagtgttttacggaaatcaggataggaagcattgatatacttttgaacttgttcaacactatcatcactactcaaatcaacaccttctgctagaagaatattataaattcgagtcatgaattgttccatatcatgcttttcgattgtaataacttgaacacgagaaatgataggtttttgaattttatgtggttcgttacttgttaaaataaagcgagcgttttcatggtagtcttccattacacgtttcaaactaccttgtgctttatggttcatctgctccatttcttcaagaacaaagatacgatacctaccaaaacatgatagctttgctgcggcatcgattttatcacgaactgcatcaataccctcatccgacatgttaagcgtagtcacatcacttgggtcaaggtgtccattctgtaccaatccattaatgagtactttgatcgcagatgttttaccagttcctgctgggccaaaaaacccaatatgtggaatgtcaccagttttaatccattcttccattttctggcgtagtgcatcattttttgatacataatcttccattgattgtgggcgatatttttcagtccatagtgtggtcatttttatttccttatgtgtacgtgttatagaatccaatcggctgaattatataataaagccgtgaaaagttcttctgtcatttccaattgatttaataaaaaattaaaagaatttgccttatttttaatcccagtactttcagcttgggccgatgcaactaataaaactttaaacatatcatgtgaaacttcatatacatatttggtattttttctatcttcaaacatgaatcttccgtttttagatactaatgttacatccttgaaactaaattttccatcatcagttatcatcaaaatctgtccaaataaaaagcccagatattcatccgagctttaattatattttattaacgaccaaaggttagcattttagttcgtggatcttcatctgaaactaaactaactgcggctggataatcaaccaagtttaattcaataccatcaacttcaatagttcttgaccatcgaccatgatcaattaaaatccattgaccttctttaatatcagtaatgtcttcgcctacagaataaacttttgcccagcgagaacgaatacctctaattttaccgtcatcgtttgttaaaacgataccacctgctgttttgcgttcaccatgttccagttcagttaccagtactttacctttacatgcagtcattactttattagtcatttaatatattactcctgatctttggttctagctcgacgtggtgctttcttctcttcagaaacctcagcttcttgttcttcgggcttaacttcaaaactctcatcatcccatacttcatccgtaccatgttcagtactatgaagttgatgttcagggatataatcaggaatttgcatttctcgttctttttcttgaatcaactcttcacgagttttaataattgttccaccggaaccgattttatcaccacgtgcgtttaaattagcattacctaatgctacctgatgttgattttggtacttgagcatatccatgtcaattgttgtaccacgataagttgtatgtttagacatatcaaaatccttttattgtatgtgtgatataagcctacaataaacattatatcacatgtttttctaccatttcaaaaattcgttaacatcaagttcgtacttcaatgaatctaccatatgtagtccaatcaaaaacaaacagtatgatgcaacagagcttccacgacctagaccccaaaagatctcattttcttccatataatcaacaagccatatcatacatcttagtagctttgtcatattataatattcatataaatcaagttcatactcaacacgttttcgtgcttcatcggatgtgcatttttgtaagaaaaagtcacgcagatttatattgtcgtatactggatcatatcgccacagttcatgatttttatcatgctcaattgtataatccagcatacgttgttctaagccaaattttttacagttatcattgaatttcaacctttcaggttcatcaatttcctgcaattgtaagtactggatatctgcaccgcaattgattgcataaacaactgcgttaagattacatttcacatcaccattgggacttataaatctgtttccttgtactttcatttttcttcttctgggcctcttcgttgtcagttagatatgaatccatatcgaagatacatgggtcttcttcgtcataaacagttttttctttttgtccttggcgaagttctagttcagcataacattgatttaagacagtttgcatattaccaataatcatgtcgcttaggccagcagcacgagcagaagttaaacgcattgactgttcattaatttttaactgtagttctttttccgtcattccagacgggtcaaaaaacggattaaacatattaacctcctatgttattgttttgcaatgtaatcaaaaatgtatctgaaacataattcactgattcatgcgaaaagtatccgaattcaaccgatgtgatttcgaactctacacctaccattgtaccatgttcattgttctgaagtaaagtgttgaaaaatgcttcacctttgcctggttgacaatatgcaactggaatgataggcatgaattttttctgtataccatcttcaatgtatgggtgattcataaatcttgggaccgtatcaagcatttcatcactgatacttggtatcgcatcaacgtatagaccacgattttgtaaatcggttgggtcttttactaagttggttgtgtcttcaccaatagcctgaaaaatattttgtcgtaaaccaaataattcaccaagctgaccgttgtcgatttgagtatattgacgtggatttttggatacagatactaaagaaccttcaggtaaaacctctctatataatagatcatattgtaagttaccttgattgtcaagtgctgatattattttataattacccattaccattttaaattttccatttggaatagtagttccatttgggttaattatactatttctcaatactttcttgatatcagaaaggttagtatatggatacgtttgacttaggaagttttctttcaataacatcttcggtattttctgaagaccatatctattgtcagattgtcggaaaaatagttgattagtgaatgatgaagtacttatacatttaaaccattctctctcaaatgcaaccgaaggtaatacatgtgcactcaaataattctgtccgaatcctcttacaatcttaaggttaaatatttttcttgcttcaccaccttcagtactaaatgctttaacataaaacgataatttaatatcatcattttcactaaaatcaatacttttggcatatgcagttcctacaagatatccatctggtgtcaaatctatcccatactttctaatgtcatcaccaccatctaaaacatacgaaacttgattagagctatcagtttcaattttaggatatatactgtctccaaaatattcaccaacatgtatggttcctaaatcactatcagtaataaagtttatattattaccttcttctgcgtttatcaaaaccctgaacattttttgcataccaatgatattatcaccaagagtagagtcataatatcctaaatcaatccaatcactactatcataaacgggcttaattgttccattatcgtattcaccactaattacgtatggatacacaacattatcttttaattgatataaatgattgggtagtggtttttctgaaatagaatatatagtatctatgtcttcaggacaaacccacatttgatatgctttatatcgttgattgatagcaaacctttcactttcttcggtgtatgtacttaatatatcaacaatctcaactttaaaatatgcatcacaagcatctgagtcatataaaaatgtttgcaataattgcccatttgggttgaacaccattccagtgtcaattaaattaccatttctattttgaatattaacttttacttctttgtttataccagaaataggccatgttgattgtgctggcttgaatactgcgaaatcattcgtaatatgtttatctggaacttcagaaatatccatgtcaatcaaacgatatgctggaaaaaagacacgaggtgtaatatcagtagtcatgtcagtacccaaaatgaaaggtcgtcttcttccaaatccttgaacgaacaatgtactgttggagccatactcaacatcaccaatacaataaagctttttgtcatcaccaatctcaactccgggtgtaacccaaacttcttgactatcatatgttattgatgtatcagttaatcctagaacaccacttggtgaaatatttccaaaatacataacatttactgcttgtaaataaaaatttataatttctgtattattataggttccatcatttttacaatgaatttttataaaataaacatcttcactattagtacttgcagataagttaaattcatttttgctgattttacacttatgcttaccatttactaatttattaccagttgtaccatctgaaataggaacaaaagtattttcgtcattaccaacataaaaagtataatgtggttctggatcaaatacagcacctgaactatccaagcattgtatgttaagaatcatttctaagtattcatcttcatttaatacatagctatcatccgttgtgctttctttattgatactcaaacgcacaagaatgtcttgtccttcttgtatatatcgagcatcggcttttatatcccatcgtggggtaaaagttgtcattataattctccatagccaagctgccattatctatagattatttatataaaggacaaggaagacccataaggtcttccattaaatatatcaattgtctgatttaggagtaaagtcaatctttcttagttcttttagttcagatttataaatgtcccaaattaagtcatgattagataacagttcattgtacttatccatcaaatcaagattatcttgaatatcttgtagtactgattgataattatcttgcgtccagcgatatgaagggaagtttacaatgctttgaatattctcttccgttgcttcaatttcggtatttaacgatttaacgaattcaaccatttcagcacggtttgcaaatccttttaccttagcaatcatatcattatcgaaacattctttaattagaattttataacgaacttcagcagcacaatcatcaagtttcttttcataacgcttgatgtaatatttgaaacggaaatcaacgaagtctttaatcaaatccatcgtagtatcgtaaactttcactttgccattttcacctagaacagttaaatgttgagtcatttttttgttaatgccaaaatactcaataacatccatctctgtccatttagctgacgttccacgtggaagtttaatggtaatatcaattacatcagtactatcattgtcataatcacgaatctcaccatcatcactcattttgattagtttttcgatgaatttctcaatactgtaattaggtggtaagcctgttactttaacagtgcttgcatcaataacctcagctttaccatagaattcatacttattttcatcaagcttagtcacaacatcacttgcaccacatgaaacataatatggggtcatttcttttagtggttttttatcaatagcacgaatgcaattatcaataatatcttcaattttatgtggtagaattgtactcttataaccaactgacatactatcattaccaaacaatgataatggaataataggcaagaaatgaacaggttcatatgttgtcccgtcatagttctctttcattggtataatatcagcatcacgcaaaacaagcatctcagtactcttattctttttaacataagtgtaacgagcagatgctggtgtactgtttacttgtgtaccaaaaccaccacgttttccaataagaggatagttgttagctactggagatgctagattttgaagtgttcctgatgctgacgtgtccccatgaagatagataccatcactaatcatttttccagcacatgatactgttttaatttccccactaattttagataatgtgaagattgctttacgttgtgaactctttagaccatcaattccaggaatagcacggtctagtgtatacatcgaatattctagtgatgttgtattcacataatcagaactgttataatctagtagagttagtgtttggttatcgatattattattttctgtttttttacttttagccattccattgtctcttggtaaaaggggaacaccatgttccccattagtctatattattccatccagttcttacgatcatctgcacgtttcttgttgaaaatcaaatcaagagtttctccaagacgtccatcatcggtgatcgctactgcaacactattagtgaatgcatcacggaagtttgctttttctaaagttcctaaaccttttgcacgcgttgctttccagcctttccaatcatctgggttatattcatgcacattatgaccatagtagtattttgattctttacctttctcaagaatgataaatggtgttttgaatacatacacaaatggattttctgggtcttgaaacaattcaggccagaatttaaataagaagttacacactagagcaccaatgttcttcccatcttcatcttcatcagcacagatgtaaagcttaccatagtttagttcagaacgttctgctttaacacctggaactaagttgatactagccattatatcatgtaaagccattgaatccattaattctttggttttctcagtaccactgacgttcataattttcccacgcaatggtagaataccatgaatacttggtatacgagcactagccatgttggaaattgcagagtcaccttctgcaatcaatagaatacactgtgaacgggctgttccagtactatccaatagttttgcaactttaccttttagaagtttctttgctaggcgacgatcttcttctgcatctttcttatttgtacgggcagcacaacgttcgaagatttcatcaacccattctttgttcttcttaactaattcatcaaaccattcggtactcatagcttgttgaattggacggattacgttttcattagttagtttagatttaatctgtgagttgaatgaaggtgctttcatagttgtgacattataaatcaacaaaccttcttcaatatcagaacgattaggtttcatcctacgtttcttagattctttctctagtgcagttcctacaccgagtgagaagaatttcttgaatgtatcaagatgtgtaccaccatcaaatgcaggagcattgttaaccaacccatgcatatggaaattcgtgttcatgccagctactgcattaggaacaatataaaaagtactgttaaaattgaatgaatcatctttaacattcaactgcattaatttagatgcattgaagagtgctttttcagtgtttcctttaatagcaatacgtttcccgttcagaaagattttataagttgggttagctgctgccatttctttaagaatactataaagtaattcggttggtagttttctgtttggaaaaacttctttactcaaagtaaaacgaattgttgttccagttttatcggtttgtacctttctaatagtaggttcgtgtacatgaagctcagggaacataatagttccttcctcaaacttctgattgaacttataaaacccatcataaccatcattactactttgtgttttatacggacgaccttggcgatgaatttctaactctgccttagaactgacaatcattgcaacagaaccacctaaaccattctgaccaatcgtttcatcacgttttgaatcgtcaaagttacggcctgtttttgtttcagtcattaccatagtacacaagtttttctgatactctggaacataatcaattggaataccacgtccattgtcactaatttcaaatgatagttcttcttcattgaaatcaactttcaaaacaggttctttggttccagcttttttaaattcatctaagctgttatcaataatttcacgtgtagcagtaagaattgcaggaacccattctacgttcttaacctcataacctgattcgccaaaaatcagtacttgactttcatgcactgaacgagaaccaagatacatctcggtacgcaaacgagcatgttgataatcatttagtcgttgaacatcatgttcctgtagaacagcactttctttcttagccatttgaattccttatcatgtctctttgtcataaaacattgtatcaccaatgttttgtttgtctcaaaaaaaatatcggaacgatttgtcccgatatattattattttactaacataagttgaagttcggcacttggacttgattcatcatcactccagtacttatgaaccttatctggactcgcctttgcaagtacttcaccaccaccaacaatataaacttgatgggaaccaattaaacgggtccagaatttaattgcatcatcagtatgcagactatcactcagaactttaataccatgtgatatcatatccataaaaatattataaattatacctttagttccagttttagaagcagttgcggcaatttcaaaaacgttttgaacaccaagtactgcatcattggataaatgcccactaactatagcaagctgtttaccagacttatcgtaagcgataaatccagtaccgtttttgttcatatatacatcatagtctttatgttctgcgaacttaaccatgttgtgcttacctgtcatttcggcagttttatcgacaaactcgtctcggtcttgaccttgaaaactatcgaaacgttgtggcatttcatccaacttatctttgtcgtcttcacatgaatccattatatcacaagttctgtcgtctgtatcagctaattctgcatcttgtacaatatcgactaaactacgcatacttgcttcttttactttattaggaagtttagaactttttttaagatttccttccttttcatcagcggcattccattctttagcagcactttgtgaaattccagctttctttgcaaattctggattgtgtgcggcagctgcgaagaatttagcctgacttttactcttacttggcattataaactccctaagtctcttctcatttgcacaattgaaacatccctgtccaatgttttaagtaatttttctggttgctccttcatgaaacgaagtatatatttcataatatcagttattattttatcagatccaacaagatacatatttctcaattgtggagatgatattaccatacgaccattataaggttcaacaacaaattcagtgttgttaagcttgaaaccttcatcggttttctcaaagtttaatccaaccatatccgaccactgttgaactttactaacaacaccatttactgccttcgcatcatcggcatccatatgcaatatttcatccataaattcaacaacttcatcggttgagaaatccatacttgctaatgaacctacaaagttttgggcttgtttataattcattatatttctttcattctcagattcacttcgtatctgaataataatagaatccctattttctgatggcttagtaataatcatttcccaaccatgttctttactttgagaatgtattttagtaatttcatctcttgaatgaccatacaatctagtttccaaataacgagatctttctgcaatatcgcttagggttttcatttcattaatagaaactcctaaatcttcaactggtccttcttcatggtcagtacttattttattaatagtttcaaacgcatccatgaacttcttgtataaagtactcatcactgttctatactttttctgtgaagttttatagatactaataatgaatccacgtgcattatacttatcatcacgtgataatacttgttgaagtactttgttgaatgcttcttttggatcttctggtagattatcgtcatcaattaataattgtgcttcattttccatcgcatcaattacatttcccaattgtggtgtatattctataccagaacttaagtattcatcatggtctttaccataatttttctttacttgtaattgatttgatttactattaattttctttattactgaactctgcacaaaatgttgtgcttcatgatatgcagtactcattaattgcatagaagatgaatatacttctttaggaagtaatttaatgtttactcttataatatatgcattgtccgcaacttcagtcatagaaccacgttcttttgcagttgaatcagtagttataactaaagacaatttcgtttttttgatttcgtcaacgacttctggtgctaactttttaaaatttaattcttttatatactgttcagcgtcaaaaggtatttttaccgattggttaataatgttattaaatgattgtgaactaatatttttagcaccatatttggaacttaatacattaagtgtttttttacattcagcaataacattagcttttattttatctgcggcggggtgattacgagtatcagcatccatttgtatgtcatattgttgaataaattgctttatcttaaagtacaagatactagctacatatttgtttatctgtgacatagtggagctaggaactttaataatagattcttgtaattgattatatttcatcggttccttcctggtcatttccttttaacttaatcaaacgtttagctatatctgttatcttagcaccgatttgctttggtgcaattttaccagtttgcttacttctccattgtttcccttgaaacacataatcttgattattaggtgctctaaattgataccctactggtatttcaaccgttttaataacatcaggtgttaatgcatcttcccactcaccagtttctacatcataacgcaaacgttgtttaatagcatttggatttgatgtatacgtctttttggagatagaactggtttttctatatggaaacttatcacggatatatctccataaaaatctacctttagaatcaacagttaacatatgtcttactaatgattcgggtacatcatcatactcgtatgtacttccatttttaaaagtaatatacaagtctttaccattatgttcaattgttttaagatgtgatgactctacatctgttggagcaattgcttccattattgctttatataattcttcataactcataataaaaaaactccaagatttgttttagatatttatcatatatctaatcttggagtttttaagtctatattttaaatatcatctgggtaatctttacgaatcagtgtttctagaacttctagtgctgaatcatagtctttaccatttgcttggcatggaactttgtcatattttaaattttgacgcagttgttcgttaccattgtcaatcattgcagcgaatgtaatacacatttcatcagtaaatgtaccaacatgatatgaatgtactgaagagtttagtgcttcaataacctcccatgcttggtcttggtccatgtggaatacttcactacaaacacactcaacatactctgcatgtgtggtaggatcatctaacaaaataaagtgaaacttaggaacatccaactgatttttttcagggtgttcttttaaaaataactctagtccagctttaagtactttattatcaactttactatgttcagattgtagttttgttacataaggagtaatatcattactccctgctaagtaataaactgaatctttatatgtggctttcacaacgctgaactgttgaagtgaaaacacttgttgttcgatagtatgtttcatagaatcgtccttattattttactttgacagtacaggttacctttttaccttggaactcgactttttgaacatatgaaacgttacccaaacgattaacgaatgattccattgcattaatatttgcttgaattactgatgcattagttccacgtcctgaagttttcattacaatatgtacatgttttccttcatcaaggaatttttcagcactttttgctttaatctgcaaatcatgctcttgtgtaccaaagttgaattgaatctctttaatactcacggcattttgtcgttgttttttaagagaagccttttcagcttgcttcaactcatatttgtatttgttaagatctgtaattttgacagcaggttcatcacctgcaccaataaccaccaaatccaatccttgattttctgctaaagtaagtgctttagagattgccatgacctcacttgcaccttccgtaacaagacgtacagtttttgcggtgatttcgttattggcaataatagatttcatgtaataaaagctccaatatgattttaatgttttgttcgatagtaattataggatagaacattagttctgtcaagcactatcattgtgttttttaattgcttcacagattgcttgaacttgaacaagataagtttttgcaaattctgcttgggttcgcacacgggggttcggtgcgtctttgatcataagttctaggtcataaactaccttatcaaaaactcccttgtcttcaataatacgatcataaaatgttttgtcagtcatgtcaagaactccatgttataaaattataatttaacgtaagatactacagatgcatcagaaacagaaggaacattaagatacacgttctcatactcaataaaatcaacagtactcgtagtaagagcattcttgatacgttgtatggttttttgtacagtaatttcttcattttctagtgcattagtgccattacctttcaatgaatcattgattagtgtttggataatctcagcagcttttgctgttttcatatcttcagtagttagtgctgcttgttctgcaacactcaaagtactaagaaaaggttgataactaatatatccaacggtgattgttgcaccagttggaatcgtttttgcagttcctggtgtagcaaattcaacattgctataaactggtactgaataagttgaaagcaaacgagaaagttgtaggtaacgcaaaagtgcaattgacttatcaatagtttgctggtcagtcggtgcggttgttggggaagatgaatcataatcaccatacatataatatgggatattatctaggttcgtccctgcaacttcaattttaaatacttgtagtaaattgttcattgtatattcttctccataatacaaaacacttttgattatttattattaaaaatcaaaaatatttacgtataacatttagtcttttagaatcgtgcattttgcctcaacataacactatagcgtgggcgtgtcatggcagtgtataaaattctacacttagtatcatttgtaccaatacgttcaataaaatcagtatcaaaccaaatgttatcaaaagtacttccttgtgatttatgaacagtggttgcataaggataattgatgatatgtaatttgttcttaattacatagtaatcctgccacatatatggtttctttgtcaatggatttatttcttttttctcaatatccttaacaagtttatcaagtttttcgtccattgcaattcttgtttctggtcctacacctaaaatataactaccattaggtaaacggaattgccaacaatctattcccatgaaactttcacgttttacttcaggacattgtataatttgttgtactacatatggactattctcagttatgctttcaaaaacaattggttcacctttagtaaattcatctggtacttcaaatagttgacttctaatgtaaatattagccaaattaactcgatagttagtatatgctaagattttattttcatttacgaaatcaaatatttttttagatgaacccttgttttccataataaattcacgataaacatctaaaaataaatcttcatcatcaataggtgtaatagtgcttaaaccatatgtctgatgcataatatcaaatggatttttactagttccaatacactctcgaatagcagttgcaactgccaaaatcggattatccaatgcttgacgtaaaacctcagttaactcatattgaacaggtacatcaaacgtaggagacaatttagtctctcccattgtaccttcggactcaactgggggcaattgacaacgatcaccaatgaataaaactgctcgacggacacgccacaattggtcttgtatgtgctggaatagttcatctgaaatcatactacactcatcaacaataagaatgtcaacgttagtattactaactttactttgtggatcatgcttcagtacttgacgattcttttcatatactaattttaatcctaaaaaagagtgtatagtactaacttgtgcatcttccttagtaagaccagcattattaattagcatattacgaataacagcatttgctttatgtgtaggtgaagttactgcaatattataatttttacatagtgcttttacaatctcagcagtagtgaatgtttttccagttcctgctggtgcagataaaactgaaattgttttacctgcatagttgtaaacacgatctataaaatcatcaaagatttcttgttgcttatccgtaagcttaattttactcatcattccctcgactgatttatacatttcaagttaactgcctttcatttcctcagcagcagtacgtgcaagttggtcagcaaggttattataaacattatctgcatgagctttaacccattcaaatttacaacctgaactgatttcatccagaattttccataaagaatcattctttacattattccagttacgttttttccaaccagctatccattcattcataccacgaactacatagttggaatcagtgtaaacaactatttcagggttttcatatgtatccttaacatattgaataccagcaatagttgcttgtaactccattttgttattagtagtcattatatcaccaaatgacagtttgtcctggatttgattattaataactacaacaataccaacaccgcctgggcctggatttcctagacaagaaccatcagtatataagtctattttcattggtatgcatccacccaatcatcgtaaacatgaacaatctcgtaataatcaacaatcgtaccgtcagataatgttttagactcaaatcttgataattttacacgcttatcgtccttaaatcgaacaaaagtatcacatgtatatgtacccttgacggtactgtgaataatctcattaacgtaaggaagagcagctttataaatcttagcaccaccaataacaacacattcggggtttaactgaatcaattcaggtaaactcctttctggtaagaaaataacattactatcatcagcatatttttcaatatcatcacactcacgagaaattaagactacgttcaaacgtttttgaagtggtttttttggaagtgatttccacgtattataccccataataatcattcgtcctgatgtttcatttttaaagtgctcaaagtcagctttactgtaccaaggtatcgaattattacaaccaatcccataattttcatcagtgcatagaatcatttttgacatacaagttcctctagatctttttcattttttatacgatacatagataatatcacaattcccaatccaagtaaaggcatttcgagaaggcttacagaaataatactatgtataattgtagacataaaaatattaatataagtattttttccaataggaaacagactagttatcaacggtaaatcatttattatttctttttcttttatttttatacaatgaataagtgttttatgtaaatgtaccataaggcccaaaactacaagagagatacagtacaaaatactagcaaatccgatatatccagaacaaatgaatgtcaaaattatatcaatccacattacttgcaaaattatcatattacttctttctccatataaactatgtaaaacgtaaaattgggtaaatactttataaaaataacaataagattggagattaacaggtatatgaatatcgacttagatagtagtataattaacaaaatccttgatgttatctcccggaatgcctgttattagaacaatagtagtgacgttatgtcttgtattggggtttgttgtttatataacttccagttcatgggaaacttatataaacaataaacttaatcaccccgaacaatttgaatcgtttaaacctcataagtatacaatttcaccagaaaagttggagagtattgataaaagcctatataaatatgtttctgcaaactctgatgatattgctatggttttggtttacaagtttgttcctgataataatacattctatcaaggtagagtacttgttacagacgaaacaaatgcatctatgggattaaatattaaatcttacaatttggattggttacccataagtgcttttagtgctgagacaaatacattactaagggggaaaatattttgcgttgaaatttctaaaatttacacagaatatttaaatcctgataatgaagcacgaaatgagtatctatcacctattaactttccagcaatagttcaagatggtggtgtttatcttgtttcagtaccgattaagtacacttcaattgaaggatatgttagtgtttatttcaaacgtgtaccacaaaatgtggaagaagctgagaagtttcagagacttgcacaaaaagttgttaatgaagtaggatattatatctcattttaaataaaagaggaaacacatgtcaacacagaaaagaatttactattctattctaagagtgttaattgtatgttcttgtatcactttgagtatttttctctttcttaataggtcacaaatagaaaatagaattaccaaatcggtaatacccagtattgaacaatatttttttaaaagttcgttggaactggataaggtaaatgaatcttttgctaaaattatttcaaaacattcagatattagtacggtggttctatacaaatttgtacccgatgaagacactaaaatgtataaaggccaagttcggactagttctcagagatcgctctggagttaggagaatgcgtactgatatgtacactttagacagaagcgatagagcatatcaagaaatatttcttaataaagttcattatgaaacaatcattggttctaaaatggaatgcagtttatactatgataattccaaagattattcatgtgatgatgtaaaacatattcgttatacttataacacaataatcactattcctattttagataaggaaaagtatgaagttgctggttatgttatgattacaactaatagaacattgaatcaacatgaagtacaaaatctgattaacgatatcagaccgtacattcgtaattttgataattcaatacaagatattaaatgaaataaaaggagcaacattttgttgctccttttttattaagcgtatttagttagatctggttcaaagaaatcttttccttttaaacctttaccatctttcccacgtttaataacgaaaacattcccactctgctcaacataagcaccagtataattatctttttgttcaatgcgttttggtggacttgataatgtatctgcttctgcaagacgaaactcaatactttcaagggcttctttctctgttttacaaaatttactcatattactacggtgaacttcatcatatgcccctgctaggtcaaatccacttgcacgagcgaatgatacacatgaagatacaatacgaactagtccatcactgatagtgcgactatcaccaatttcaacaccacgtttaaattgctcgaaatagtcagttaattctttaacataattcaaagcagtatgtttatatagtagttggcttttacgattttcagggtctattgtaatttcgtattcacccaatgcatcaatgcagccataagttgcgattgcaccgtatgtaacatacagaatatcacacaatgcatctagaataccaaccttagaatccttattgatagaatcaaccaactcacctgtcccaaaaatttcttctttaataagctcaattcgaagatttgcaattttagaagtttggaaagttcgagtggtgttaactggctggttacatacttccatgaactctacaacttgtttatattgatctaatgttgttgacattaccattctccataatatgcatcaccataagtgatgttgattgtttcaactgttgcaaattccatttcaatattggataattcgcacattaatttatttgtaaatgttttaatatattcttcagtactgttatcatcatacaatgattcaaattcatgaagaattgtaaatccattgtctgaactacaaacaaagcacccaacatcatgttcataaattacatctaaacatttgtcagtttgtttttggtctaatgaaaaaagctttactggaataacaatagaagccaaagatacagcatacccatccaaatgcatttttttaagagtacgttgacttctatatactttttgtttaggaaagttttcatttacttttgaaaagatatactgcatattattcaccttattttctattagctttcttggattttttagctagtttattacgagtgcgatttttagcttttgcttttttatgttctttaattttctggtctttacgaacataatatccagataactgttcaataatttttttagatagttctaaatcttctggtgttaactcatacccagttacttcttcagcagcatcaatatttttttctaccatttcatttaggttattaatgttcatcttcttctccagttgtttaacaaaaatcattatagcacacttttctgttttgttccaaaaatttatacatgtgggacaaacataatgatgtgtgtttggacaactctagtgccatcacttaagattataccattatcacaaacatcaatcacagtacccgttacctttacaccaccagtaagataaaaatcatatataacgttagcatctattgtaaaaatatctttcatatattatacccataagaaaagggattcatagaatccctgttagttacaatttatagtttgaatggtgtgaatgtatctacttggatatcattcacaataccaccaatgatataagaacttatttcagtttcttgtggtgcaacttgtactgaaccaccactaacccaatgctcagtccaaggtagtgggttactcttagatacggtatatggacatttaattcctagtgcagtcatacgcttagaaccaatccaacgaacatattgttttaggatttctgcattcagcccaatgattgaaccatctttaaagaggaagtctgcccaagcttcttcttgacggatagcagacataaacatttccagtacttcatcataacactcttctgctatttttaccatatctggatcttcttttttcagaagacgtagaatcatttgggttgctgctaggtgtaggttttcatcacgacagattagacggataatcttagcattaccttccattagattgttttcagcaaacgcccaagaacacgcaaagcttgcataaaaacgaacaccttcaagaatgttaatactattcagacacaaccaaagttttttctttagttcgtacaaactaatttcaactgtttcaccattgattgtatgtatcccaacgcccaatgcacggtataaagttcctaatacatcaagttcatcgtagtatttggaaacatcagccgcacaatctgtgatttctggaatgtccaacatagtatcaaatacttcagatggattaggataaatgttacgaataatgtgagtgtatgatttgctatgaatcgcaccttcaaagaatgcccatgtctctataaagttctctagttcaggtagagatgcatatggaagtaacattaggtttggaccacgaccttgtacggaatcaagaagaatttgacgtttcaagttagaggtaaaaatgtgcttctcggaatcattaaggttggcaaaatcaattttatctttagatacgtcaacttcaccaggagtccagaagaaacttttctgttgctctgttagtttttcaagtgtagagtatttgttactttcaaagcgttggatatcaacactttcatcaaaaaacatatttttttctaggtgagacttctcgttaattttgaaaactgacatatatattcctttatatattttgaaataataatcccgccgaagcgggatcttaaattagattttacaactatcacaatcaccttcatccaaatcaggaagtgatggtaatacaaattgtccagattctggtttggcagcttctttcagtactttttcaacgtctacttcatctgaaccatcatttgtattatgataataaagatttttcaaaccaactttatatgcatacataagttcagttagaagagttgacattggcaacttaccatcagggaagtgtattgggttataactagtattaacactgatactttggtcaatgtatttttgtagaacaccacagatttgtagataaccaatgttatctttctgatcccatagtaaatcatatttgtttttcaacttattgatttctggaactacttgtttaagaataccatccttagatagtttcttcgttacaagagaacgtggcttttcaataccgttagtactgttactgatttgtgcacttgtttctgctggcattaatgccattgttgttgcgttacgaataccatattctttgatatcggcacgtaaggattcccaatcttgttttagttctttagttactaattcatcaatgtccgatttataagtatcgattggaaggatacctttggcatattttagattatcaaatccttcacacttacctttctctttagcaagctgtacagaagatttaattagatagtaagaccatgcctcggcccactcgttaactgtttctagtgctgcttcattataacgtaaaccacgtttagcaaggaagtatgcaaagttaataataccaacacctagtggacgatacatttttgtagcacggtcagcatgaactactgggtagtcttgatagtccaatagtgaatcaagagcacgaacagaaagatcacacgcagtttccatatcttctggtttatcaaagttaccccagttaattgcactcaaagtacataggctaatcaaaccttcaccagtattaatatcatcaaatggcacagatggtagtgcgatttcttgacacaagttggattgttcgattggagcaattgattcaataaatgttgagtgagtgtttgcatggtcaatattttgaatatagatacgaccagtttctgcacgttcagtcattagagtactgaatacttccacagcaggaacggattttttacggatgctttggtcagcttcgtattttttatatagtttttcaaattctttttggtcagaacaaaatgcttcatatagcccagggacttcattaggactaaagaatgtaatattctttccatcaaccaaacgttgatataaagttttgtttacttggaaacaatagtccagttgacgcacacggttaaactcagtacctttgttatttttaaggactaccaagttatcaaattccaaatgccacaatgggaagtgaacagttgctgcaccaccacgaacaccaccttgtgaacagcttttaacagtcttagcagtagctgcaatgaacggaatcagcccagtgtgtactgcatcacctgaacgaatctcggagtccagagcacgaatgcggcccatattaataccaagaccagctttacgtgaaatataacgtagaatagcgtggttagaggaaccaatactatccaagctgtcaccaacgtttagtactacacaagagctaaactgacgtgtatttgtacgtagaccagccataataggcgtaggaagactgatgtcaaaattacttactgcgtcataaaactttttaacatatgacatacgtacagaacgatcatactccataaagatgattgctgcaatagtcatatatgccatttgtggggtttcataaattttcttagtgactcggtttttataaagatactttccttcccactgacgcatagcaacataagtaaatttatcgtcacgtttatgtttgatataacgtccaagctcttctatttcttgaagagtatatttctcaagaatttcaggatcatatattttggtatcaaccatttcttgaagatgagcagtatatttaattgggtcatactgcccatatacttgcttacgaatactatagtttaatagtcttccagcaacatattggtaattaggtgtatcttctgaaataagttctgctgctgctttaataagaatatcatgaatagtactagtttcaataccttcataaaactgaagctgtgctcggatttcaatttcagaaactgaaataccacttaaaccttcagcagcgaaaaataaaatttgatggatcttatccaatgataacggctctttcattccattacgcttggttacgttaatcatgtgtcatccttgttttttgatgtaaatttctttttttagtggaagaaaaaggcgggacgccttttaaggtttgtcccacccacgatatacaaattctatatgatatcctgaatttaaataatccgagttaactatgttaaattgcatatttccagttgtagaatcatatgcaggatcttcaaatgagatagaaataattgcgtcagttctatttgtattatttgactgtgcaatcatcgtgtttgtaccagcagctacaatttgaatagttcctgattccaaaaccgtttcggtatcatcatatgcaatataatcgatgaatactctactttcactttcaagaataacttctatactttcttgattttgtggaagatcaactttaaacggtctgttaattatttttgataccgttctccacggtgaaaattctgtaattatttctacgttttctttacctgaatttggatcagtagtccaagttctacctgcaactaagctggcggggtcagatgatgatggaaggccaataaaaacacgacccacatcagtactgaatcctatctgacctttttctaatgcatcaggtaagtctctctgtttaccagttcttacttgttgtaaagcaatttgttgttgtgccataaaaactatctcctatagtattataggattatttagctttttctttaacttccgcaatacgctcattaattagttgagatacaactgagctatctacagaagataaaatttgttctggtactaaagattttaaatgtttaacatagttggaaacacttttaaattctttagtctgtaatgcttctttgataatgtccaaatcttctttagatgaaacaacacgctcaataacgacttcatcttcttccaattcaggagcaagttcttctgcaataatttcaacttcttcagaaactttaacttgttcttcactatcaacaacatactcttggataacttctggtggtacattgcgtgatacttcatcaacactaatatcttgtgcaatttgttctttaatttcttcaacaggtttagcaccacgttgtttataatctttgatatttagaattagcttatttgataaatcaagtttatcaatctcttcttcactaagtttaattacttcttctaaatcataacctttacttactagtgcacgaattgtatatagatcttgtttcatttttttatgctgctccatttgattcaatttctccacgtaaaatatagtattgttctacacgttcaatccacatattgactgcatctttgaagtcttgaccttctatgacaaactcttgatattgtagattgttaggatcttttcttacacagatgaaaatcacaccacgttctatattagtaccaaacatttgattatgggctaatgcatatgctgcaatttgcatacgataattttcgatttgtccccacttcttaactttacgggaatttttataatccataatggttgggattccatcatgaacacctactaaatcagttgttccggcccataaaccttcatagtacaatgggacttcctgtccccatacttcattaattctaggccatgcttcttgctgaattttgtcagccattctacgtgcaagaactcgaattggcataccgccttcatggtctggctttccttccaatctaaattccaagttctcatgcataaaagtaccaactgtacatgcttctaatgtaatctcattagccttttcttcaccaacaaattctctccatttctttaaaccttcgtcattcgaagtcgcacttagaattgttgttactgacggcagattacctgttggagttgaataaaggcgaccttctgggccgccttcaattctattgtaaccaacatatgtatatctgctaacaattggtggtgtgtacatccgtgtactcctaattatagcattatattttaatttgtctcagtttttttgtttatttgctgtcacagcagcttttgtggcccaatcttcaacttgctcttcagaatcttgctcgacttcttctgaaccttctgctgaatttcctgcaaaagttacaacatcagaattagcatcctgtacaaaaggaagggaattcaaaatgtccatcattacattgtatggaacatcgatgttggttctctttttaatttcagaaatcaaagattgaacatttacttcttctcgacccgtggacactaaagacaacgcaatagtagtaatcatattgcgtatatctttaccaggagcctcttcagtaagatcacgaaatctcatgtagaattgtccttaattattttttaacgtatcctagaacacgtttaactttcttttcattctcagaaagccatgttttcatttcttcttttgaactaaagtatttagtacccacagttccgcgaatactttccatttttacaccaactttacttggtttaacagattctttcatttcacgttcagttggtactggctcagagataatgtcttcttcaaagtctgcgtctgcatccatatcaaaagttggggtatctgctgcaatatcaatatcaacatcttcacttccaatatcagaaacatctggaccgtcagtgatatcaccagttagtttaagtgtttcagtactgattttgtcttttacatccattaaggtagtaactgcatgttgtagtagatggcgaacattatcactaaaattttgtgcagcatctagaccttgctcggctttaatacggtcaagtaatgggcctagtacgtcaacacccatgttgttaataacctcagattgacgttggagtttatccacaatctcaccttttactgaaagaacaatttctgctttttcaatattagattcatttagttgaataaacttcatagcttctgcacgagaagctgcttccattagttttttatattttgacatttgtatttccttataaaatatcactcatttatttactttatataaccttcgccttttagaaagtttaatacacgctcttttaatttatacgcttcagctttcttttctgcaataattatatctaaatcttttgcttcatcatacttcgattcattaagtacgcgttgacgtttctgggctgctttcaatgcttcactaatcacattcgtgtattgaagacccgaactgattataccaagtacttttgcatctgtcaacattcttccttcattaagaagattaactaatgtaagtgctgcttcatacatcataatattattcatgataatttgtgaactatgattacacttaatgctataaactttagtagatttagtaccttgtactttttcttccactaaactccaattagtttttggtttaagaggtgcttgtgatggtcgtggcgaaggtactggtgaattccctgataaatgttcattatacggagaattgtattgaaccatatgtggatgttgtggttcaccataatccatacctgcttcatttaatgaagttaaaatagaagccatagcaccgatatcaccaccagttttatatggaacccccgatgcgttatgtgtttcaccagcttcaatgtcattcaatccacttaacaaatcagccatctgattaactgattgttgatcatattcgtaattcatttactactcctaactgtttggtaagattcagtaccgtcatcattttctattttatttagaacaccacgtgataccatcttatcagctaattcctgataatattcatttaccttttcaactggaacagtaccgcgtgcttttatcttttgtaatagtttatattcttcattagaaaccattgtattgtgaccatgcacatttagtactgttctcattaacgacctcgcatacgatgacagaaatcgataatttggtctaccatgtcatcattatcagattgtgatgtgtttgccataacactttcatcaccatagatatcatcttctttttcaatatcagaaattgcatgtatcatttcgcccataccaggtgcgtgatgtgacaatggtgatggtgtatcaggattactatcaggctctaaactggaattagccataagttcactgttaatttcttgtggagatttttcttcacgaattggattattttgattatcaataggattaacatcactcaaaggaaaaacgttcaactcatttggcttagtcccacttttagtaataactaatgattgctccggtgtttgtcctgggtcaacaccaactacaggttcaaccgaatctgtcccgctttgtgtaccaggaacactaactttcatattattagcatttctttgcaactcagcttgtttcattttagcttgagtttgtggattgacttgttgttgaccctgagaaacattcattttagcaatttgttttgcttgcatttgtgtggcttgattttgtaaatcttcaaatacaattgcttttaattcttgtgtggttagttttgttatatctgaatatgtataatttttatgatactcttctgctaattgctttagtgacattgaatcaacaatactatgaagttcagtgctttcattaatatgtttgttaacatttttagtactaaaataattataacattcactcatctgtgctttgtatttttgtaaaatttggaatatttcacgattgtcagaattatcaatcgcagaatttaaagtgataaaatcacctgcatccatattatcaagaataacagaaacatcaacattcaaattatgtgcatctgcgaacttttgaagttcagttgctgtttggtttatatccataatttctccatataaaataaaaagacctctgtcttgctttatgatatttatcacaattaagaaaaggtctgtttgctgatgctaatgttaatatcatcaccagatgtgataaattttgttattcgttttccatttaattcggttggtagaaccaatggtataccattcaaacgaagttcgacatccattggtaatgcgaatttgaatgtgcttatggtacattttccccaagaaattggcatgttataaaaagatgaattattatctttatataaatcgacttcatttttaacaacgcttaccatcattggatagtcatataccataatagcttccaacaacctagacaagttcatagcaccagtgaacttagaatctatgattgttggggttttaccatcaccaatatctactacagtgtgaattgtgtagaatgtatatggtttcattctttgtccttatcttttttctctacgactttgtatccaaagaagttagtaggaggcaatctacgatgtaatggataatgtaaaccagtactgactgatgcaatagcacctgctgaagtagctccagaagatgcattttctttgatattctttttcttcatattaatttcctttattacgtttttcatcaagtgctatattctctaaccctttttgaaactttttataatctcggttttttatacttagaaataagcgtttttttaaatcttcagcatcagtttggttaaactcatcttcaatgctctccaataaatgaatcacagagtttattgcgtggtcggcacgattactaaaactctgtaatgtatctttctctggcgtatagtcaactatactatcaagtagattctttttattggatttactagacatttatcatttcctttgatttaaccattgcttcattgcatgaacacgatcagtaccagcatgtgtctgtggattctgtatttcgttttgtgtcgtagagttaggagcactatcagtatttagtgttactgtattgtcaggttgcacagatggtgatttagctgcaccagaaagcgaatgacgtaatgtttgcatagtgctgggtggtaacgccatgttccctccaccaatcttagaaacaccgctgtgacggaatccattaccttcggtttccatttgttgtactgtagttgcgtggtcaagaactctcaatgaatcaatatcatatgacatacgcaaacgggaacctactgcactactgttacgtgttttttggaaatcaaaccatagttcgccagtttctttttttgcttcaatataaattacgttatcagcagtataaatttttgaaataccaccagcaatctgactttgacttttcttatcttcgtccataccactacggttaaactgagatgcagtgaaaacagtcaaatccattttggatgcaagagcacgtaattcttctgatacaaatttatctttagtaaatgtattggatttatcatttggtccaagacgattagaagttaatagatccaaatagtccacgcatacataatcaagtttgatttccatcttaatttgtaattcacgtagataactttcaatatcgtctgtggttgttacagattcaggtaagcgtttaatacgcaacataccactgtttttaccttcaactttaacagcaaatccaatcttttcagcttcattttttacgttactgagttttgattcagtcatcataccatagatacgaacagcaaccaactcttcagctagttcaagtgaaatgtatgcaccattcattccagctttcgcaaagttaactgctaaattttgcagtactactgatttaccaccacctgatgcagcagcaaagatctctaactctctacgcccaaatccaccgaaaagtttgtaatcaagagtttcccaaccactcttaaatgatccttgcattgtactgagtgagcggattgtatcttcagggttttcaaaaatatccaaacctaactcattctgtaccgttaccaacattgcttctcggattagttcttcgattccaccatattttttctgatggacaagttccattcctttttcaacggctaaagctaatgctttatggcgacaaaattcaccacaggtatcaagtactgattgtttatgtaattcttgaacttcatattgatcgtattgataaccacctttaacttcaatatctttcaaagtaggtgatgaactatattttgcagcataatcatgcacgtattgaatactttcatgaaatgttttatcaaaatattctggtttaaggatatttttacaacgtacatataaatcaggattactgaaaatctgagataataagtattgttgtgcattaatcccatattgtttcacatccactgtgctttgaatcatctatgttccctcattatatgtattacatccatttatccgtttgagctttaatataaaatggctcatctactatactatcatgtattaattgtaaacaaaataacctaccaaatcgtgcacaagcttcttcaaagtctttgatatgacgtattgtactaccttctcttacagcaccaaagtctgggaaggaaacactgaatccattttcaagtgcttggtctatagttattaatccatctttatctctatctggaacaataactatttttttacctttttgctgtgcatcttttaatacatcaatctgtacgtttgataatttaaagttattagcagatacaccacccattaatgctgcgtctaacggaccctcacatactaaaattgtttttattcgttcatcttttaataaatcatagttatatagtatattagtacttacttgatttatgaacctgtatgtacttccaggatcttttaatttatgtcgtgcagtataaccaataattttaccattcatgaaatatggaataataaatctgtcatacattttatgttctttattaggtgaccaatataattctaagtctaacagatatgggtttctttcattgacattatgcaaaacacttataaattcttgtggaattttatcttcaggtaaagaagcccattcccaaaatgtttttgcatttgatggcaaatcacgtactgttactcggtcatacaattttgatgcaacagtttcttgtgcagcaaaatcaccgctgtcaaccatttctttaatataaaacttaactaattctatttctttatcttgtgcaccaaaagaaatgagcaaagactccatatctttgctcatatattttcctggttgccaaccagtttttaaactacagttaaagcagttatatgaaacggaaccatctgcattgaacatatgattaccacggtgctttgtatccggccttgaatgtcctctgaacacacaagctggacagttgtgttgtgaccatgtaccaatcgcaggtactggatcattcataatttgtgccattatgttttgtacagcgttcataagttaatccttgtcttttcttacaaatgattatagcacaccttctagttttgtctcatctacgtatcaaaattttaggtactgttaggaaagggtcatacacttttcggacagcagcatagtcatatggtactggaacaattttgggatgaatagcaaccaccaaacgtaaccacatataatttcctttaaaattaaatgcttgtattccgtcaagttcttttggaaaaccttctgaatcaattccattttcaatataatcctttccatctaatttaataataaaccatttatagttttcattatcattaggtacgttgttacacaagcacccttgtagctgtattctaccaataaatttatcaaaatagattgcaatactacttaatccatctactaatccaaactgcatttgtgctggtagtggagttgatgcgagaatatcatattcaccaatcataccatttccaattggttcatgatataaacgctttatagttgtccatgctggatttttattaactgatatttcagtactggggacaaatacaggtgctgcttggtctgaaattattagctctgctgatgcctcaaagttcatccctgtgtatagatattgtgttggttctataagtgaaccatccattgttactttagtaatgctccatctatattttgaaccaggactggtatcttgaataactcctgctggaacaatacatccataatatactttctttttatttcctaatgtttgtcttgcttgtccactttctgataaccaactgggttcttgtttttctaatacaacatcaaatagtttagtattatttcgtgcatcaaaaatcataaatgtaagatattcattatctttcaataaagtatattttccatcagcgttgtgaacagtaaaagataaattattatttgcccctctatatatagttagtttttcattgctatatggcatattaaaattgcccaatgatacttcctgattataagggtacataaacacgccgtgatgagccatagtttttccttccataaataataggtataaatttatactaatatttatggaactaatatgaatcaatataacactattccaccattcattactgtaatccagtatgatggtaaaacgtttgttggtatcatcaaaatcaaaagcaaacagtatacaactctttactgtttcgatgatatggatgattcaatgcaagacgaattgttaggtatagcacacgattggtggtggcaaagtaatagaaccattccagtttgtctattctttcaagaagagatggagaaatttgaaccgtacacacagagattcgatacaccgtcggtgaatttcgtatgtggtccagtagtttctttaagcaatttgccacagaaacgcatcaagcgtcgtaatgtggctcttaagaagaagtaagatgttcaactaaagcatttagttgtacaacaatcattaagctatatgcgtaagcatgtggctttttgaaatatcgtaatttatttcctgcttggtcagtgcctatagtactataatcccatatggtagctttaacttcgtcccatgtgttcatactttggcactgcctttttcctgggcgaatcattgcaataaacattgctagttcgtctatagatttaggcttccatacatttaataaagttacatgttttttaatttgcgatagatgttctacaatttcgggttctaacaatagatcccaatttggttcctgattcattagttcttttaaatgctctctatcacgaacatacatgtaagctgactgtgaaagaatatcaactttttgataccctaacctttcagcttctttatattgtatacttgccaatccagtgattggatcaataggtatattatcaaaatgaacaccactattatgggggattaaaccatcctccgtaattttttcagtacttcgcacacatggaagtttagcgattacgcttttactatccttgaagtcaatgtcaatatcagttcgggcttttctataatgtttagaatcggtcgaatcctgcattttttatttgctcctgtaactgtttaactgtattagtcaaagttgatatttgattctctaataatctacaattttgttttgtctttgccaattcttgacttaaactgaaaaagcgttcttcgtgtctttctaccaaagaaataattttttcaatacgagcaggatcatgaacttgaaatgttttaccatctaaagttatttcagtaatagatccttgtctaagtagagatatttgttttgatttttgttctttaggtacaggtacatacccttctggtattttattatatatactttttccattcataatcctgcctcacatagcataatcttaatttcatcacaatcctttttgtattttatagtttttatttcaaaataacttggatcgatgtatttaagtatatattcaatttctgagtttgatagttttttaaaaaacttattagtactttttttaggagcaagccagataatccaaggtgaaattttaccactctcaatccatgcaattgcacgggcagaacttacattttcaaagaaagtattccattgtacattcaaattttcagcccattcaactagtgagataacacttcttgcaattgcttcttttgggtgctcggcacgaattgtttttaatatccattcatcttttgctttatatgtactccattccgtgattggtttgttattgataatcaagtactttacaaactcgtccacattaataatatctctattattcaaatagtattcggcaaaactataaaaatcattaaagtactttgactttataaaagcaataaaaggctctacaccttttttaaatgggaacttattcaattccataaattgcatatatatacgaaaagcctccatcatctggcggctttggcggtcttcgtatcggtcacgttttatacatttatgtgtgtttacagtttcttcacgtttaaattcacgatcacaaaatctacaggtatatactttattacttgatttctttgccatattttttacattcttctttaaacaatttcatcatagatttcttttcattatcttgaaaaccattattgtcaagaaatgtctcaaatgtttttttatcatactgcaatagaacaattttgtactcatcttcattcatttgagtagatatagtatcaggttgtgagcttttaattaactcaaataattcgttatttgcctttttgaaattcttagaaaagtttaaccagttacgtggcatttcttgtccaccaatcatatcatggactgaacacataagctgatatactaattctggatgttctttcatatcccaaaatccatcattaaccatatcatttagcataataagttggtatttgacaacttcagtatctactaatgaaacaatttcggaacctgatacgccaaattcgaccattgaggatattaatttttgtgcgtcatcttttgattggactgcaaatttaatacgccaatcataatcactatgacagtacttagttactgatgaaacatttgtccctgaagactttaattcagtaactagttcagtcagtgcttctttaccaccagatttccatttaccaaatacactttcaactttactactagggtaggttacttgtaacgaatcatctaaagagcttacccatcgcaaaacagtatatggagtaaactcttttcgttctttttcggtcatgtcattatagtacttataatcagcacggtcaatgtgttttagaaattcagcaatagaaaaagaatgctgtgttggtttttcatcatcatcgaccgacttatttttaatatcactgaaatcaaacactattttatactcctagatacaaatcttgaattttttcgttttcatctgcaaagtacacacatggtggattttcaccactatgtagtgggacgcatagtaaattctttttaggtaacattggtatctgccactttgtagttaatgcaaatacacgtagtactttgactggttcaaacttaggatacattgaacggataggattgtaaacaaaagcttttggttctttcatgttaagaatgttttcaattgtacacatctcaaccataccagtttcttcatcacctaacataatttgccatcctagaggcacttgaataatcttttcaccaatttgaagatcagcactaatactattaaatgatacggtgtttagaatatgtctaaaataaaaatcagattcaccatttgggcttagatccaaaacacaatacatttcttcagggatatgttctgttactaaatccatgtcaaaagaattattttcaggtgttaatacgttcatgtcatctccttagtactgcgaatcttcttcgtcatcataatattcttcatcatcttggtcttctaccccataaaattcaagtccataagtttcacacatctcttgaattttatctacatcagtatccagatatgaatcaaaattaccacttagacttactacatcaataaaagttttcgtgtcagtacttgcatagatgatatcatatttcaatgattctactttagaatcaattcgtgtctgtaattcatagatattaatccaagaatcactatcaatattacatctccatacgttagtatcatccgtttctagctcaggtatatagtcaagagaagataccatgtcatccataataccatcatcgttcaacaatacatccataacttctaaagtttcttggtcacaaataaaagcaatactagatctcaattccattttattttacatccttgttgttgtcatatgacacattatatcacaaacagcgggtttatcccgctgtgttttcccaatctttaacatctattatactatgaggatattgtgcttccttatagtaagctaaacgttctcgtaaatgcttagcactatacttattagaaccactaatatcatatatttctacgtggtctttatcttctgctcggcgtaatccacgtccaattgactgtatagttcttacaaaactttttcctggctcaatcaatactacattatataaccttgaaatactaataccagtactggcaacgccgtatgtcgcaataagtattttattatcagcccaacgaatttcaccataagatgattctcgatctttctttttagtttctccacgaacgaattctgatttgggaatgcctaaaaattcacatagcaactcacctgcttcaagtctatctactaaaactaaagtgtttcctgattcagataacgcagatatcaatgacgctacatatgccatcctatctctgtcagttactaagtatttcaactcttcagcatatgatgcaaacttcatactactttttagtttgatgcaattcacattacatgtacttagtatttgtttatcttgtaattcctttgcagttattttaaatataacatcaccaacattacatttgattttcgcggcaactaccggatctttaggaattgttccagtaagaccccaacgtaatggtacgttattcataactttagaaagtacttgaactaatgcgtcaccgcctgcaccttgacactcatcaacgataacacaaactactccatcgataaaatcattcacgtcttgttcagttaattcaatttcacctttcttggttttcttccatagagagttaaatgattgccaagtcgtaatagtatgttggtgaccaaaatctttttgtgaaccatagaacatgccagtatccaacccacacataatgtagtcatcatatgtttgttgtactaagtcagtacttggtactattataacagaacgtccatactcttgcactttctttgacaatgcagcagtaatgagagttttacctgcaccagtcgctgccaatagcagtccgtgtggattagccaaacatgcattaaccgcattaacttgatgttcacgtagttttatggatttaccttccatgtggtgtcctgcaccgaatacaacatcactaaaaatatcttcatcaatggggtcaaatttaaatccataatctaccctatgatctactaattcaatgtcaatcttagcttcatcaagaataggcaataacttatctaacatatgataataagttgtcccgcctaaattcataaactgaactttaccatcccaacgtccaatacgtcctgctggtgtgaactttgcatatggtaacacatattcagttgcacgaatcatcttttgtctaattgagggatcaagtccctcaaatttacaattcacctcatccaataaggttaacttacaagttttcatccatgattacctttattaattagttcgagtattatattcgtactcaaatgtatatactaaatctttatcacagttagggttacttgcatctaaaatgtcactattagtaatcatccattcaatgtaattcaatggaactgtactcattggctcacctttgtgtttaccaaatggcatgaattgataacgcattggtgtgttgcagaaagttacaatttgctcaccaatatcaccattaggttcgatatgtccacgttcgattgcaatttcaactaatttgattagaacctgataacacataaacacatcgtcttttgctgcgtgtgcattaacaggtcgatgaacatcacgataacatccaaacttataccacaaataacttagagttaagtttttaaattcaatatcttctgcgaacattttcttagcaagacgaagggtacaaatccatttattttcatcaagtaagtactgtgaaattgagttacgatatttatattcgttatctaccatcattctacggtcaaattgtacattatgaccaacaaaatacttacggcatcccataagtgcatcaatgttatctaaatcatctttatacccaacacaattagctacatcctcagtactgataaagtgcacagcagatgcctctggtggaatatctttcaagggtttgtatctcaatgtatagttatcaatagtatcaatgttttcatgtgaagtatgtggatacgagatactaaattcaataatatcatcttcactctcaaccccagtagtttcagtatctagaactgctacatttgataaaaactcatttaattttgtcattttattctcgcatagaaaaaggacgcgatatgcgtccttaatgataattattctaaacgtgcatcctcaataccagcggcacgtagtctcacaatattgtttaactgaaaagctttcatctctaaggatttaacaatacttgaatatgtatttcttatataagatacctcgtttataagttctgctaactcacaaacatctttatcaccttcaacatactttttacagtcagatgaagatagtgcacggcggtatccttcgagaaagtatttgaacttctcggcttgtacctgacgcatttcaatttctaacatttccaatactgcttcaagttcttgaagctggcttagacgcgtctcatgccagccaggaatctcttgagcaattttttcaatgatgccaatcttctttacttcacgacgagcttcttcaacttctttgttaaagaactcaatcatttcaataattttagatttatcatctttgataatccaatgccaaggtttcattattcctcactaatatccacatcagtaccaaaagtttcatcacctttttcttcttctttaacttcttcaatcaaaggatgatttttaaattgatgcattaccaaatcaagacatgaatcttcattacgcatccactctttgcgatattttagaatctgttcgccagttacaatatcaacatacaatagacggttacctgatttagtgattagaccgtatttttcaaacatatctagtagaccactacgtgggtccatacctttatcccaaggaattttaatttctacatcttcgaacggcttgttgtaacgagtcttcatgactttacatttagcacgaataccatttacttcggaagttttatttccgtcttcatcttctttaagttttaatttacccattgcgataaccatagatgaagcataaatcaagccactaccacctgaaactttaggatctgggttaaacatgtcctgagattcataactgtggttaacgcaaaccataccaatgttcaatgaaccaatagagtttacacagtttgtgatatatgctttaagctgtttgggtttatgacccatgtcacctttaaggttacccgctttcatttgatcattggctacttcagtgtttagcataccaattgaatcaataataaacaatactttttgacgttcatctttaggtgtattttcgtattctttacgatatccttcaatgaactcataggtgaattttgcaacgtcaccaatcatacccatattgactttcaaaagtttttcttcagaagtgtcaacaccaagtgcttgaagccaatctgaatccaatgcgttctctgagtcaatcataacaacaaagatgccttgtttttgagcttcacgtgcaatattaccagatacgataaaagatttaccactacctgattcaccagcaaacatcgttactttgcctagtgggataccacggtcaaaatagccactgatgcgataatttagtgcgtagttaccagtactaacccatgtatctggatcatgaaaaccaacactaacaccagtattctttttaacactaccagtactgtttttaagaatgttcgcaaaaccacttgtcattttcataattcgctccttgaattttatgaaataaaacggggcaaactccgttgccccttaacttttcaaaaactattacttaccttgttgtttcaaacgagcaactagtgcagatgcagatagttgttcttttggtgcttcaggagtggttgctgctggggtagcgactggagttactggagcagcttgtggggctggtgtaactggagcagtaggtgctactggtgcaggtgctgactcttgttgtactggagcaggagttggttttgattcagtaacagttccagagttaggttttggtacacctgctggacgatatgcaaatgcccaacgtgctggatcatatgcttcaccatttactgatgcttcgaacatttcttcaattgctttcaactcttctggagttggttgttttggcataaaatcatttagattgtataggccatatttttcaattgctgctagttcttcttcgtttagtggacgctcagacatggagaattgagacatgtcgtagctattataaccaccaccattcttagttttaacaataccaaaatcacgaccttgaacgtagtgagttggagactctttgatgcctggatttagcaggatggatttaactttatcaaagatatctttgttagccagaatacgacgaattggattttctggtgcaatgtcgtcttttactgcaacgctatcaggagcaataaaacattgcattagataggttttcttcttccagtaacgaccagccattgcttttagttcttcgttccctgtttcattcgcactttggaaccattgacgtacttctttcagaaccggacaggatttaggaacccacatttcgttacaaggtacttgaacggtaactttatcagtgtgcataccgactacaccattgaaagttaggttaatcatgtcacgttcacgccagaagaatgggttagactcatctgcatctggtagaaaacgtaggtttagtggttcgttataaggtacgttccagaaagctaagaacgaatcagctttacgctcgccagtaaatgtaccattcttttgagcttctgctttttcttgttctgcttttaggtgtgcacgaatttcagctagagatttcatatatatcttccttgattttgggtttctttgttatttgttaattggcttcaatgtttcagaaacttcattgttccttcaacgttttacattatagcacaggtttttatactgtcccatattttttaactctgtttgtcaaggctcatcacctcgacaaacatcattatatcactcactatttgtttgtcccgctattttttaccatttgcccattccttgagcgattcaagttcaggctctagtaagatctgctttttcggtttatttcctaaaagagaatttcctactgcaatgataaattttgcgtcagatggttccatgtaaggtttctcacatatacccattactgcgtccttaataataccatcttgaatcaaatcaacgattttattaccaaacataaggactttattttcatcatctggtatttcaccaaattcaaattcaccatcaactggtacacaacctaaacatacacgttttgcacttcgtgttatttctttgggatctgagatgtcagtactgatattttgttgtattgtatttaaatattcagataacattttacactcatcgagtagaaaatacttcgcaaaacttctattatggtcgtgatcggagccaagtgttcctaacttattagcaaaattatctatgtatgtattaccaattctcggtagttccttgtgtgtactcagttgagtctgatatccacgtggtgttccagcgagctttaagttatttttcaaattattaatgtattgcatagttttggaagcataatggcttcgaccaccaatttctagttctgatagcaacgcttttaaattttcaaggtcgcgtgctgaaccttctatataagacccaaatttatcaccatactcgccaccctcatttaaatgatgggtcattgctcttgctgcatgtaaatttgtagtactcattcgtctacgttcaccattagattccacaaaaatctcttttatgtttctagttcgtgaacccttaatgccttcttctacacgactcttatgaaccactaccatctttgctcttggtagtttgtaataagaacgcatagcacttccatcaaggctttcatttaaatcattttgtttagtttcttccatattacgcatggcaatgtgagagaactttttaggtaaattcccagaaccaaagtcgtatacagtgaaaccatatccatattgattagcaacgtttttaagacgttttaaaacttgtaatgtttgttcatcttttatatcagtacttttccatagataaacttctgggcgtactgcgtcatcaccacttggtgcttggatcataaaattcacaggtctaatataaaaccacttagcttcctgtggactgatagttccttcaccttcgtcattgaacatagtaatactatattcatattgtggtgctgccaaaatcttataaatgtctgaacaaagaacccctttcatcatagtggtgtctccttcattttttataatattatttatcggttataagtcatcatgtacccaagtggcataaaatatgactcatcgaaatcttctagtgtttctccaataacatcagcagtattttcttcaaatttagaaataatatcaatcatacgcacaataagtagtgttgcacttactaagtcatctttacaacctaattttgccttaaaaacaccgtcttctgaacctgcacgtataaaatcgttaagctggcgatgtaagtttttactggcaacatccattcggaatgtttccatcaatttttgcatatgaatacatgcagtttttttagtacttttagttgtagtcattcccttacgaatacgaccagtgcgtgttcttcttggttcattgattaatgttccagggaaattctcaatacctaaattctgtacagcaagaattgctgcttcacctatactgttattttccaatgtccagaataaactatcttctatgtttctggctcccatttcttgcatttcataagcaatctgcaagagtattcgtcttaaaagttttacttgatctgtaatcaaatatttgttgtttttccattctgcaacttggcgtaaggttggtaattcatatacttggattgctgcgtcatcaccgccagtaccgccacttgggtcaagccccacaacataagtcattccatattcaattggtttgaaccactgaatgtcatcagttactttaataggttctcttacactacgttttttaatttcacttagtttaataccgtcaattaaagtttcttggtaagttacaaactcacaattgtattctcgtttaaaacgcgatgaaccgatcttatattcttctttagttgcccattcttgtgtacggtcagggtgagaatcccaacgtaccattatacctttaaaatcatttataccagttccattaggatcgtattcattaccaccttcatcgacaaaacgctgggattcgttccatatagaagcaaactgatcatactcagtgtttggtgtactagtgattatacaacgacctttggatgatacaagtgttggtgatactgctgaccagaattccgcttggaaaccttcaggtacgaatgcaaattcatcaagataaagtaagtttacagaaagaccacgggcagcagatggtgtagttgcacgggcaataattcttgatttattttcaaagcgaacttcagttacgttatacttttcaacaccatcacgtataaagtcaggacacatctcatatgcaaactggatacgttccataatttctttagcagttgctagaatgttccccaacaataaaattgtttttgtagagttaaacatagcataccacaaaataaatgctgctgcaacagtagttttgcccatctgacgagccgttaacataatgttgttttcataaccttgaaagtttcttaccatttccttttggtaatcatatggcttaaaaagtatttcaccacctttactaacaatgtaaaagtaattttccataaagtaaattgggtcagcagcacactttgctaattcttcctgttcaaagacggtatagttcatctttagaccaggtttttttattcgagtatattccaactcatcttcataattgtctatattttccatcatatttccctttcattaggcaatattcttcaaatttatgaatgcctaatatatttagcattgtttgttggtatgaaaacaaatcaatactattatgtaagaaaaaagggagatactctacttctggaaatttatctaatatagagaaaaaagataatgaacgagaattaattattacttttatatttttacaatatctaattgtatctatcatggcattgaagtgttcatccctcatatgcgttgacatatcaatgataatttcactcctaccaaatccgcgtaaactatcatctgataaagatctatataatatttctcctataacagtacttttacatctaataatacttgatgaaccagtatgcataactgatagttccaaatcaaagttattattaatatttgatatcattttttcaaaatgaaacttcattgattgtatattagctttaaacgaagttggtgctgatataaccatactttgacgttcttttgatttcaaaatcttgtaaagtgcataagcacctatagattcggtagtaccaattcttggaggaactacagcaacatacgtattatcagatttttctaacattctatcaaagatagttgaactatcataattcgttaatgtattataagttattaaattatccataacaaataaagggaagtacttttcaatgtacttccctaatctccttataagtttttttgttgataagttagttccataaatgttttatatggaccatatatatcgtctttatgttcatcaaatgtatcagtactgattgtacaacgtgggttatatgtcccagcttcggttttaacaagccaccagccaggataaaaacgttttttggatttttgacttttcttaaaagtacacaatccgctgtctgtttcttgtacatcataaacattatcggtttcgttaactggataatctcctatgaacttagtatttgtatccttaacttgtacttcttcatatttaaatggtgttcctaatagttcttccaactcatttaaagaatcaaactttaataccccatctgacgtaaaaaattcaacacctttatattcagttgggcttctatcatgatctattagaataccaatcttttctgaactatcagtttccgcgatataagaataatcagttaatttttttagaattgccatattactcatccttctttgtgaatagtttaatatatgattcaggggaacgttggacgtgtactaaatcatacttagcggcaaatcttaagaaatgaacaccaattaatgggttatttttaggctcacggttaaaaataacatcatccatcatttcaataatttcagggggttgtttagtcaaatcaaccagtacttgattatgtgcatatgcatctttaacacagacttcaactccatctggtctagtccatttatgattcataaatgaattccatgcataaccgcgagagtgacgatcattaaatgcttcttcaatacctactgcttttttagtacttttcattcttgcaccaggatatgcactgaatacattatctgatgtatcacccttaatacatttttggaacaataaaaactcagggttaggagtttcaatcggttttccttttttatcatgtgctggttcattatttttatcaaaaacaccagttgttgtatacatcatttcttgtactgggttatattgacgaacattaaatgcaagtaattgacggaagtcggtatcagtactgacaatgatatggtcatcttcaggatgtgtttgaatccagcgagcaataaagtcatcagcctctgcttctggtgcacgtagtaaagtactgttagtctgattatctacgaagtcgatgaaatcattaatcatttcaaacatcacttccatttcttctttttcatctttagttttgctggctgcttttactgcacgatttcttttataatcttcgtcaaactttttacgccatgatttaccctctgcacagaaaacaacgtgattaggattaaacatgtcttgtagttttcttaaaccgctcaaagtaatatgtagtgctaatcccacctttgtccatatgtcaatactttgagatgatacgttgatactacgatggaaacagttttgagtatcgacgagtagatataattttttcattgtaaatccttttaatagtgttgatttggcacatgaaaactcaattttcaatgattttcattgataattatagcacatcttgaatcactttcccagatttgataaataatatcatagaaattcattaaatatctcagtaaatttaaatgctagtgatattttttgataaataactttaagcaggatatacctgcacaaaatttgacaaggagattttcatgagtcttaattcttttaaccgtaactatggtatgtctagcgttgctcgcgaatggtggggtggtaataacggtttcgttaccatcgtaatcgatctaccaactgatgttgaactaggtactaccaaagttacttctgacggttctgatgttcaagctgaagcgtatcaaactgctctaagtaatgctcaatataacctattcatggttacccaactactacaacaacgtgcagttctagtgactacctctttactagctcttgattcagaagttgttattcctgctgatttcaaaaatgctaatccaaacgtagttgcgttcggcactagtggtgctgatgtagcaggtggtgctaattctgttgcattgactttcatctgtgaacgtcaagacgtatttaacaagcaagaagttcgtcctggttcagcatgtcctgctccagttgatccaactgttgacctagctaagtctatcgctcaagctaaagttttccgtaccaaaactttcgtaagtcaaggtactgatggtgttggtgatgcaggtgcatctactgctgtagcaattaaagtacgtgctgctcttcctgttcaactataataggaggatagattatgtcatatactaatacttcttttgaacgtatcaatggttattcctttgaacgtattctaggttacttttgtggcactaacgccctagcatccattgctatcagtaagctaggaaacgtaaacgttctagttactggtgcagtttcttcttatgctggtctacaacgttttctaaacactgatattccagaagaaattctagcatatctaaatgataaaggtatcaaacgtattgatggaactgcatttgttcttggcacactagaagctgattacaatgcatcttatgcagcacaaactaacgttaaacgtattgtcgatgttgttcaacaacgtgcggttatcatcgctacctctaacatcgcaggtaatggtcttgaagtatttccagttactggtttcaccaacgcacctgatggtgtattgagtgcaggttcagttagtattgctgatgcttctgttgttaccttcctagttgaacgtgctggtgtctttaacaaagatcttaaatcaccacaaggtgtaccaagtactgaatccgaagaaggccgtctactaattgatgatctaactggtgttccactacttgctaaagatggtgttaccgaagtttacctacgttcccaatctgctgatgcagcaggtgatttcggtgttaaacttttccaatacatcccagcattggtttaatatttttcaaaagaaaaggagagcaaatgctctcctttttttatatgttatctatatgaacgaaatccttcaggcaaaccaggtagcttgtctaatccttcgttcgcactcaccagctttgtgtcgtaatcatcactgaaatcatccgtagcaagtttacgccccaagtctctcacaaagttatcgataatttcttcttcatcatttcctggatgaccttcagctttcaactttttccagaaatattcattatagtcaaatacaaactcaacttcattagtttcaggatcaagaacaacatccaaatcaatccaaggttctttacgaagtgtgtatatttccttagaatattcactttgtgtgatttcatcgtaacgatatgcaaattcaatagccttaagccttttttcatcaccttctggcattaactcaatgatttccatatcatattctttttctgtaataactccaatacttagttttgcatcaagaactttaacatcatactgttcacgagtaattttagaatattttagttcaacatcaagtacagcaattagatattccaaatctccaattacgctatatttctttttaatatccaattgggccacttcaacttcatatggagttagatatgtcaattcagcaactttcatatcagcttcataatcatcattgtagtagtatgctttagctatctcttttgcctttccagaaagtccccagtgagcagggaccatccaaaatggaataaatttctttttagccatttttcttaccaaaaatctcttcgattttcattacataatatgtatcttcgccgccaccaagatcttcagtcagtggtgtgttcaaagatgaacgaccaaacacaaccatatcaccttctttaatattatgttctgcaagttgtccgttcggaagaattttacctggaccaacggaaattaccatcccaatacatggtggttcaacattacctagaataataccaccagtacttttattctgtgcttcaatttgtcgaacaagaacgtaatcattaatcattttaattttcatattagtaacctccagtatttgcaaaccattttccacggaaataaagattagcacccttatcacctggagtgaacacttccaacttcatagttttttcaccattacatttaggacaatcatgaggttcatcacgatttgcaattttaacaattttttccatgctatgtttgcattcttctttttcacaacgatatgtatataatggcattttgtattcctttactttttaaatcaaactaatttggggaacatagtgttccccgttatttatattagcagcctgttacgtaaaatttgtatactgcaattccagtatctagtgttacatttagcataccagttttagtaataccaagtgatactgattcggcattagatacgcgagataatgcttgaagtacgcgatcaatattataaccaaaaccaagacctaattcaccttcagttttagaaaaagctagagaaccaacgtggttacttttgtttttctcaccaacgtgaaagtatagggtgtcgccttcagtatacggagttacaagagaactaaaagatttaaatacaccagaaaaactctttagttcctgaacttttgctgcactaggaataacctgtacgtcatatggttgttcatgaaaacgtggttgaactggaataagtttttcagcttgtaccataaatgtagtgcttgcatcttcagatttaaatgccagacttttaactgaaccatctttaacatttgatgtgattgtggttccttcggtactgtatgtttttagagacattagaccctgaagaagacctagattacctaagccaaaacgaccctgaacttcaggaacatcttctttagtatatgctcgcattacaagagttcggtcatctgtgtacgcttctagatatacacgttgtccttcaccacggtcttcactgcttactgcaatacaagagaagtcaataccactggttgtgtttacgaggtcacgtagtacgttgcgtagatccattatataattctccgttttatttgttaatcaaaaaatgtttttatgtaagattactacaagcaccattatatctcaaaaatgatgcttgtctcaattttttatcagtattttgtattccaacgttgaagataaggcttatcaattgtagaactcatgccaattttatcgcgtaattttttcaagtcttttaatgtatgtacatcatcgacaaaaacaactttacgctttttcacaagagtgtaaacatcagcaatctctccgtcaacttccactgaaccagtgcgagtaaaacccgcaccaattagaactacttcttcatcattatcatatgctagtacagaattaatgataccattaccttctaatacttcaccaatacgcttatatatattactcatcatttttaccttgtaatgaagtccattctacatatttttcccatgcctcatttacactttcttcagtaagattcaacatctcattagtgaaagtatcgtttacttcgtcatagtttagttcaatttcatttacaataaccatattattactccttaccaagtgaagaatccattgtttactgacgcagtacttttttcatgaataccaatatccatatccaaaataccaaaaatattctctaattttttagttagaacaatctcttccattttttcagtatcaaatggtagttccaagaaccattctggaagatactcaacacagtcaattggataaccaacagctttaattcccataggattatcttttaagttacagacaattacttttgttccatccgttacttctggtacagatttatcatcataaacttcacgtagacggttccattggataccagcaagaacgtgaccaactttacacttaccagttagctgatattcagcctctaaattagtgtagttttttacagtttttggtgaacctttttcatgtacaggcatatccttaaatacgtccttaaactcacgtacacgctgttttagctgttgttcactctcacctaccagtaatgcgattagagtctcttctaggaagttctggatgtattttggcgtgtctgagcgtttaatttcaagacccatcgctttgatttcacctggtttaccatcaatatctttacggaacccatcttcccagtacttcagaattgcataacgttttttcttcaagaataggccacgcgaaccaaccatctcaaggtctgcaccaacaatcttacctttttcaataccagtgttgaacatctcatgcataaatgatgggaaagattcaccaacttcttcaccaattttaatatacatatcaacaatctcttctttagatagattatatggaataccttgttctttcagataatgagttacactaaagtaaactgagtcagtatcaccataaattactgaaccaccttggtggttatatacaccagtagtaatttcattgatacgacttgccatatgtttggtcatagaacgtccagttaatgttacggattgacctaaacgtttgtcaaaaaaacgagaacctttgttcaatagtgcaccatatagactgtttagaagaatcttacgaatctgttggttctgtttccagaaagcactacgttgtttgaagtaatctttttcttctttaggacagaaaatacgaccatcttttagtactaatccgttttctacaatcaacttagcaacttcatcccactgtcctttaccaatttctttacgaagtaagtatacaggatcattatcatgaatattagttctaaacattgtaccaggggtatagtttgatagtagtggttcaactttttcatagccattaaactcccaaccatcagtatacatatgtttgtagtcaatgaccattttttgctgtgctttacgttcagaataccattgagttagaatgtcaggaattacaccagacttagacttatcaaaaagtgttccgtttgcactaagtacaatagtactatcttctgcaaaaataatatcatatagctctttgcccgttgctttaaaagaactcccatcttctaaatcaacaatcaatgtttcttctgacttttcatgaaccattgtaaattcaacagcagcaaataaaccatgccatgccgcagtccaatctggttcaaatgatttagatttagatttgttcttctgttcttggattttagctgcaagatacgcatcggtgtaatcttgacgtaattgaccaagaatacattcagtactcatacccaaagtacgtagaacagtagggtaaagagagttaaagtcagtacacccaaggtcacttacaagtcctagtactggatcttgtacccatgcacctgctgcttttgcactaattttctcatcttcatcttcaccatcttcaccataatattccatttctggatcaaactcaagatcatctttcggtgctttgttgaaaacaacttcaccacgagtatgtgctaagttgataatagcagtgtcgattagtgctactgaacccattgttgtactgataagtacacattctttgtgtgcaagtcgattgtgtaggttgatatagtcacatttagcatcaatctttttaagaagaatactatcctgtttagaataacgcaagaaagtaatgtaatcctctctgtaaagtttatccaatgaaccttcataggatactttattttctttagttactttttcagcaatataatctagtttataagattgttcaacttgaccagcatgtttcttatacaaagccaaataatcaagatggacgcgacctaccagatcatatgtttgaacagttttaccaaagttgtctgcttcacgtgaatttggttttttattccataaacaccaacgagcagttgttgcttcattgaagatttttttagttcgattgatcatatatggaatatcaaagaattcactattccatcctgaaataacatcagaatcatcaattaaactaaagaattccataaacatttccttttcgtctgtatataaaattacagtactgttaggatcgtttgtttcttcatttagttggcgaacaatatcttgtgcttcataaatttccatatcagcaggtggtaaagtaagtacataatcctttccagtccatgattgatatagagaaatagcggttactcggttaaacgggtctgatggtggagcataaccaaatttcttatggaaatcagtctcgatatcgaagaacacgatgttcaaatcgggtgaaccttttcccatatattctttagctaatgttttaaatgtaatgttacagtcactttcaaaaatacgtagaccttcacttttgtgttgctctacacttttattcatttgagcttgagtttgaaactcaaaatgtttagccattgtaccataaacagttttatgtgttccttgtggggattcaacataatattcatatactggatctaattcgcgtagaatacgtttaccattcttacgttcaactacatgaagaatatcaccagtacgtttacgttccatataagcatcgatatacatcgtttgtattcccttacgtttattaagttaaaaagaaagcctccgtcattggaggctatttaatatattttagtactaattagtaatcatctgcttgtggaagattattagtaacactaagaatagtttcgatattatcgagtttattttgtttgtcaaagtaatcacctttgtacatacgttgtgcagcttgtttgatatcagatgcatcgataccaagttcatcagaaacactagaaacaaaatcagataaggatgctttggtatcatcaatgaaagttagttgtacaacaatgttgttaagtgcgtcaccgagacgtttacgttgttcatcgtttagatcacgaatttcaactttaacttcttttttagatttagccattttgtatttctccatgtgtgttttcaaaaaaatgtcacctcaccacaatcggtgagatgacttaattgtatcacgtctttacgtgttgtctcattttttttccggtttaactggaaatgaaaatgttttcttgatcatgtctgctggtttgattgaattcaattgcgttacataatctttcaattttacaaacaatacagcttcttcatcagttgctaactcaagatccatagcagtttttaagtgtccaagttcttgaattgcaatgtatttcaaattagataattcattttttaggcgttcaattttttcttctttagtttcaatatagtcatgaatagtatttccatcgtaaaccataccataaagtttgttaatatcaccatcatattcaatttcagaaacactaaaacctaaaggtactagatcataaatgttatatgatgctgaaacaattaaaccgttaatatcatacataaattttgctttattaatgtcaaacaattcacgagattcataccaatccataccttcatcggacatcatatacaaagaattaggattaccaccttctttatcatacatcttaaaatttgttagttgcattacacattccttattgttgacgtactgtttcccagttaccatttatttgcatttgaacatagcgataactaattcgttctaagtgagtgcctgaactaccattaacagaaatccatacgccatccataaatgcaccttctggtgtatatgtccatgaagaatcaggtattttacttgtttcaatacgtgcactcaaacgaatactttgtacgttattagtactaatttgcaaagtaacgttgccactagcatcagcagcagtaccgttaattgaacgaacaatatttttaccaccaacagtagctgagttgttagaaacagttaatgatggagcagctaaagtaccagaagagtttacagtaacttctgctccaccggaacgtaatctcaatgtattatttgaagagttatgatacactgccgcacgctcaccaccgcttgcgttacggaaatatagaactaatgatgtatcatttgacttaattgacgcactgtttgcaatagtcaatgaaccagtcattgtatcaccagtttttagtacataacgagtgtttgcaactttttcactcaatgcgacgttagattcagcaatgttatataggtatgcaacgttaaagtgttccacatcaatgttgctaataccatgatagtgtggttggtttccaccaagtgtgttagtgtttccactaaatgagtgaatgtggtctggtgcttcgttaatgttattgattacagttggtataccgttatcattacttgaagttaacgcatttagaccactacggtccataccttttagtgcttgactatgaccatgacgaccagcagcaccagtggttccactaaaactaaatgagtgtgatggtaactgggcaacacttaatactgtgccgctaatattaccgctactaccaataacactatcagttttagttacaccagatgtagatataccttttaagtatgcgttttggttaaggtttggtacttgtttggtaattgtaccattttccccctcccattgccaccacataccatcagcaaaacaccaaccgtcagacgttttccacggagcaccttgtgaaccgtttcgtccactttgtccattcgattgccctgacatttgttcacgtatactagcaacagattgaccagaagtcaatgaatattgtgtaatagcaccaggtttaagtgaagtgtaaagaccagttggaccagaaccaccactagaagcagtagggaatacaatgtttaagtttgttccactaatacttgcactaggaacagtactgctactgtatgttacactttctacttttaaatttaattttctgtttacttcatctaatgaaattctaattggttccaaaatagtatcagtatcgtatactgcaatccaacttgtaccgttatgatacttcaaaactaattcgtttcgatcaaaaaccattgcaccttgttcaccagtaggtaacgtttgtactggtataataactgatgacgaattaaaacgaataggtcttgggttagttggtgtaccaccaagcactattagttctaaagatccattagcaccagtactggtcattgtatccaatgggttattaaaacttatgctcatgtataaatccctttatgattaatatatactatatttattcctatagcaagtcgttatccatatcatcccacacagaatcaatgatgtttgctgctatctttttagacattttaaaccactccgtatttggttgtctagttgcattcatttgtttaagccttttatgtatctctttttcagctaaacgtgcgtcttcaaagtgaacttcatgataaacttcaaaatcacgaaacggggtagctgtctgatacgttctcaaacgctctgtcatttcagatttagaagtgaaaccaatcttaacatagtcaggccatgcagagtttattataacataacatatctgtgacatagattcaatctccatcattaatatggagatatttatctatcaactaatagtgaattttaaaccaatatcaattaaacgttgaaaaggattatgtggctgaaattccgatggttcttgtgctatgtttagtacaggagcatcagaatgcagcactgacatacgctctctataatgatctatgtattcttcatacaacatatcttcagtatgtgtattaagtatatcttctatgaaagaatctaaactataatccaatctatcatcattataatacaatgtttcagtggcttcatcatatccaactaacgtaccataaggaacatttatttctatatttgagtactgactctttaagtactcttctttgttaaatttgtatacagttaacataatttgatctccttaatgtcacctatgtgtatttagatgattatcaaaaaagaaaagggactccgaagagtccctattgtttttaatttcttgattaaatcttttaaatcgattacaattacatgaaagtaacgtttttgatagcgattttgctgtagtagtcagcagcgttaccaagagaagaagtactatcagtcaattgtacatacccgtatctggttaagaaagttgtaacgagttccccagtgttagggtccattacagtaccggaagccattagtgggatgtatgggcaatagaacacaccagcatcagtttctgcattacctttataaccaattagaatatcttctgcatcacttgcataagtatcaacaaaaatacgcatagtgctgtttagagtacctacaaacttaacgttagttggtgcttcgaaagtaccttcagtggtacgtgcaaagctagaagtagtagcagattgtagaatggttagtgcagttggggaaacaacagcccagtttgcagcaccacgcttagtacgacgagcaacttcgtttgcttgacggttaattagagttgctagagcagcgtgctcatcaccaacgaaggttgcaacaccagtaactttagattggtcataagttacagcagcagcaccaggtagtgcacgtagacggcttagtagctcttggtcgatttctacggtaacttcttgagcgattgcagccattagttctgcttcaacgtcaacaccatgttgggattgagcatcttgtgcagattcaacagtccaacgtgcagatagacgacgagatttcgcttcaacagtttcacgtagaatacggatgttaacgcgacgacccatagtaccttctagttggctagtaggagcagcttgtgggttgctattatccgcatttagatcaccagagtaggatttagcgattttgtatggagaaagcatttcttcaccagcgataacaccaggtgcgttatcagcatattgcacacgtagggtgtggatctgaccaactggaccagtcattggttgaacaccgatgatttcgttagcaataacggttggcattacacgacgcataattggtagaatcactttgtttagagtagcgatgttaccagcggtagttgcaccagaagttgcggattcagttagcataactttacgatggttatcaagaacagtttccattacagacttacgagtaccctgtagaccttcaactagtttctcttttactgctacccatttggattcatttagtagttgtgacattatatatctccttaaagatgttatattcgtttttcagtatgatattatttatagaactgaaaaatttgattattaaaatgctttaaaatgtttattttttattgatacctgaaagaacatcgagttcttttaggaatgccatatcgtcagcggtcatttcttcgctttcaacaatagcctgacggttgccagtgattactttaccttctgcaagagttttcttagcggaagactgaactgcttgacgagtggtagcagattcatttactttagtaccgttaagtactgacttatggtacttgctgaaatcttctttaagcttttcagtaggtgaagtagctagaagggattccataatttgtttttgctgtgcagttagtggttttactagttcagacataatcgcattacgtgcttgtgcatcttccataatacgtagtttggttttagcagctttaaccgcattagcagtttcatgtagttcttgcttaacttgagcaatttcatcttctttggatttaattgattcagttagggaacgtagcaatgagttttcattaaattgtttgacattaaactcttgagcaaatgcttcaaagattttacgaccaaacatattttgttttgcttccactagatcttgtttcaacgcatatagattcttctgagtggtttctgcaatatatttagcagcactttcagatgtacgtttgatgaagttattacgagcttcagcaatttgacgtgaaccttcagcaagtagtttaacgcgagtttcaactagttgacgtttttcagtgtggaattcttttagctcttctgctaggataccgttagaaaaattaacgaatttacccatgcattcatgaagatgcttacgttctttacgcatttgtttaacttcttcagccaaaacagagtttgaaaacgcagagaaattgcttagtgttttacgtagagttacacgatcttcaacgagacgttttttctcttcatatacagcacccatttcttcagcaatgacttgagtaaccatagtgttcaaaccttcggttagttcagccaaatcttgctgataacggcctttcatttcttcacgcatctctgcggctagtgtattcttttcttcattccatgcttcctgaattagctgttttgcctcatcagaaagagatgattcttttagaagcttttctaatttagacattcgttctctcctttaagtactgaaatatctgtacttcaacatacagatatttatatttttaaaatgttaaccttttaatttcttgaaaaaatcgtatatttcagaatctaaattatttacttttttagattcagtgatttttttagaactattacaaggtgatccgtacttactcatcagagattcaaataccgctgttgggtatgcttctggagcactaggttgagcaacaatatcaatagtgataatttcaaaatcagaaactattccattataatcaacgttaccggaaccgcgagaacttacaccaagttttacaccagcctctagcattttacggatattttgaccatgtgcagtatcaagtagtttgatttctgccataccattagcaccttccatccaaaccttagtaatcattgctgctactcggtctaggttaatagttagtgtttctggatggtcacattcaacaagaatgctttcacctttagctaaacgctggttcatgttatttactgcccttgtaatttcagataaagggtaaattctctcgttcaaatttcgttggtcggcttgaatagcaataccacgaagatagcagtcacgcccaccaaatccattatcacgatgttccaaaacaactttagaatcattgaatgaagaccattcacgaatcatactactcataatgatctcctttcagatatttattttagtttaggttgtgctttgcttagtggtgatttagaattagatgcagtagtttttggtgctttaacatctttcatttcaccgcgagcatttttaccaagatctagactatcttttggtagaacagatttatcatctaggtctagtagtggtgcttggtcagttttcttagcgaatttaactggctctgctcctgctactggagatttagcttctggtgctactggagatttggaatgagtgccagctttttctttcttatcaactggagcaactttttctagtttgaaggattcaccgaatttttcatcaccgaattcaacatcagcaaattcgtcgtcaccgtcaacgccaacttcttcttcgctatcttctacttcttcttcagaatctagatcaacttcaccgtcaccgatttcatcaaacatttgttgtaggccacggaaagcatcttggattgattcccattggtcttcggaaggaacatcagcatcagctttcacttcaacgtcaacatcgtcttcaccgtcaccatctgcatcagcagagaattcaacttcttcttctgcactttcatcttcttcaccaagggtgtattcgatttcagcatttagaccttcgtctggttgtacatcaaaatcttcgtcaagcttttcttcatctttgactttaacttcgacttcacaatcttcatcgtcgtcttcatcttccatgctttcttctagttgtttgttaatttcttgagcttgctcaacgaaatacttacgcatttttttatcagcaatatcttgttcgccatttgcaaacgccgcaattgcttcttgtagtagttttaaattcgccattatatcctccatagatatattacattcgtataaagtatgatattatttagtactgaataaaatcgccttttttaaaagctttaaaaagtgcgatttttgatttacattaacccagaaccgtcaccagttggtgcagcggcataaacaactgcaaccacatttttgcggcgttgttcttcatgtgctttaaattcacggtactttcttaagttgtttaatacttgtaatgttagtttcggttttctggaatcagtaattttatatacgttctgatcatcttcagggtcgtacattgaatcactgctagattcaaagatgtcctttaacatttgatctccttgaaatatgcattataaatgagggtaaaaataaaccctcattcttatacactgttatttatgtttaaaaagaattgcctaaattattagggttgaaaccaccacttccactctgttgctcttggtattcggcatcagcactttccaaattaccttctccatcaataccaagatccattccaggatcatttggagcatcaataccaacagactgtaatccagcggaatcttcttcaccaccagaaggttgggaaccatcttgtggattctcttgtaaccacatttgttcattcttaacaatatcagctttagaaaagcccattttttcaagaattgtttgtttcgccatataaggcaagtcattaagaggaagatatgtattaattagtttagcatctagttcagctttacgataagaagctaagttaataggtggattcataataacttcaaaagatgaagtactaatgttatatccatttttaaccataaatcttttgaattcagcatcaaaatgttttgcaactaaacgttgataacgcatacattgattattgaatcgcaattcacttgccatagcttgtgtagcaccatcaccaaataatgaaacaccaccatcatctggaccttgtggtagataagaagctggtatttgaagaccacgaatcaatttattattaaaataacgtaagtcatcaatttgtcctaagttatcaccgcctggtaatgtttgaacatctgaaccacgaccttcagaagtttgtgggaaaaagtagtcttctaaaatgcttaatggattatatgctgcatccatcaatgaagtacttccacctttgtttgaaggtattctacgctggtggatttcatttttaaatctttcaacataagccatcgcttgatgtgcttgcatatcaccaacatcaattttaaatacacgacgctcaggtgcacgttgtacacgataaattatgatactatcttccagaagttctttttgcttatagactttaaatacgtcctcaagtatactagtaccaaaaggccataccccatcttgtcctgtatttagcgttagatgaattacgtgttctgcaccaacaggaataacgtctaattgaccgttagtactgaatggatcagcagtatttccttgacttgtaaaaccagatgcaccacccgcagctactgaaccaccaccacccattgttgtcggaatagctcctggataagcggttttatcaaatcctacttgaaggttactaaaaactttatctttcaaatttaatgatacgtcacgtatataataaattactggtgttttaccagtggcttcgttaacaaatacttgctcaacatttttgggacttacccaataccaatcgaatgtttctggatctcgaatgaaaaattgatcaccatatttcagaagaccacgcacaatttcatacattcgtgttttaaaatcattttgttcagtccatgcatctaaacgatcttcaatagtagttacttcagtatcaccaatatcatctttatatttgattttatatggtaaaccaaaatcttcagtactttgggtacaaaagtcagcaattatattcaatgcagttctaatttcaggatcttggtccatttgctcatactgactataacgctcagtacggtttgccaatccattatatacaacaggaagataggaagcgaaatttgttttcgttcctgttgatttattgctattactggactgattcgggatggtcgatagtttagaccttcccactgtcatatgtcgtttccaactcattattttcgtccttaactgtttctctcaccttgagtgttttcagagatagttcttagatagttatttgtctgttgcacggcagatagagattgctcattaacatcagcaagttttttaagtaactctttcatgtcttctgatattgtggcattattattagcatttgccatactactaccactatttatcatcgctttcatggcctcataatcgtccggttcagcttgaattggtggttcatttggaccccatgctgatttatcaaaagtttttggagttatggtaacatatggtgcaacatgttcagatttttctattctcgcagttgctcttggcttattttcaagaccactactaataagtttttcagcaactgattcatcaaggggttttggttgtttaaagtttctacttgaattccattttaaaaaaccatcaaatgaactagaaatataatcaccaaatgaattcattttttcttcaaaataattattaactttttctgcaccatcggtaacagaattgttttctacttttactttgtcgtctgaaccaccaaaccaacctttaacagaatcccaaagtttaccaggaagatccattaggttattcataaagctatcaaatgcttctgaaactttattatatccactaccaaaaatttcagtacctaacccttctaaccactgctcaaactcaccaccaatcctatccaaatacgcaactgcatctttcgcaataggaaccaaaccaaaaccatcaagtgctaactctccgataaattcccatgcaccatcagtacggtctgcaatatcagtaaggtaatccgcaatataattttgtgtatctgcatacattttattaaatggttcagtaaattctttactaatccatctattgaatctatcagtgaattgtgttagtttatctgctggttgactcttaggatcattaatcgcagcttccatatcaagtagttgttggttgaaggttgctgccgtagtgtttcctaattgtatctgatttaataaatcttgctttattagttctttgttctttttaacaaattccaattgttgacggcgaatttcttgtgaatcagtaacaccactacgtaccaagttctcacctaaatcagcaaattggttcagtactggagtcaataaatcatctggtactccaccaatagttaaacgatgtgaaattaaacgtagaaaatctgcaccagcatcacccatactggcagcagcttcgttaaatgcttttgatgttgcaactgctgctttactagataatccagaatagttttgtaatgcgatttgcattgaacgtgtgtctaatgatttatctaagttttgtgttttatttaatagtgcatcaactgactcacccatacttttactgaacttagtcatactcatgataaactgttcagtactttttgcttgatccatactacgtaacatttctcttccaccaaattgcttttggaatttaatattacgtgcagttaaatcagttaatgttttttgagaaacaccatataaacctaattgattttgtgcttgttgcacagtacccaataatttaccaaatgtagaaacaccatcaccatatgcaccatctaattgtgcaacaactgcactatgggtttgtaatgcttcaccaaatgcatcaatactcatcattgatgcaccagcaccttttaatatggagccgtaaccttcagatagagcgacaccagcactgtttattctattataaacttcaagctgtgcatttaacacattataaactgctaaaccagcgtcagcaaccaatttgaatgcagatgctgctgcaccaactggaccagggatcattgctaatgaaccagcaaatgaagatgcactcattcctagtgagtttacaacattgctaacgtttgcagacgtactcatcatagttttgccgacattcgatacttcagatgataatgatttgaatatttttccaaattctttaccatcatcagctttgttatttgttcgagagccacggtttccagtacttgatgaattacttccattacgttttccacttttagaaccggatttctttctatcattttttatattttcagccaataactcacgtatagcactcaaactatcgttgttatctttagtttgattaaccaactgctggagtaggtaatcacttgtatttccagccataacattcccttttaatagatgtattatagaaatatttatgaaactatagagaatataaaaattagtttaatttaatcttttttagtcttataaatactaaaacacatttattacatggagatttaataaaatggctatgaatccacttgctaagtacactaaaattgaagagatcagtactaagttagttacaaacggcgttattccttataaagaaggagttctaggtccaaaaggtgtcaaatgtggagtttgtgcacgtagtgcacgtgatgaaatgacacttaatacccccgatatgttactaaacggagatgcagtatcccgtgttattgaaaactgtgttcctaatgtaattgacgctgatgagttgtatgtaaatgacgttgaaatgcttcttattgctattaaagttgcttctaaagaagaaacatatgatattaacgttgtatgtcctgaatgtgaaaaagaaggtcgatttgaacgtaatctatcatatcttcttgaaactgcacaagcatttgaagaaatcccatcaattgatttagataatggactccgtttagaatttagaccactgacatggaaagaatattcatcgtttgctgaacgcatgttcagtgagcagcagaagactaagtttcttgaaactgctgatattgataaagatgaaaaagtaaaaatattttctgaagtatttgaaaacatggctcaacttaacttcgatatgattggtggagttattgcaaaaattataacaccagatggtgatgaagtagttgaaaaagaatttattaatgaatggcttggacaacaatcgaagggagtacttaaactaattcgtgaaaaaatggatgaagtacttgaaattggtgtatctcatagtatggaagtagaatgtgatggatgtaatcatcaatgggaaattgatggactaaaatatgatcctagtcattttttcgagtaatgcttctccagtcatctcctgaagaaatacaagaagtactgaaggagatagaactgaataagtcagaaatcaaaaatgcactaatggaatgttctgtatatatggataacattgactatggaacactccttaatatgccattaatagatagagacttattagttaagtcttttaataaaaaaattaaaaaacaaaacgagaagcactaattttcatatagccagcacattgttgctggttttttggttttaaactacagaattatttgaattgaattatgaaaggattaattttaatattattggattcatctaactcatttcattcgttagctgaagaatattcgttactacgtaactcatattcatttaattaaattaattataaagaactttaaaagatttaatacttgacgggatttgttgaggacattttcatccccccgcaggggaatgaagacaataaaaaagagacaattaagtctctatttcttgacgctgatggtttcagcatttattgtattgcgaatttcttaaaaatatattaagaacgaaagcgggttgctctgtttctctctatcgcagtcatgtgcaacggtcgtcagtcttaatcatcctgacactcacctgaaagtctatacaatcaaacttcaggctgtttattaaaatcacttaataaactcccttagcaaatctggtaaggtgcgatccttatatgtctatctaggaactctctgtatgcttatcggagttctttattgagccgcattgccgtgaggggttcaaactatgcccacatctaacgggtttcttttgctcatcgcactgttgaactgctcatctgccatctacattttcgataggatcaggttctaatttatatgcatttctgcattcaacaggattgtcattactacaacaaacattatagcacaaactttaaagttgtctcactatttttataaaaatattcattaagtacttaaaatattgcaaataactaatctataaatattttgataacaaatagtttggtgaggaattatgaaaaaaagattaaaagatagtaaggatgctgcaaactatcgaaacgaattgctaaagaaacaaaatggaatagatcctataattaaagaaccaataactaaaccagtactggatcactaccactatggtaaccaacattgtagacaagttcttcaaaatgaagtcaatgcttgggaaggaaaggtacaaaacagcttcaatcgatatatgaagcacttaactgataaaccattatatgaggtactcagaaatcttgctgattacttagagcgtaataacagcattcctgacgatgaacaagttatacatcacactgcactaactgtggatgttaataagtttaaaaggcttccagcaacacagcaaaacgcgattctggaagggttaggagttgtccctggtagtaacactactgctcgtgtaaagcaagctagaaagctgattaaggacggtaaattaaatatggttgatataaaaaaagggagctaaggctccctttatctttaattagaaaacatcgtcaagggttgcatattcaacagtactgaaaccgtcctctttaacaactttgaggattttttcagtcttagatagtaactcttctctgtgggaaatagcataaacgttcttaccacgtacagcagccatatcttggaagatagaccacacacgtagaacaccacttgagtcaagaccttggtcaatcatctcatcaatgataagaatattaatactttggtataatgactcatatgtatcacggaaagcacaagataatgcgatgtttacccttgtacgctcacctctactaagctgtttatagtcaaagtactgtccactcttctcaatttcaacactcaaatcattcaaaaacacaacattatgctcagaaccgcacatatcgatatagtactgaagtcgtgtattcaaatatgagatattttgctcaataatacgtttacggacataagaatccttgtttaaaagtaatttaaccaagaaatcttggtgatttgacattttatcaagattattatagtcgctataatcgattggtactaaagaatcagtcttcagggtattaatttggctaataaatgtgttagtagtcttcaattcacgatctaattgctgtgataatgaatttacagtcatttctaactctttaacttcatatttgtttaatgtatctggaacttccattagttcatatgagttaagttcatcatatgatgacataagttcatttgcatagatgtttatttgttcttcttcactctttctgaccaattcttgaagcttatgttcatgcatttgtgcttctgaaagtgtattataatatgtcacaggcttaggtggcatatcaaaaatctcaatactatcaatttcttgaagtaatgtttcaatttcagaagaagaactatcaattttagcttgaagatcattaatagtactttggattttgtctttaattgaagaagtatgttcgttatgttctaattcagacatacaaagtggacatttgctgttttcaactgttgataatttgtcaatttcagcattaattgaacattcatatccttttaaagctatttttagtgagtttagtttttgttctttgaaacgtttttggttattattctcttttagaataccctctaactgtttccatatctccaactcattatgattttccaattctgcactaatatcaatagtttttagcttatcaatgcttagatttaatgctcttttagatctttcaagttcacggtcatatgcatcaaattttaacgccaactcttgtacacggcgttcgatttccccacgctttgcgttatgaataagagctttctcttttatatcagcagcttcatagaggtcattaaagtctaaagttttatatatattcaactcttcatttaacttagatactctattatttttatcaatttcaaactggtttgcctgttcttgtagtgtctcaatacttttttgaatacgttcattacttgcagctacagtttcatttttgaacttttcttgttcggctaaacgtttagtatccttatacatctcctttagcatttcagctttttccgtcaactgtgttattccaagaagttcttctatcatatcacgttgtttttgtgtggataaagctaagaaaggttcaacgttagcattcagtactacaatatgttcaaataataattgagatataccaagaatttcattcaaatcttcttgtgtgtctttcttttctccccttgattcatcttcaattttattatctttgcctaaagtaacaaaattgaaatacgtgggacttctcccacgctcaacaagatattgtacaccatctttttcaaattctacaactacttcacaatttttaccattagttttattgactaagttaggaattttaatatcattaccaatacttttcccaaataatccaaaaactaatccttgaataatagcacttttcccgacaccatttcgacgtccggtgctgtcaccaccttcaataactgcatcattattttgacccagtactaatgaaatgtcagaaccattcaattcaattgattgtggtgcattaccaaatgaaaagaagttcctcatagatatacgtgtaatgtttagcatatagtcccttataacgatctgtaaatttggattagaagatttttatcaaacatgggtgagtcaatttccataatttgctgcaacacaatctcatcaactgattcagtactttcaaaactaacaccatcttcaattaattctgcgatactttgcttgctcgttacaacattaaactctctaatgttgtaaagtttagtaaatgtatcacgaataaaactaatctcatctgttgttattgatatatcaacttgaacttttgatattgtgttatcttgtagataatagcttggatcagtcaacaattcagaaagtgtgaatgttctatattttggtgcattatcccatgacttgaaaataggttcttttccatgttcaagaatcatcacacctcttgcatcatcccatgtatcggaaaaattatgtggaaaacaattaccagtataaactacacgagttccttttgaagttgtttttgactgccttttatgaaaatgtccactaaaaacatactcacaaccaccaaaagaaccttctgtttctttaccatgatcaggcatttctaccatcttgttaagcaagtaacctggtaactctaagtgaccaaaaacatacttactttttagttgaggtaacaacttatattcatcttcaatcataaatggaatgaaagtacaatcatcaaatgttgtaatttcattaatgaattctatattttcataaacttgagccatattgatacttgttatatcacgtttgtttttatgatacatatcatggttgcctactaaaaaatatactttttcaaaattatcatttaataattgaagaatttgtaaaccatagtttagtgtttggatattgatattacttctattatgaaaataatctcccataaaaacacaaactttgatattattttttttagctacctcaatcatgaatttaatgaagtttaaacaatcttcattgtgttgcttgctgttattctttaaacctaaatgaatatcagtgaatgtaattgctttatcaaacagagccatcttcatttttcctttcaatcatgttcaattcaatttcaatttgacgtgtatgtgatggcgtaaagccatgcatttcaagtaaatcatcacgtatatttcgaacatttttctcactattcaatatagaacgaaaactattgtttacgaatgatgtatagtaagagaaaggatttagctgaactgctggtttatcttttttataaagaatgctctctttaaagagaagtgcgtttttaactaattgtattcttgcatcacccatcatttcatctaagtatgtatagtttctgtaattagatttgtgtgagatttcctctgcaagtttaatgaacatcttcccaagttcatttgtaattttaccatgaacagtactgaattcaccagtttcaaggtcgcctttccagtgagaacgacaaacttcatagagaataccttcattatctacaatataatgcttgaatggttcaaagttaactctagtatctggtggaatatgttcatctgtaataacacgaataacaacttcatcaattggaacgtcagtgataactaaattgtgttcatctgcatattctttagcttttttagcactcatattttccttttcacgaatactatcaagcatttcattgttcagtcgtttaattcgtgctgccttagctttttctagtaactcagcagtaatttctgactcatgaaaaacaatataatcatacatactatatgatttgtctaataaccagcaatatgaaattttacttttttgtatttcacgaagtaaatcagcattattgagatactttttacgctttggtctatttgtcattgtattttactctccatgtttaaatccaataggtacaatccttgtaccatcaatgttattatagcaccaaaaagcagtttgtcccacgtataaatacatcaaatgttcccttattatggagaatcaaaaagatgattgatcgtagaattcgattacgacctaaagccgcaggtgctaactatgtatatggtgattttggagatagctccgaaccaactctactttcgtttctgcgtccaactaatgggttggtttggactgtaacaccaacaattactgaacaaaggtcaattcagtatgaaacacagtcccctatacatactaacagtaactataacaactataagaacactactaatacagttttcacgattcagggtgaattttatgcgaatacagcagcagaagctatgtatgcgttggcatgtgttcattttatacgttctgtttcgttgatggattttggtagacaagctgcatcggctaataaccccgaactcgcaattgcaggtgcaccaccaccaatcttacttctaagtggatatggtcgttatacatataatgatattcctgttattttaaaatcttataattttacttacccaaatgatgtttcttatattcaagttccgttgaatagtagcgatagtacttttaatttatccgacatggatagtagaaaattcttcgaacaacttagaagtactggatatatgaacccacaagatgaagtttgggttccacaaaaaatctcagttatgttacaacttgaagaacaaccaacatcggattatatgactaaaacgttcaacctcaatgcattcaaacgtggtgaactattacgtaaaggaggattcatttaatgtccaactatagtcaatactcaccttacgctaaggtgaaacaaacatggtatcttgggtatactttaccacgtgatattgttccggctgatactgatgatttttatgagatcccattgaaatatgaatatcaaccttggcgtttagcatacgaaatgtatggtaatgaacgcttatattatattttcgcattgttaaatccagacatactaggagaagatcctatatataattttaaaagtggagtaacaattagaataccagcaaatcaaagagtacagaattatcttaatggtactcgaaacataggctaatggagtaacgtatggcagatttacgaagtacagttgataattttcaaaatgatattacaagtattactggtaaggctaaaaccaccacatctaatgcacttgatagtttgaaagctacagcaaatacattacaaaatgatgtaaaaactattacaaaaaataattacaaagcaaatgtaagtaatgtagtatcattaccaaaacaaagtgctagtgttgatcaagtttatgaagatctcgatttaagtcagtttgtaataccgtatgacaataaattattgaaatatgataacccaacttggcacttttgtttatttgccttagataaagatgattttaaaaacttttggctttacccagatgcagaagtgcaacgacatgtgatatcagaaagtggtgttactggcaaatataatatcactagtgtacaaatgacacaagctggaccttcaacaccaggaatgacaacaaactattgttttaatacagcagtacttaatatgtctgaaaataatagtatgagtctatatgatgaattaatttcgttaagtaacaaacttagatatcataaatttatggacttgccattgatcttggaattaaagtttattggctttaataaaaatggaatacctgaaattatcccagaaacaacaagacgctggtcagttaaaattaatagtgttactgcaagtgcttcacaaagtggtagtactatgatgtatactatgaacttagttcataatagagcagctttagttgataacattgaatggaccttaaaagaaccattcaattgtactgctgaaaactttggtgacttctgttttgatttagaagataaattaaatcagatggctgaccaacaatatggttatcttagatataaatttggtgaattatccgaaggtaaatttttcgaatttaaagtagcaccagatttgcaagatttgtttataaactatgattctaaacaaatggcagaggccggaacaactaaaagtggtgcacaaggttctaaaaacttttcatggaacccaagtactcctatatctcgaattattgatgacgttattgatacatgtactgtacaagccgatgatagtactagtgtgcgtcaatttgtaaacattataccagttaaacaatacgttggttttgataattatcgtaatacttctgtttataaagtaattttttatattgttagatttaaaataggtgatattgttcatgaatcggatttacaacctgaaaatttcacatttgagtacttttttgagaacgcagaaaaatacgtagatcctaatgatcaaaaaccaaaaataaacatgaaaacttataattatcaatttagtggacttaatagtgagatacttgatttggatttgaaatttgatcagcaatttttcgtagccactacacgtaaccctggtccgatacaagatgtagcgaaccatgcaggtacacatacatcccaagaactcaatattcaaggtgtacaatacaatagtataccagacgcatgggcaaaaacaagtgatttacgtgtaactcgtgatttaggagggatgttaacacaagcccaacaacaattgttaactgaagttgaaactttagcaaaaaatcaaatgcaggttggtaacgcagaagaacaagaccgttataataactatcaagtcaatgttttacctcaatatattgaagattatgtaaccacttatgaagaaaacgatggtggcactgatggtgttggtcaccgttatggtgaagtgttcacaatgccaaccgaagcaactaacaatgaaacaactttatccgcttcgttaaacgataacagcagcacatatgaaatggatagacgtaaaatacgtgacaactattacaatagaccttttttgtgtaaactcgatatgcgtgtagtaggcgacccgtactggttagggtggagtgattactcttacttacaatatctagaacaagtaattaatggtgaagatatggaaattaacccagatgattatcatgtagcaaattatataacatctgaagcgtatctattactaaaattacaaccagtaatatcaataaatgataacactggtgttttggatattaatacaccaaccacatttaaccaaacaatttatcgtgttaataaaattgttcatgattttggtgcaggtggttcttttacacaacaaattcaagctgcaattgtaattcgtgcactcaaacgtcacgatagtatagttgattaaggaataaaatattatggcagatacaagtaaaaagtatgcacaacagcagttgggtcgttttgacccatcttatccgcagttagcaactgttatggataacagagatccaactaaatcaggaaaactgaaagtttggatacaaggttctcaaagtgataaaaactcaaaagaatcatggatagaagcatcttacatgtctccttttgctggtaaaacaccaggtattccaagtgctgatgcatatggtcaatatccaaaaggatacggtttttgggcagtaccaccagacgtagggtgtacagttgttgtaatttttgcacaagcccgtacattccaagcatattggattggttgtgtatatgaccagcgtatgaatactatggttccaggtatggcaactgaagtaagtaattatggtggaactgatatgccacttcctgttactgactatgatcgtaacactatcactaccgatatgcaagacaaatatgctaacgttccaattatcgcaggtcttaaaaagcaaaaccttttatatgacgaagaagctgggttggcgaatcgtagtagtactcgacaaaccaccagtactgtatatggtatgtcttcgccacgtggtaatagttttattattgatgatggatatactgaagaggaattaacagcaccaacgtgggatcaagacccagatggatatcaagatacacaatttaataacccagtaaacgatacacgtgttggttctcgtaaaaatgaaggtgtcgtaataaaaacacgtagtggtgcacaacttcttttatcagaagctactggtgatgttcttttaattaaccgtgatggcactgcacgtataaaattcactggtgaaggtgatattgacatgcactgtgataagaatattaatattcgtgctggtcaagatattaatattactgctggacgttcatataatattgaaaccggacaagatttcaatgcacgagttggtgcaaatactaaattagatctaattggtgctcttgatgcaaaagttggtggacaagttgttgttaattctggggcagaccttcgtttagttacggctgcatcattacgtatgcaaagtggtagcagtactgatattacggctggttcaaatgcttctatttctgccgcaacatctgcaaacctaattggatcatcatcagcaattattagtggtggtggtcaaacattaacagttaatagtggtggtaatagcggtactgctgaatttactgcaccaaactttagaacaccatctgctggtcttaatgaacacattcatgatatcgctgcatgggttaacgctgaaaatcatggtagttatgttgaaccaccaagacaaggtggtggaagtggttctagtgaatcaccagtacaaccacaaccagcaaatgatgtatcaccagaattacccgtagcacaagacactgaagctgttcagtttgttaactatacatcagaaactgaacaagttcaatcacaagatttgatgacatctgatcctgggatgactggatatagtattacatatgaaggtttacatatgttaatgccatgtagcggtactattcgacaatatggttactgggggaaaggtgttccaacacaaagtggaggaaaggcagaccgttcaggttgggaaatacaatgtaaaggtgatgtagttgcaccagatggtggtgtggtagtaattactaatggtgctcttttaatacaacataagtctggatataaatctattttttataatattcaatctgatttattaaacaaagatgttgttcaaaaaggtcaagttgttggaaaagcaaatggtgtcatacagtttgaaattcgtgttacatcagcaaatgttcttggattcagtggttctgttgacccaggattattttatgcttcacaaacaggaacagggtctgatgcggcgaataaaacattaattggtggtcaagcaactaatcaatctgctccaaaagcagttgtacaaccttcagttgatagtgatgaattggtagttacaacaaaaatcaaaacgataggtactggatattctcaacgtggttctcgtcatgtgcctcgtaggagaagaacacagagaagtggagcttcaacaactccggtggagcaacctacctataatattggaaatgttgataaaactgcaatcgattggaaagttgttccaggtgatgcacaatttatttctgaattaaaagaatatgaaggtacattacaataccaacaagcaaaaggatattatcgtaatggtaaattctggcgttatttggatagtcgtgggtatccaactattggttatggtcacttgattattagtggtgaaaacttttcagatggaataactgaacagcaagccaacgatatgttagttcgtgatagtagtaaagctatatatgatgctaaatcaatttatgcttcatataacatgaaaacaccttatttggctcaacaagtactatgccaaatggtattccagatgggtaaaggtggggtacttaaatttaaaactatgttgtctgaattagctaaaggtaattataaacaagctgctgctcaaatacgtaattcagcttggtatcgccaaactactcgccgtgctgagttaatggctcgtcgtttagaggcatgtcaataaatattttagtactataaataaaacgaggatatctttatgagtaaatgggaaattaaaaatacagatgagcaattttttaaggaaattaaagaatttgaaggaactattgcttatcagaaaaaacttggttattttaaaaatgataagttttgggtatataaagacagcttaggtcttgatacaattggctatggtcacctagttttacctggtgaaaatttcaagaatggtttaacagaagcacaagctgaccaacttcttcttaaagatgctcaaactgcgtacaatgatgcaaaatcaatttatgaacaatttggtatgaccgcacctatacaggttcaacgtgtattatggttgatggtattccagatgggcaaaaccaaagttttaaaatttaaaaaagcaatgaccgcattaggtaaggctgattataaaactgctggtaaggaattgcgtgatagtacatggtataaacaaaccacttcaagagcggaaaagatggcacgtattgttgaatccgtataataaaggaaatagtcaatggcagttgtttttaaaggtttttctaccccagtagtgggtagaactgaaacattgtatgatagtgaattggttcgccaagatttaatgaatcatttcaatacaaaaaaaggcgaaagagcatttgatgctgactatggttttattgcatgggatttgctgtttgaattggaaggttataatactatcaaccttttggaagcagatgcccgtagaataattagcttagatccacgcttaaatcttaagaaattgcaaatttcaagaatagaatatggataccaaatgaatattgtattacagtacgtagtattggatacattagaagaacttactattgtattcgatgcaagaagtaataacagaatggcaacatattcagtatcgtctttataattacaaaagcactcttcggagtgcttttctttttgaataaatatttctatatataattcccagtactgaactagtactttactgatttaaaggaataaattatgtcacaacaaaaaaggcaatcaaatttatacgctggtgaggattggactcaagtatatgaaagtttttataaaatcaatcttacagcttatgacttcgatactatccgtcagagtatgattgattatctacgtgcaacttacccagactcattcaacgactggatcgaaaacgaccagtttatttttattttagatacgatttctatgctagggcagaacttggcatttcgtatggatttgaacacacgtgaaaactttttagatactgcaactcgtcgtgcatcagtactaaaactagctaaaatgatttcttactcaccacgccgctcatatccaggtcgtgcagttgctaaattaaccgaaattaaaacaaaccaagatgttcgtaatagttttaatgaatcattaaaagataaaatcattcgttggaatgacccgatggatgctaactggtatgaaaacttcattctagtaatgaacagttcatttgtcagtactaaccaatttggtaatccagtcaagcgtattgatgttaatggtgtctctcgtcaactatatcgaatgaacaccatcccaatgacagcacccagtattccatttattgcaactgtcaatggtgaatctatgacatttgaagtagtgaatcctgatattacgtctgttggtgttgaagaacgacatccagaaccacaagagcaaaaatatattgtttatcaaaatgatggtaatggatttagttcaccaaatactggtttttttgtatatttcgtacaaggtacattgacatatcaagattatcaatatgctatccgtgaagagaaccgtatacaagatattaacgttgataatatcaacgaaactgatgtatgggttcaagaaataaatgaagatggtattgttcgtaccaaatggacaaaagttccatcaatggaaagtattgcatataacactgttaatcgtcaattaaaaacaatttttgctgttactactcgtgataaagatcaaataacaattaagtatccagactcaagaagtggtgttgttccccgtgggacgttccgcgtatggtatcgtgttagtaatggtaaaacatataacattaaaacttctgaaattcaaaacaaaagcgtaaaatatacatatcgtacaaaaacacagtcaagttatgaatctagtacattggatatacgtttttcattacaatatgagtccgaccgtgcacaaagtgcagagactattgagcagattaaagcacgtgcaccacaaatgtactatacacaaaaccgttttgtcaatggtgaagattataatattgcaccacttagtttaggcaatactgtacttaaatctaaagctattaatagaatttatagtggacaatcaagatttattgatattaatgatcctactggtaagtatcaaaataccgatgtttttagtgatgatggtgcattatatcaagaaaacacacaatttaatagatcattattgctaccaactacaaaaacaaatgctagtattgttattgacaatattcaaccattgattggtgaaaatgcggtaatacaacgttaccaagcgtttccatcaaatacaattggtattgaaatacaacaagcatggactccggtatacaattcaaattatacaactaacacatatggtagaattttgggttcatctggtacagtttatggttcatatcaggttggtactctaattaaattttctaattctggaactactatatgggctagtgtagttagtgtattggataatggattttatgtactgagtacatcggttccaagtggaatgcaagccatagagtacattttaccatatagaactagatttaactcggttgaagttcaagcaatttctgctatgctagataaaaaaactgattttgttattgtacatgacaaagaaacgacatcatgggttcctattgaagtaagtaccaatgatgatactattgtatataatggtaatgaagttttaattataattaatgtaaaatatacagcagaaacttgggaatttgatgctaacggtattgaatatatttttgtgggtggagaaaaagtaagattttactttgtatcatctaaaaaaattactgatattagtactggtacagttcaaagtgataagattgaaattttatcatctaacactactagtagtagtaattcaggattgacaagtaatatagattttcaaatttatgacacaattcaacaagagaatggctatctagatggttctcgtgttattgttacatctaggaaagtagatagtaatggtataccattggaaccaaaccaatttaaagaaattgttcctacttggactggaaccgatgcattaaaatatggtggtattttggtatttcaggaaaatagtgatttcactatatcagtactgtcgttaccaaatgataccttcacacttcttgattcatcgtggtcttatacaatggaacaagccttggcagagccgaatgcatataaaagaactgaatttgttagaaataacgcaattcgttcaaccacattgagtggattatatagtaaaggttctggatttttagttggttttaactatgatggtaaatattattttattgaacaaacagttggtaacaacaatgatcgtttaggacagctaattagtaatttaacttattccgatgatactggcactgttagtcctgaattggctttttatcgtgcaattaataacatgggaactaatgctgacgagaatcagaagctagattattatggatacaaagatgttacttcacagtacactgttaaaactaatgcacgtactagtatagacttccattggaaacactatgcacctgacgacaatcgcattgatcctagtagaacaaacttaattgatatgtatgtattaaccaattcatataaaactgaagttgacgtttggttgaaaaataatgctgttggtagtattcctaaaccacctacatcggttgaattgaaagatatgttcaaagatgttgaacaaaaaatagtcattagtgatagtattatttggcatagtgctgagtacttacctttatttggcaacagtgctgctgaagattacaaagctgattttaaagtagtgaaattaccaaacagcacaatgagtgacgatgaaattcgtcaaaatgttatagcattaactaatgaatacttcaatgttgacaactgggatttcggtgaaagtttctattatactgatttgtgtacttacatacactcacagttaggtagacatattagtaccattgttatagttgcacaaaatccaaattcaaaatttggctctctatttgaaatcccttcacgttcagaccaaatatttttgagtactgcatctgttgaaaatgttcaaattgttaactcactagctaaaagtaatattaatatcggttcttaatataacgggcgttcttcggaacgccttttttatatcataaataaatcaaatgaatgaacgaattatatggagtccaaaaatgactaataattttaagtttcaacctacacagatggctgaagcagtacagaagaagctttttattaaaagattgcctgagtggatgcaaggcttagaagatattcaaaaagtcagtgatgatgttattcaacaatggtttaatccggctgaaaacgaattagttgacggctatattggtgatatgggttctcctgccgctgctggtaatatcttcttacatgaaagtactgtagcacgtcaactttatcagttgtccactgcttacgtctcaaaaaatgatgattcgacaattcgttcaattcaattttatgatgatctagttggatacatgaatcattatggagcactaaccgataatgaaagccgtttgttcaacggtaagttttatgcatggactccagctattaacccaaataaaatgaacaattttagctcatatctttgggatactaaaaactcttataatattacttcacctgattacattgtaatggaacgtggagcacttaatggtaatacatggtcactacaaaacttttggtatactttaggtgaaacattagaagatggctcaatattaactgaagaattaatgcaagattcacgttttattcgtgcacgtgcaccaattattgaatataataaaaatattgagctaattaactacggtacaaaattccgtggaactgttgatctgttctctgatattattaaacctgaagatatcgttcaaaaagatattaatagtggtatacgtattgatggtattattccgcaagatggaatgcgtattctattcaccagtattggtaacaatggtgaaaacaatagaatttataatgtatatgtgaaaaaaatgcaagatggtactcgtgtttatggtttagcactagatccagaagaagaaaccgaatcacgcccaagtggtgaacctcaagatggtgatgttgttctaatcactaaaggtaatgagtatggtaatagttctatgtactggaatggatctttgtgggttcgtgcacaatcaaaaactagtgttaacgtattccctaaattccaactttatgatcgtaatggtatcaaacttgacaacagtactacatatccatcaagtaactttaaaggttcagagttgtttggttttaaaataaattacaactatgcaactgatagtgtatatggatataacattgaacttggtgattataattattacatttatgaaaactttttacaatcccaacgttatacctatgaccatcttggaaaagaagttgaaattgatggtttatactattataacattattgatgaaaataatgaaatgaatcttcaaaccgattgggttcgttcagaagagtactctaaacaatttgtaaaacaaactccacaagtccaacgtactgatatgtatcgtgtattcagtactgtttatgatatggaagtttttaaagaaccagttgatggtatgtatgcatatgttattgaagttgatagaacatatcagtactataaagctgaccgtgaaacttatctagattggcatccaattactggtgatggtgttcagattgtaaaatatgaccatacattcgaattggcacaaaaagttttagataatgattctgatattattgaagttgtggttgatggtgttgatgtgtccaaatataccaaaaatgtttcaaaaggtcaagtacaaagcatcactctagatagtactgtagaaatggatgaagattctgttattcaaattagaacttatagcagtactgtaactcctaataaagaattaggtgcatatgaagttccaatcaacctacaaaataacccatataattctaatattatatacattaaccaaggtgactacactttacattttcaggatattattcaaaagaacattacacgtggttcttctgatgatttcaatgactatgaagaacgtttggctaaaggattggttaataatggcgtaggtactaaaattatccaaaatgaagcatctatgcttccattgatggcacatactgcaaatgaagatattgatttgtttgaagcaactatgtttatgcaatctgaatattttagattcattaataaatttaatacacaaatgcttcgtatgtatgatgaaaatccatcagactttttacaaaatagtgctgcaaacattgttgatgcaattttaactactattaatatgggacgtgatagttcattcccattctattatgataatgttggaagtacttctggattcattcgtgcatttataccaccaacaccacagttcttaggtattcttcaagcatatgtaccagaaaaagcgacattcctcactgctggtagtaaaccaagctgttataacatcagtcatactggtattatttccaaagcataccgtgttatcaatggtgttgataaaatggatgatgttgtatatgaattagaaaatagaatttttaatagtattgataataaattcaaagatgttgattacgtaccagtattgaatagtgatgaccttttccctacaccatatttcactaaaactgaatatagtgctgaagagaaacaaacattattactacgtggatacattaacttcaccgcaactaatggtatcagtaatagtacacatgattatgatcctaacaattggagaacttggaactatactggcacttattatgtagttaatggtcaaagtactgaaattcctgcacgtggttcatggcgtgccatttacactgaccaatatggtacatatcgcccagctacccatccgtgggaaatgtttggctttacacaacgtccaacttggtggaaccaagaatacgaaccaacggctgttcaagttggtgaacgtgatagtgatgttgtatatgtatatgaagcacttgttatgaatgagcaaggtgatttagttcctagtggtctttgggatattgacggaactattggagatagcagtactggaactattttatttggtgatcgtcgtggtcaatatgacaaatataaaagatttggtgtacagccattcaaaattacaaaaactggaaataaaacatcttctggtattgatatttgtgtggttgaatatattgcacctgaaattttaggtttagtgtctggatctttaaatcatagagcagaaccttggacatatggtgatatgggtgacatggaatttacatacatgaacactacattgtttgcatatgaccaaatgatgcttttgtataaagctaaaccagcacaatttgctaactatttctgggatacccgcaacgataacttaaaagaagtattcactgatggttcacaattcctttatggtgatacacgtaagcgtattaattttgataaaaatacagtagttcatggtgaaaatagcacaagaacaattggttatcaaatgtttgtaagtgaccatttgatgtatcaaaataaaaatattaccaccaagtatggggatgtagttcgttcttcttatataaatgttggtcataaaattggaggatttactaaagcagatcagctaacattcaatgctaaatctttcggtcttatttcacaagaaaaccaaaccattggtcttgttcgttctaataatatccgtgatgagcaaatgagtgcgatcaaaattacttggaatggtagtgcatatcagattgatggatatgatctagttggtgctaaatttaaatataaacttccagtaaaaaatggtagaaaagtaactcttaaattggaaaaccgtaatgttgttcattataatgaatggaagtctgaagcttcaattgaatatggtaaagttttcaatagttaccaagaagtttatacttttatttgtggatatggtgaatatcttaaagaacatggttggatttttgaagatgtaaatgatagtggtgctcaacaagattggaacactattgctaaagatttcgtgatctggagtcagaattctctagtaactggtgaatttatttcttgtaccccaagtgctgcaaacgctaaatttggggcggactttggttcagtacaatctattacgcaaaataatggtggtgtatggtcattacttgatgataataaccaaggtattcgccaatatgaaattgaaacttctcgtattggaaatatcttcactgttagaactttagaatctaataaacgcattgcattgattcgtttaagtttgtgttcatatgaacatgctgttatttttgatgataaaactatttttggtgattacatttatcagccaacatatggttctattcaagaactaattaaaatgtatggatatattactggttcatggactggtcgcctacaagctcctggatttattatcttggaagctggaacactaccatcatttgaaaaattagtgtcggatttccaacattattatgatagtgaaactccagtaagtgatgtacaattacaagagttgtcaaaccatttgattggttatcaatctcgtgattatctacagcgtatgattagtagtgatgttagtcgtgttgatttctataaaggattcattcacgataaaggtactaaccaagttttagaacgtgtacttcgtgtttctaaatcatatgacactgatgaatataaagcattacaagaatgggcatttaaaattggtacatatggtaatattgatggtaagaaaaaccttcaatttaaactaatcaatgaccaatttaaacaacaacctcaaatggtttcttttgatgtaaatgcaacttcaaatggtaatggtaatcatattgtatacttcggtgagcaaggtaaagatcctcgttggattacacgtccaaatggtaagttctcattcccaatgcgtagtggaagaagtgaaaacatccaacttccagatattggtccagtaacattggatgaagtatcgtacacaacaaaagatttcagtactgcatataatgaccgcataacttatactaatggtaaaggtgaaaatcctgaatctgtgtggatgtttaaagacggtaatggtttgtggaacatttttgaattggttgatactaatgtacaaatggtttctataacacctattgaaaataccgatgtgtatgctgaacaattttgtaaagtaactttaactgataatgtaccacttgaagatggtgattattattattttgttgatgaaactaactttatgccagatactttaacagtagaaagtcaatattatactgctggttctgatcctaaagttatggtagttccatttgacacttctattgatattgaatttactgatccagatacacgtccacgtttgtatcgttatgtatcacgttttgccagtactgatgaacgtcaagcttacattgacaagaaatatagttttaaagcaccacaaagtactttatttgatcgtccaacgacatatgatgaacgtactaacattactgagctatatctaaacgtttatgacccaattaatggtgttattccaggtgcggctatgcaaaacgtaacatatacttcaccagttgatcctgcacagtataatagtaatggagagttaatccaggcttggggtgctgataaagttggtcaagtatggtggaacactagcactgcattttatttggattatactcgtgcaatttatgacgcagacggtaatgttgatattgatgcaaccaatgaatacaaacgttacaactggggccgtttgttaccacatagtaccattgatgtgttagagtgggtttgttcaccagttgagccatataactgggacaaatactgtaaagatgttgctaagaaaaacaaaaataatactatgtatctaccaagtggaactgcacttgaagataattatagtacatttttggaatatgatagttcaactgatagttatgtaacaaaatactatttctgggtacgtgatacaatttatgtaccaccactacataccagaacgaaatcatgtactgacattgctcgtattattaaagatccaacacagctaaacattccttggttcgctccaataaatgaaaactcgtttattcttagtaatatgcaatttaaagtgaatgatgataccagtattttaactgtttcttattacatggatagtactgaagttgttaaacatgaccagtatcaactatgtaaagaaggtgacagctataactttaacccactaatttgggattcaatgtggaactcactaattggtcaagaaacaactgaatcaggttctgtgattaatttattatatccagatgttgataacggtttaggatcaaacaaaacttggttccaaaatgttatagaagctcgtagaaactttgtagaaagtgctaataattattataggtcacaaaacataaccactaatagtgttgttatggaagatgtgtttaatgttaaaaccactgaagttaaccctaatgaagtttctttccgtgtgttgtcttacaataatgaattagttattgcagttgaaagtgataaatttaaagaaaatgacgctgttattttaagtactagtggatatctaccaaatccattaacttctagtgctgtttattttattcacttcgacgaaaatggatatattcagttaatgaatagtccagcaaacgcgggtagtgttgttactataacgttagaaaacaaaggtgagggacaacataaaatgattaaacaatctgattatgttgaatcactaggaacctcattagacatgactcagtactggtcatatgctgattggtatgatgttggatatgatagtaacacgacttatactcaagagtcaagcttagaagatgctaatactaaaaactaccaagttggcgatattatcagagttaccgatagtgaaaacatttggacattgtatattaaatcacaatcacgcgattcaatttattggaaagcgattggtcgtgaaaacagtacagttgaactcaatgatatgctttacgcagattatagtgttcataatgataatggttcactaagcaatcgtgaaatcaacgttcgtaaagcactagctttactcaaaaattctttcgatttacatcaaagcgaaattgtttttgatatggtcaaatatgtacatgttgaacaaagtgttgtggattgggtatttaaaacatcatatatctatattgttggtttggaacaatcattagttcaaaactattcaaacgataatttgattaatcaaattgttgaatattttgaagaagttaaaccttatagaactaaaattcgttcacaaatagagcaaaagacatctgatgatgatttaataaaaggtctatgtaatgatttagatcctaatggatatattttcgttgacggttcttggatcaaaactgaaaaagatatttgggattatgagtacgctcaatttaatgaaattacccaaaaatgggaacaggtaggttcactaccaagtgatttcgttacaccaaatagaagattccaagaaattgatattattatgcattatgataatattcagtgtaaaccaaatgaagatttggcaagcataaatgaattagtaagtgttaataacaaatatcaatccaatgaaaaggatgctgttagtaactatgaattacaacgttatatatattctttcccagaatatagtgaagaaactttcgatcttcttattgcttatcaaatgcaaatctactatccagaattggatgtaacactaggaacagcatatggcgttaaccagtggtataaagaccatgcggaagatttagaagcaactgatgaattcactgctacattggaacgtgtttataaagaatcaacgcataacgatatgtttactgaccttagacaatatgttcagtataacacattggcaaaccgtttgaaactttataaagatataagtgatgagaaaattcacgatgaagttggatgtggatttagtggacttacttataatgacaatcctagtactagacttccattaggcttttcttctagtaatgattataactatggatattttgaaataagcagtgaattgtatcaaaaatacatttcattaattaaagataaaaatcctgacgcatcagactatgaagtaaaagttaaacttgaagttgagtatggtgtatatgtttatcgttatgatgaagtaggtggtgatacccgtttctatactgatgctattcacgtattagcaggtatgagagggttattcgacaaagacgctactgataagtacgaaaaagctgaagagattcttagtaagaccccaattgatatctatgcaattacaatgattccacgaaaatatgtttacttaaatgttaacggtgtatatcaaagtatacctgatgaacaaagtattgatgatttcatggaagattattttatcacaaatggtgaaatggttgaactagctgaaataaatcttgatgatttaccactagatcaaaataatccaatgtattctgattatcaatatatacttgatagtattactgaagctaagtacttcaatgatatgaatgcatttgataacctagcattggaatctcaaacttcttcaataaaatgggaagttaaagatgatgaagttgatccttatattgtggatatatctgacataaacccttctgggcgtgatgttggacaaattagatttacagttgatggatatgggtttgacaatgtatctcttgtacaattacgtgataacagcagatatcaaactgaaggtatggcaattatcaatccatataaacatacagaagcaattgtaagtattccttcatatgctaagattgaaaatgatattaataaaacaacatcgaagtttgatgaaaaatatttctatcgtgtgagatctattaatagcttaactgaagcagaaatagttgacaatgacctatctgatggtgataaggtgatgattttcactcctgatggtgaagattttgtgagatatcaaaatcacacatgggaaacaatcttgcgtgtatctaacatcaaaaacaatacaactccgatcctattcactgtaagaaatacaggtaaggaaacgattgaattgattgatgagagtactggtgcagttctccgttatgataacatcactcttgcacaacaaaatgagccagtacagcctctagcattgaacattgttcgtgttagaacatttgctgaccctgaatttgtcaagaatggtattaaattgtatgaacaaaatagaaattacaccattgatgtaattaattatgatgttttctacgatactactttaaatggtggtaagtacaatgacggaataacaccagatgacgttgacgtttggataatctccaatgaaatatttgatgttgatggaattactatcgataacggttataacttaccaattacgggtgcgggagttcttagtgaattggcaagaactaaaatgactgatagtttagaaatcaacgttatcgaatatgattcaagtgttattcaaccgtttagaaataatgaagggatatgggtttatggattcccaatggttgacggtatgtatatcggtgttgttggtggtactgttactaacatcacaaccattagtgaagaaaatacaacctatgtttctcaacctaaatcaataagtccttatagtattagaaataatgttttatccggttcagccgcgaacatgaatgatattatatcgattggatatgaaaaagttgaagttagaaatgcaaataatttactccgtggtgtaatgtatagtgcagaacatgattttaaacttaataccacatattctttcaatggaattaatttaggtaattatgatatgttaaaacgttacacacaaaatagttacactatagatctttcagtatacactgatagtctacaagttagtggtaatgatattaaaaatatattattagttaagtaataaaaaaggagagcataatgctctccttttctttttttatactagtgctttatctacagctttggtacgtttcggcttaataccgattttaccatcaataacatcaaatgtaatgttaccaccattcacaagtgaaccacacaacatttctttagctagtggtacacgaatgttttgttcaatggtacgtttcattggacgtgcacccataccaacttttaccccatttttcgcaagccattcacgtgcagcttttgtcaatgtaactttaacattacggtctttgacttgttcattcaaaccacccatgaacttatcaatgatgctgtcaatagcttcactgcttaggtctttaaacgtaacgatactatcaatacggttaataaactctggtggcaagaatgctttaattgccttgtcctgtgcagtgtcactaccgctcataccaatgctacgctttgttgaatcagccgcaccaaggtttgtagtcataataacagttacgttattaaaatatacagttttaccttgagaaccagtcagacgaccttcatccaaaacctgtaggaaggttagtagtactttacgatctgctttttcaatttcatcaagtaacagtactgcattagggaactgctcaattttatccaacagtaaaccgttaccagaatcatgaccaacataacctggaggtgaaccaattagtttagaaacagtatgttcttgagaaaattctgacatatcaaagcgaatgagttccgcaccagttgcgtctgctaatgctttggtaatttctgttttaccagtaccagatggtccaacaaacataaatgcaccctgaacactagatttgtcacgcagtcctgcacgagctaccatcacgttatcaactaatttttgaatagcttcctcttgaccgtatacacgtgagcgtagtgcatctggtagattacgcatacgatcactttcagtacatgcaaccacgttgatatccaaattggcaataccagcaacaacttcttgaatcaaattggcagtaataagcttactattgttgtcacgtgaacgaactttagccgcagcagcatccattagatcaattgctttatctgggaagtgcttattcttcaggaatttatcactgagagaaattacagcatccattgcatcagatgtgaactcaacattatggaatttttcatacgttggtttcaaaccattaacaattgcacgagtttcatcaattgtcggctcaactacgtcaattttcataaaacgacgagttaatgcactatctttctcgatatttttacgatattcatcatatgttgttgcaccaattacacgaatctcaccacgtgaaagtgctggcttaagcatattgctcatgtccatagaaccattacttgcggaaccagccccaaccataatatgaatttcatcaatgaaaacaatagtattttcacgtttctttagttcttttagcaaattgtcgatgcgttcttcaaattcaccacgatacttagtaccagcagtcaatgcaccaacatttagtgaaagaatttcaacgtctttcaggtgttcaggtacgttaccatcagcaatagcttgtgcaagcccgtcgatgatttgtgttttacctacaccagcttcaccagtgagaatagcattctttttggttttgcgagcaagagtctcaatcaatgcagacaattctttctggcgaccaatcataggatctagtttgccttcttttgcaagagcagttagattcgttgtatagtcttccaaacctttttgtttagatgattgctgctgttgggccacttttttatctccaatcggttcgtcattaatactttgtaagttgatacccttatcaagtgactcaacgtgtttctgtaatgcacgtgcagcttcagtacagctaacaccttcttcttttaacgcagcttctagtgctgtgttagggaaagacagacattcgaatagaacaaaatatgcatcaatcgaaaaatcatcactttttagttgttcaataactgattttttagaaagctcatgtacaacgcgattcactagaagcgaagttcgattcgcgtcttcatctttaacactttttggtgcatgtggaactgttgtatttttaagatagttcatcaggcggttgtgcagtttgtctgcatcaatgttcatatcttcaaatacgttcttgatgctatcaatagtcagtactgtggcacttacgtggtcaatagtcaagaatgtatgacctagagatgttgccagttcgtcgctttttttgaacaattgagtaagattcatgtattctcctatgtgattcacgtcactctaattaataaacattatatcacattcttacggtttgtctacaaggtaaataaagatatacccgatttattttggagacaatcatgacatatagaatgtggaaaaaaggtagaaccaatgattacaagttcattgattctgccattgctgaacaatacaacattggtggagttgacatgtggctttatgcatatgtcggtccaaaacaagttgctgacaacactgacttatcctatggaggtgattatacatcttcaggatcagttgtgtcaagtattggcgatttaatttttggtgacacaccaaacagaaactacaaccttgaagctatcacacttagttgtgtctatcaagttcaagaagcaactccagacttgaaaatcccaggattgttctttaatttcaacactatggacatcacaatccattataatacaatgatgcagcgtttaggtagaaaaatcatgccaggggatgtgatagaactaccaaatttacgtgattttgatgtattgggtaaagatacaggtctaaaccgcttctatgtcgtccaagatgcatttcgtacatctgagggatactcggttacgtggcaacatcacatttataaacttagagttaaaccgctaaccgactcacctgagtactccgatttactcggtaacaataattatcctgataatccagatgaccctaataatggtaatggaaataccgatgatggttcgtcggaaaacagtaactatggcaatgaaatggatatcatgaaccgtatcatcatgcaagctgatgatgaagtaccctatattcattatacaaatgaacatttgtatgatgatcgacctgatacagtagatttatcaaaatatatgcttaacggttatgattttccagaagaacctgccgatggaatgtattttttgaaaaaaacatacccagtactcaaagagtttgttaatgatacatggatttctgtggaagtcaagcgtggaaccatctttcccagaaaaccaatggatggtgacttcttctttaaagaaaatgacgcagatgtgacaggttatacgttgtatcaatatgataaaagtgctaaaaaatggttaaattgtgatgtagaatatactaccagtgatgttccaccagaagatgtggaagatttttgtattttttataaagaaccacacatttatcagtataatgatgacaagtggggggaaccaaaggtaacttatgtcaatgaaccattcacgtccaattgtgtatatggtaatattgattcgcaacaagattatcgtcctaaaattccaccagcacgaggtacagtccctgaaggaaatatgttcccaactgatgcagtagatggtgactatttctatcgcaccgattatactccagttacgttatgggaattcaatgcaactaagaattcatgggttatttttgattatggtggaagaaaaccgtgggaaggtgcagacttagcacttacacagtttgtaaatagtgataacaaagttccattacatgacgcagttaaacctaatactgtttatcgcatacataaggacacagaatgaaaatagattattattatgacggtcaatttcgcagagtactgaaacatcttatcagagtttttggtgaatttcaagtacaaaatggtattgatgctaatggaaacccaaaatacaaaaaggttccatgtcgctatgccgatatttcaagaatggcagcagcaattataaatgggaatagtgaaaatgttctcccatcagcacctataatgaccataagtgttaatcaactaaagttggatcgtaaaaatattcgttctaatgccaacgaaactatagtaatggggtctaacaagtcccctgctattaatgagtacacaaaagatcttgacacacaatacaaaattgtaagacataacccagtaccttggacttttacgtttgatttgaatatttgggtaactcaaactcaaactaaaatggaattattcgaacaaatctcaactttgtttgcacctagtatacaacttcaattatctgataacccgttagattggacatcgcttagtgatgttgaactaatagattgtcagttttctactcgtggttttccacaaggaactgacccagatttggatataatggttttaacatttgaaacgacaatatggttttctttaccagctattgttgaaaaacccaaattaatccaacagattactacaaatattaaaggtgctcgtgacgaatttgattttgaaatgggaaattattcagatataataacagatgtttttacacccaagaatttatgcattaaagttgaagaaattactaattccaagtataatttacctgatacataccaacttaccttggttagccaatcgctatcggcggtttcccccaacggtggaatatattcatgggaaaaatatcttaaatatctagaaccaaattttgatgacaaaaaagtagggattaaatttcaacaatctattgaagaagacaacccactaaaaggtcatatagcgtcgtatggtgaaaatgaagatgccaacaaaattatagtacagcttgataataccaattatactgttgattacactatacatgggtttgtgcagaaagattcagtactttcaagtgcattacctgaacaatattatgtaaataacagtatacataacatcatttataaagaaaccgaaatcccatcaaattatttgtttaaaattacaaatgacggtgcacaattaattgatccatctactgtacgaaattacatttataataaagaagacaatggttattatagatataatgacaaatttaaatggcataaaagtatcatgcctgtgtatcgtcagggatattggaaaataactttcactgacaaataaaggaggtgttgttatgaatgaagcggttggtgctatatttttatcaaaaagtactggacatatgatgttaaacttgcgttctgaaagaagtacctattctaacaactgggcatttgttggtggaaagcttgaacataacgaaacaccactacaaggtctgatgcgagaaattaaagaagagttgggcaactcaatacctaacattattgatattataccgtttgatgtattttgtacaaaaaatggtaaatttaaatattattcatttgttattgtagttgagaatgaatttgtaccaactttaaatcatgaaagctctggttatgcttgggttagaattggttcttggcctaaaccattacaccctggtgctaaaaatactttacttaacacaaacttaatgaaagatttttactcactatgggaaagtatacgtgaaggtacacagtttgtcaacagtttaccatatagatattaaaacaaaaaggagccgtgtggctcctttttttatactccaataatcggaatacctgtaatatttaacaacactgatgcttgtagtttaacggattcaccagcagttagattactaatgctaccatcaactcgaaaacctaaatttttatttgagtttagagaattgataacccaattttcataatcagctttagatgttccattaggatttgggatagatggatctacaccattaataacaatatttacgtcccagtttgggcgactactggtaataacatctttaatggattctaattgtgtaatcctacgtgggtctggcatttgacttgcccccaccgaaccaggaacaaaagttccttgattatctacataaaattgcccttttataaaaaaggttttggaattgtatggaagagaaactatctcaccagaagaatcatttacttctctaatcataatttttaattcatagaaatagttgctaccaaattcaaagacacctgtaccattagttaatgttgtccagttatttgtatctacttgtgaagtaccacctaagttaaaatacgcaatcggtttagtactattactttgtgtgaactctatatattttttaccattatcatagttaatatctaataatgatgaatactctttgttttctggtctagatgtttgaatttcacgccattctttgtttttcattaacacacgaagagaatcaccgttactagttaataccatacgacccataacactattttcaccatcaggtactgtgttaaaaacagtaatcatagggatagacgcccattcagcttcacttaccatatcagcaggttgtctagcattatcaactaatgatatcaataactcaccagtactaccagtgtttctataccaaagttgaccattgacgttgccacgtggtgcagatgctgaactgaaattttcaactaaatgtaaaaagttttcattccatgcttgaccgtaacttactttatttctaccaactaaatttaacggaactgggttacttccgggctggtttggtcctaaaataacattatttggaatggtagcataaacactaccattacttctataaattgtataattaacactcattatatgtccccattattgtaattgtacacgaactgtgtatttaatttgtaagacacggtttgcacttttctcaactgggtgaaaaatgatatgggttaaaggaataccactatcgccatccgtgtacaatcccaattcatcaaatacataagttccatccatgcttgtccctgagcttacaccttggtcggatggttcacctaaccctagagtacaaatacatacaatatcagtataggactgtcctggtatatgtacagttgtaatattattgtattgtgaatcaatacctgccgtaattcgtgggttgatttttttcaaatatgtttgtgaatacaaaccaccgaatgatgtaacacgtggttttttataagtaacacgaccagtacttaaaactactgtaccaccattaccaaaacgcatctcgctaatagaaccaataggaataccagtactgtcttgattatatgctaacgcattagcaatggcagtactcatattttcagggtgaatagcgttagatttatctaaaacgattttttgatttgatggatcagtaacgtcagtaattaggacatgacctttaacaaatagttttggttgttctgtttctaatttcatttctaatccttagtagttaattaaaatttgttctaacttcccagctaaacttttttggacatctgatggatacttactaatataatcacggtctataccaactttaaggtaagtaaaattaccagttactgtttcagcaaatgttccggtagttccttgttgtctaattaaatccccaccatttggatttaaaataaccatatcagtaaattcaagataataattacaactttcagtgaatttaattggaaaccaatcatcatcagtaggattactagctaatgtagctaatacataaattctaccaataaaattacgtagtgtaaatgaaatagtatgtaaacctgtagtacagccatagtagccaccacttgcgagtggtaacgtttgttcattccagtgataatccaagttagctggataccagctatcagattcaggaaaatcttgccatgaaccatcttttgtttttcttctgaagagaaagtcttttgatcttaatgccattgtttaagcccttttagtagtgaactttcatttatttattaatgataacgaaatgtattttgtactgataaatattggtatatgacattaactcatacaagggaaatattatgacaatttcatttaatggttcatgtaataactccggcatcaaaagtctagttattaatggtgctgggcatttaattgtaacctatgcagataacacaattcaagatttaggtcttgttgtaggacagaatggcgagaatggtaaaaacttttatcctaatgagattggttttgaaattccttccgaacaatttaaagttggtgaaccacttgggtggtgctacttaagcttggctaacaataccagtactctatactttaaatcaaatgatgcacaagatccgacaagtacatggattagtgttgagtttggtaaaggtgatacgggtgaagcgggtaagccgttccacattgatagtgctggaactactttcccaacaactggtctttttaataactatacattttataatactcaagatggtaaactttatttctatcaaagtgtaactgctacttggagtgatggtatacctttccgtggtgaacaaggtccgcgtggtcgtttccatattgatagcagtggtgatcaatttccaagtattgaaaatcttccagttgattattgtttttataacaacactgatggaaaactatattatgttgatgaagtaactacaactacccctccttcaaaagagtggagtgatggtattctattccgtggtaaagaaggtcagcaaggtattcaaggtatacaaggcgaaccaggtgcaccaggtaaagatacaatttctattagaaataccatagatagctcatggactaacgcactattagttattggtacatgtcctgctggatatgtagtttctaatattgatgtaaacgttatacaaccttattctcttccagtaactgatatgtttgtacgttttggtggtgaagcacaagaagatattggcgggacggtaattgcaccaacttcctactttgatatcaatcgtcagatgcgttttattgttaatgaaactaatcatgcagcatccgatgatgatgaaattatttcatgtgtattcaacgattctgttaacaacagtccttatggaaaaatggaaattatttgtactctttcatggcaagctcctatccaaccgattcaagataatatttaagggaggatgtcataatggcagtattttctaattttgaaggaactatgcagcccaaattcatattggggaaaaaaggtgcttcaataaattttatcaatgattcagtttctataaaagattatctaggagaacagttcctaccactgaaggtaggaacttcatctgaccctaattcagcagttaacgtaaaatatcttgaagataaccctaatgcattatttggtgttgtaccccctaccgatgatgtaggaaagaacaataatacgtattttcaaattgatgaagatggtattgttgatatttttgcaaaaagtaatggtacatgggtaaaatcattatacattaataaaaaagttctatccagtaaaaatggtggcgatttcatcggacttattactggaggtacagttcaacaggcccagttttatataacaccagaagaatttggtgctaaaggtgatggcgaaactgatgacactgctgctgtaaatttatgtgctgcttatgctaaagaaaataaaatccaaattcaggctggtggtaattaccgtatcaaaactgcaatatacctagaagatgtaacttggtttgggggaactattactggtaacggtggtactatggtatctgttattaattcccaaatacaatttgcaacacttactggatgttatttaaaattcttcggtggcgatggtaagttttattttaataaatttataaacatcacaagtactgctgcatttttaatgcaaggtatgacacaaccaggaacaatagatttttgctttaatgaaatgacccaatgtaagtatggtgttcttcaacaaggtactggtgagaaaatgaaggttggtagatattcatataaccatattcatgatatctatggtgatgcaattgaactaaacgtaattaactcacattatcctgatggttttgtgattgaaggaaacgtaattgaaaacgttgatggttctaacgctccaatcccactttcaaactggggcattggtattggcgttgctggttctggtccttatggtttagatgcaccagatacacaatatgtcagaaactttgttattaaaaataacagactatataatgttagacaatgtatacacgttgaattaggaatggactttaaaatacttaataatgaagtttatccatcatctttagtttctgttggtactggattaaccactgctggtgttataacttatggttcgaaagaattcattattgatgggttgactggtcatttgcttaatgatccttctatcacaaatagaatggtttcaataaactggggtgtaacttctggtcgttttgctggaccacctagaaactttaaaatttctaatctctatattccagagtcttctatacttgtttatacttccggttctgataattggttaaataatacagaattgagcaatatcacttgttctaaaatcctttggcgtggtttgccatcatcatctaaatttagtgatattagaactaaagaattagatgtaattggtcaacacctctctaccgaaggcgaaggtggtggtatctatactcgctctaaatatacttatactaattggactaactgtgttgttcaagatgattgtaatgtttcaaaatatagtttttctaaaatgtatgtagacagaatagaccaatcatctaataactttaaagttacaactgcaatcgatggtacaggtcaccgtggcccagtactgatacctgtagttgagcaatattatattccatacgatacttttcctgggggacgctatttctctgaaggcacgattattcataaacaatcgggtggaaaatatattgtaactgttggtggttcttttttcggaaaatatgacacaattagacaaacggtagcaggacaaacatacatagaagcattgggtgtgtcatggggtgaaaaccaatatgcaaaagctgctggtactgagatcattatatccggtgctggtgaaaatggtggtgatttgagaacgtatataactcgtgcagtgtatgttgtaaacaacgtatatagaattgatattgcagatcctatcataacagcaactgccgctggtgcagcattaaaagctgcccaacccgtaacttacataaccctaccataaaggagattatattaaaatggcagttttttctaatttagaaggaaccatgaagaagtccttcattcttgggaagaatggtgcacagattaccacaaatggtagtgttgtgcaaattcaaaactactcaggaacacaacttcttccaatttcagcaggtgaaccaactgcaaacacacacttggttacattgggatatttaaacgcacacagtggtggtggtagttctggtatcttacgtggaacaacagcaccatccgattcgatcggtctagatggtgacgtttactttttggttgatagtactaatgttcttcaaatttatattaaagatcttggcatttggaaaccatttaaaggtagctcacctgggactgatagctcatatgtaactactgaaatagttcctgtttctgcatttacattagtaccagatactactgatcattatacttacacactaccagaatcagttcatggtagaggttctgatattatgatccaactacaaggtgacccaggtaatgttgcattggaatcagtattccaaaccacagtaacagttagtggtattggggatataacaattgatgtgattggtcaaatcacagattatgcaagtgttaaagtaaacattataggagcaacaacaatgacagtaccttatagtaaattggtaaaccaagcagattgggtttctagtgctggtgattttacaatcactattcctgcatctgaacacaatcaaacaccagataatttgtatatttcaatttatgcaaataaaacacctgggagtgttgcgtcatctccatttgaattggtagtgactgatacacaaattagtagtactggtgatgtaatcttcacttctgatatttctttcagtggtaagattgtcatctctggtaagtaaaaaaaattaaccagacttgtcctaaataagtctggttttttattatatttgcttttgtcaaataacatattaattgttggataacagcataataaaactaaatatatacatattaacaaggttataatggagggtataaatgtactcaataaaaactgacttagatattactggtgctggtacggttggtaaggatcttttagtcaaaggaaatgctgttttcaacaataacctaactgtaaatggtactgtaacttttgcaaatgcaacttttactgccattgaatcatcaactgccaatattacatctactttagatgtaggtggcaaagcaacactttctggtggtcttggtgttgagggtaatactacaatcggtagtgcagtggtcgggtctgatacagcaacaattaattcaaacgctacctttaacggtactgtatcagttggttctgattttacacaaactgctggtacaaccactctacaagcaactaaagttaaaaacttagaagttgctgaaacaacagcatttaaaggtaatattactgctgatgttgggactactgctgcatttgataaaattactgctaataccgcagaaattactaatgtaagtacaacagatattagtagtactggtactgctacatttaaagatgtgacaattagtggtacacttggtggtgagtttaatctatctgacttaaatgcagtaacattgaacgttactggtgcatctaaccaacaaggtgcagtaactttcggtgctaacgtaactggtattaacagtactgctacttttaaagacattcgtattggttctaactctgaatcacaaaccttcagattaagcttcccttacactgctcctggtaaacgcccaactgttattctacaaaacgaaattcagtccgagttaatgtcacctgcaaacttaacagttttgacatctgcttcttttggtaatgcgtcattatcttcttatggtattactggtaatggtctaaacaaattagattatctaacagtttctggtaacaatacacaatcaccagacaccccactattagaagttcaaaaaggaaaaaccaaagttgccgattttgaagttacaggaaccgcaactataccaaatattgaaagtactggaactgctaattttaataatattaatatttctggtgttcttggtggaacattccaactagatgatattaatgcagtaacattgaacgttactggggccacttcgttagttggtggtgttactcttggttctaatattactggttataatagtactgctacctttaaagctattagcttaggtcaaaatagtcaagatgcagcagtgaaactaggttttggatatactgcacccggtcaacgcccaacagttattctacctaatgaagttcaatcagaagtagtttctccttctacattgaacgttcttaaaactgcaacttttggtaatgcgtcattatcgtcttatggcattactggtaatggcctaaacaaattagattatctaacagtttctggtaacgaaacacaagctccagatacaccactattagaagttcaaaaaggaaaaaccaaagttgctgactttgaagtcaccggaactgcaactataccaaatattgaaagtactggaactgctaattttaataatattaatatttctggtgttcttggtggaacattccaattagacgatattaatgcagcatctttgaacgttactggtgcaacttcattagttggtggtgttactcttggttctaatattactggttataatagtactgcatcatttaaagctatcagcttaggccaaagtagtcaagattctgctgtaaaacttggatttggatatactgcaccaagtcaacgtccaaccgtgattttacctaacgaagttcaatcagaattagtttctccttcaacactgaacgttctaaaaacggcaacttttggtaatgctgcactttctacgtatggtattactggtaatggcctaaacaaattagattacctaaccattacaggtaacgcaacacaagaccctagtacaccattcctacaagttggtggtaaagcaattcttaatgatgtcgattttactggcaccgtaactgggttaactgttgatgtaagtggtcaggatctaacaccaaactcagttgttgctgcgacaaatattaaaggtgcaacccttgaaagtactggtaacactaccgtgggtgctaaactaactgttactggtgatattgctggtacaactgcaactctttctggtgcattatccgctggttcagtaagttctggttctattactggtacaacttctgtatctgcaccaacaattagtgcatctactgaagtaacggctcctactatcactgcgagtggaactgtaagtggacaaacaattaacggtactaatattagtgcaacaactctgactgcaccaactattagtggtaatactaacttcacagaaaatgttgatattactggaaatctaacagttactggtacagtaaccccaggtacaattgatttgagtactactgatgttagtgcgaaatcaatcactactaccgctggtgcaaatattggtggagatcttgtggttcaaggttcttttgatttatcagcagcagacattaacgttaaatcactaacttcttctggtattgttaaaagtaatgaccttgttaatgctaacgtacttcctgtacttaatagtactaccataacggcaactactgttaatgctgatgatataactgttaccggatctgctaatttgggtacaatttactcaagctcatctgttctagttgggtcaactttaactgtaactggtgaaactacaactgcatcgttggttaccccaaccatttcaaatgcaagtggtgtcactatttccaataatacaaatgtaactggtgacctaaccgttactggtgcagttattccaggctctatcgatctagcaacaactgatgttaatgctaaatccattactactactgctggtgcaactattggtggtaacctaactgttaatggtacagtagatcttactactgctgatgttactgtcaaatctttaactagtactggtgcaattgttagtaatgaatctacaattagtagtgttctacctaaacttcaaagtactgatgcaactattgcaacccttggttcaacaactgcaaatattactaatttgaatgttactggtgcatctaccgtagctgacgtaacttcttcaggtaaagttaaagcagtttctgtagaaaccccaacaattagtaacgttgatggtgtatctatttccaataatacatctattactggtgacctaacagtttctggtacagtaacaccaggtgcaattgatttgagcacaactgatgtaagtgcaaaatccattactactaccgctggagcaaatattggtggagatcttgttgtttctggtacagttgatttaagtggttctgatgtatctgttaaatctctaacaagtactggtattattacagttagtagtgcagaaggtatcaacgttctacctaaagttcaaagtactgaagttacagtgtctgctctaaatgcaacaaatgcagtagtttctggtgatgtttcagcagcaacagcttcaatctcaggtgcaattactggtgggtcagcaacactatctggtgttggaactgctctaaatgtaactaataacgcaactgttggtggtgtacttactgttggttctattacttcagcggcagaaaatgtatccattactaaaaataccgcgattactggtaatttagcagtatctggaacactaactgcgggtgttattgatcttagcacaactgatgtgtctgtgaagacattaacttctctaggtgatgcaaccgttcaaggtaacttaactgttgatggttctattgacctaagttctgcaaacatcgtcggtgtaacactagaaagtactggctctaccactgtaggtactgatttgattctaactacaggtaacattacaggtagtccatctatttctggtaacttgggtgttactggaaccacaacgttaactggtgcaactacagtttcaaacacattgtcaactggtggtaaactaacagttaatactggtggtattcaagtagttgatggtggtattcaagttgatgcaggaactattaccgcaccaagtgctaatatttctggtgactctacccttaatagtgcaactgtaactactacccttggtgttactggtgcagctagtatgaatggtggccttacagcatctactctagatgtaactggtgacagtactgtacaaaaactaactgttaagggtgcatttattcctgaaggtggtttggacctatccggtgctgatcttaacgtgaatagcgtaactgctgcaaccacattaagtgttactggtgcaagtactctaactggtggtgtttccacttcaactgttactgcatccggtaaggtaactgcacaagaattaagtactggtacattggcagtaaccacaaatggaacagttggtggtactttagatgtaactggaaaggcaacagtcggttcactagattcaggtgcaatatctgcaacttctggtacatttagtactacactaggtgtaacaggtgcagcaacatttggtaacaatgttaatattactggcacgttaaccccaggtgcattggatttatctagtactgatgtagatgctaacagtctttctgttgcaacaaccctacattcaaacggcaatgcaacaatcggtggtacactaggtgtaactggtgcagcaactgctccatcaatcgctcttaatggtgaaggaactgcattagcagttactaacaatgcaacaattggtggtacactaggtgtaactggaaaggcaactgtcggttcactagattcaggtgcggtatctgcaacttctggtacatttagtactacaatagatgtaactggtgcagcaacctttggtaataatgttaacattactggtacattaacgccaggtgcattggatttatctagtactgatgtagttgcaaacagtctttctgttgcaaccacactacattcagatggtaatgcaacaattggtggtacattaggtgtaactggtgcagcaactgctccatcaatcactcttaatggtgaaggaactgcattagcagttactaacaatgcaacaattggtggtacactaggtgtaactggtgcagcaactttaggttcactaacaacttctggtgcagtgaaaactggttctaatgttattattggtactaagatcggtgaacaaccagaaacagttcagattttccctaacacttacattgctggttccttgcgtgtagatggtggtatcaacgctgatattgatgttagtggtcaaacaatcgaaccttatgcagttgttgcggctgacactattagtgcagcgggtaatattacttctggtgcagagttgatttctaaatcagcaactattggtgatgttggttcacaaaacaacaacttaacaatcaatggtaacgtagttaacaacggtaactttacagtaactggtgttctaaacgcaacactaaaccaagcaaactctgatgtagctgttaaatcattaactgcaaccaacagtgttgctgctggtactagcattaccgcaggtacaagtattactgcaactggtctgctaaaagggaacacccttgaagtaactactactggttcatttggtggtgcagtaacaatgtcaagtggtgctaacattactggaaccgttgggattacttctggtaacctaactgttggtggtgatatttctgcaacaggtactgcaaccctagcagcaacttcagtaactactattactacttctggtgcagcaacacttgctagtgcatctgttactggagcagcaacaatcggtggtactttaactgttactggattaatgactgcaaatggtagtgttgttttaggtgacgcggctgctgatacattaactgtcaatgcaacatcttctttcaaagaaaatgcagtatttgataaagatgtaactgtaactggtcaattaacaactactaatgctgacttgactactacaacagtaactactaaaaaatatgatgttattcctaatcaagtaacttcttctgttattgcaccaactggcacttggaccccagacggtactagcaacgtatactttatcactctagatcaagatacaactctagcaccaatcactggtctaatcggtggtggtaaagcatcttcagtatacatttatgtaaaacaagatgcaacaggtaatagaaactttactactgatggtacttatgcggttgttgatggaactctaaacaaaactgcaaactctgtaactatctaccaagtcatttatgacggggtgagtccagtaacagatatgtttattgcacaacgtactgcttaataattataataataaaggtgtcactcattttgggtgacaccatcataacaagtgaggtagttatatgttcacatatgtgaaaggaaattcaaaagaaaattatgaattgggaagtattatttccaatccaattggtgtaaaaggacttaaagaacgtccaggtgcaacaccagaagatccacaaacctatcgttatctttatagtgatattagaactctttatggtatttcaagtaaagatggttccccagtagaacctaatgatgctgttagaaaagaagaaggtttttggtggttagtgtataaaaatcttggaaatgttaatgctattgaacaaccgttggagtttattaaattaaaagatgaaaatcaacctattgttgaatttttagaagacgctaccgaagaatataaagcactaactgttcttaaaacatatcattatattgatatgccaatagcagatgttaaagctgatttaaaagcaagaactatatcagaacgtacaaatcgtatgaattctggttatatgttcaatggtcatcgttacagtactgatatgtctggtcgtcaaatgcttcttaattattatacacaagttacttcaggctctgaaagtgtttctatttttcttgatgacgcaattgtaaaattatctgctgctgaaatgactcaactatatactgaagcatttgcaatgattgaacaattgttttcggaatgtgacaaacagtgtgctgcaattgatgcagttgatgatttagatcctgatgcaatttataaagcacaacaagctgcaatttgggtatatgaaggtattgatattcctgaacgtatacgttaattaataaaggtcaactattgttgaccttttttgtttcattataaggaaaaatatatgtataatataagaacagatattattgtaaatggtgatattagttatgacggagaactaataggcaagataccagtgcctgatattagtactaaaaataaaaatattttaattcatgaaagtgatggtttatatgttccagataacactattatctatcaaggtggaactggtatatcaatatcctctaatttaatatccacaaaaataagttcaacacaaggaaatattcttagtaatgattctaatggtttatatgtacctgataatacagtaacatatacaggtagtgacagtattaaaatagataataatattatatcatcaaaaataagcacatctttaggaaatatccttacaactgatagtactggtctattcgtaccggataattcgataacttacaatgctggtactggcattactattagtgatgatgtaataagtgtgaaggttgacccgacatcagaaaacatactatcttctacaagtaatggtttatttgtgcctgataattcagtatcttatagtgctggttccggtgtttctatcagtggtgaagtaatcagtactaaaattagttctacttctggtaatatactatctactgacagtactggattatttgtacctaatacaagaataaattacgttggtggtactggtatatctattagttcagaaacaatttcaactaaaataagcacaactccaggaaatacgttaacaactgacgtaaatgggttgtatgttccaactggaccatcctcatatactgcgggaaatggtatatctattgacgctaatgtaatttcatctaaaatcagtaatacctctggtaatatattaacatcagatagtactggattatttgttaatggtaataatactactaacctaattcgtagaaaaagagaattatattattcaaacttaaatatacaattcactgatggaattgaacaaaatttaattcaaatacttaaatcattcacacccactagtggaacactagatagtttcttcaatacaacaagtaataagttaaatgtttataatttcaattcctctctaaatttcaaattaaatatatacggcacatggactactagttcgtctaatatgagttttgctattaattttacaaatactcaatttaataatattaatcaagttagaacaccaactatcacggttgatactatttcatttaatacatttttaagtgttgatgaaaatggtaacctagtaactaatggaacacctattacgttaatgtcacatggtggtaagtttacagtaactaatttattattaattgctgaacaaatcgttccaccttcaatgagtggagtttctgtagtttaataacatattaaggtcaagtctatgcttggccttttcttttaactaaaataaatacatcatataaatctattctgaggaaatatttaaatgagtataaatcgaattagaggtgatggtggtgtaattatcgatagtaaatcttttttagagttaccgaaagcaccatcaaaagaaaccgctgatgtaataagatcagggatgattagatacaataaggaatggaaatcgtttgaaggtgttctggattttgaagatggtactatggcatatcgccgttttgcaaacttagatgcaaatggtaaacttcttacttcccaattaccagattcagtaactagtggtttacaatttgttggtacatataatcctattccagatgatattgatccacctttagcacaaactccactaccagcaccagcagcatcactaaatggtgattattatgttgttcgtggtattatggatgccgcacaagcccattatgaagcaaataatccacaaacaagtcctgttacatttactcctacaaatccaactggacaaggtaattggattgaaattttatattatgttgactctaatccaaatatatctggtgctaaactagtaacatacgctttcgctagaattattcctgcatctattccgagtactggtcatgatggtcttaaaaatttagcaacagatgctgacttaaccaaaccatttgcttcaggtgttccaatgaaccaaaccgcactatcagatggtgattggattattataactgaagataaaaacatacgtctacgccagtcaagaacaagcatttccgctgcttcagtattatatgacaatactgtaatgattgcaaatcatcgtcaatttaggacaaacgcagggaccgttcaaacatccatagataacgttgtgattgagtgtttacgtagaactggtgattccatgtataatgatggaacagacggctctgggcgttttggggtggtgtatggaagtgcagcagcaccagcattgacatttaacaataatccgtttgacccaacgaataacccaggtaatgacccaactaagtggtcagatgctaatactggtatatttcatccagccgatgacgcaattgggttcagtactgctggtacagaacgtgttcgaattaataattcaacactaacattatatcaatcaacatcaacacctgcatcaacgccagtactaagatttgataatgcaactaatactaatgtgggattaagtgctagtagtaatattatttcatttagttcaatgaataaagttcaagttgaatttaaaaatggcgaaagtgcgtttcatggtaatattgttgttgatggtacaagtacattaactggggatacatcagctagtaatataactgctagtggtaatttgaacattcaaggtaataccacattaggtgatgctgcatcagataccattacagttaatggtgttagtacttttacagctaatactaattttaatggaacaactaataaatttaaaaatataaatctattagctaatggtataattacattagaaagtgctactaatcaaagtacaatccaattagttagttctgatttaaaactatcaatgggtaattatgctgatgtaagtatctatgataatggaactataagaacacgttttaatagatatggtatccaattacctgtactagctactattgataactctgttggcgttgatggtatgattgcatactccaataccgagcgtacttcaatgcaaaaagttcaaggtcaatgggttccaattggttcaggttcagtgagaaccgatgcttttaccatttcatcttgggtcttaagtggtaactactacacccttactgtaacagcctcaaacatcgtcacagcagagatacaggaacaggttagtcctggtgtctatactcgtgttgaggtcgatagcgtgacgtttaacggcactaacgtagtgttcagtataccttcaacacctgatgtacgtttcgacggaagaacattggtaacaattagataataaaaaagggagaacatcagttctcccttttcttttatacagccatcggtgctttaattgttggcattggattgtaattcactaatttgaaagaatccattgtgaaatcttcaatattagtaattgtaggatcaagccataattcaggtaattcacgaggttttctctgtagttgttcttttacttgttcaacgtggtttttataaatgtggcaatcaccaccattccaaataaattcaccaacatctaaacccgtaatttgtgcaatcatatgagttagtagtgaataactactgatattaaatggaactcccaaaaatagatcagcggatctttgatgtagaatgcagcttagtttcccttgtactacacaaaattgtacaaagctatgacaaggtggcaacgtcatatcatcaagctcaccaacgttccatgcacttagaatatggcgacgaccatatggatcggaatttataccattgattagttcctgtaattggtcagttgtacgtttcataacaacaccatgtgaaccagtataatcgataactttgtatcctttatcttttaattcttgaatttcttcagtactggaactaaatttataatcttcccattcacgccattgcttaccatacactggacctaactcaccatcagtataaccaagagcaacgccttgatttaggtaattatctgtccaaatagttttcttttctgtatcacgagttccatgcaaaatttcacaaaggcgacgctcatcatgggaaccttcaataaaccatagtaattctgaagtcattgctttccaagctagacgttttgtcgtcactgctgggaaaccatctttaaggtcaaaacgcatttgttgaccgataagtttgattgttccaacaccagtacggtcaacgctttctacgccttcatctagaattttttgatatagttcttgtagttgtttcattattcttccttgaaaaatgtaataaaatgttccatatgtttttctgtggcattgcgtgaaccaataccagtccagttaccatgtggtgctggaacgacgaatgtttgtgtgaactctttcagtactgtatcgaaataaaatactgaacgtgaattcatatcataacaataaatttcaggattttcaactgaatccatatacatctgtactgcccatgcagtaccaccacttaccttagttggtgatgtgatatttgcaatacaatatattctttctgtattaagtatctgataactattccttgcaagtaagttgtaaacataagaaccaggctttggcacttttcgctgcaacgagtaacatgcaatgtttagttgatttaatatagaaatatcagatagaatattggatggtatttctaatatagtactttcatctacactatgctcatgacctttgaatgaaaaattaataacttcaaatccattattttttgcatagatagaaaaaaggcggtcagcacctgctgccccgccactaaaacatacattagataaacctttaattgcttcatctaattcattctttttcatattttattttgctttacgttctgcaaatagttgttttactttctcaatagctttagtctgtgaaataccttctggaatttctagataaattgttttactatctttcggttgttcaacaacttgtgtttgcggacgcaagcttggctctaaattgtatgcacgttcataatgttctttagccagtttttcatatttttgtgcatcagtgagaagttgttctacaatagtagcttcttctactttagtgtctgcttcttgtggattgaatgggttaaagtcttttactttaccatcttcttgtactttcgcttgattttcatctaatgctttgtttagaacatcaagagaaattttattattaccaccagtgtgcatatcaatatcacaagtacgaacgcgacgtagatgctgcatgttgtgtagaacatctagcattttgcgtccatcgagataaccaattttatgcattacttcccacaaatcaatattagattgaccatgacccataacaatatcagttactgcgtgtacatatgcttctggtagtgaatcgcgataaacgataaggcagtgttcaggatcatctggtagtgaacgccaaacaacaaaaacacgagaacctgtattacgcattacaccaacatgacgaatagctgccataattattctcctttatcttcttgagtttcactatcttgtgattcagcttcttctttagctgcatcttcttgtgctttaatatcttcaagagctacatttgcaaaagaaacaaatttagatacaactggagcaacctcaacaagttcttcaactttaaaggtgtttcgtgcaacagcagcttccatgatttttgcagcattgattaggtctagaagggttagttgaatttgattattttcttgttccattttaatactctccatgtatattggtacattaactattatatcatatttttataagttgtcccacttataaaagaagagaacggaattttccgttctcattatttagtacttaactacgttgacgctttttatcagcttcatattcgtagtgtacagtctcaccaaatggtgcaactttatttgggttactgtgaatcacgaacagtgttttacagtagtttggatcaccccatgactgccacggttcaccatcagtaaacattacaagctgtttaggcttgtagttgtcgttcttcatatgaacccatactgcttcaaagtcagtaccaccaccaccttttactggatattccagaatcttacgttcttcgccagttttgtaatcctttacagtataaacttcagtatcaaaagtcatgatacgaatcttaaactgtttgaattgtttagtgatgccaagaacttcactaatgaaatcacgaagcatatcttcagaaatagacccagaagcatctagtgcaatcgcaatatcaatatcatcatctggtttcatccctgggtaaattggattaccatagaatgagccattagaaccaaaacctgcaccccaagaacgacgattcggattttgatatgttgcatcagacttcaaccaactacgaagtgtacgttgaagttttgaacgccagtcaatctttggttctttaaagttgttaatcatacgagcgatttctgctggtgtaccacctgcacgagcagcattcatcattgctgttttgaaatcatccatgtaatcacgtttttgctgttcacttgaaccaccctcttgaccttcttgtggaacgtcatgctggtcaatggtagtaccttttggtttacccttaccatctttaatatcgccaaaagtaccgcgatttttaccttcaccttcaccgccgccactttgtggttgaccttcaccttcaccatcttctttttgttcttcttcttcaagaagaatgtaaatctcttctgcggtcatgccttcatattttttatcatacaaccatgaactttggattttcccaattttctcacgaacgatgatttggttaatggcataatccgctgcacggttataacgttgtggatcacgcataccacgacgaaggaagtgatcgtaagcacagtgtagaatttcatgacaaattacagcaacaaggttttcatcagtcaaaccttcagtcatttcttttaattgttcgtctgtaacttcagggtgcttttcacgaatagcttcttcatattctttctttttagatgggtcttgaatgcccattacaaattctacgttgtagaatagatgtttaccatccactgctagagtacgacaccatgtattattaggaactggacgtaaacgtgaagcgagtacaccaaagaatggtgcagttaacatcaaagatgtacgagccagaaccagacgttcttgacattctttctggagtgccggagatacttcattgaatcttgaagtagatttgttatctgacatgtatatttcctcgtttagttaagataaaagaaggataccattaggcatccttcttgtcaacaactctttgttaattagccaagagagcgtgctttacgtacaagatcagagtacttagcgatgaaatctttaaacgctggtacatctttaatggaaatcgcaaccttatgaagcgtgatggtacgaattgccagtactgccagttctgcttgagttgcagagaagttatggtctaggaaggtgatgaagttgttacacagtttaccccattcttccactggtagacgttgttcttgcttctcattgaacaggtcgataattttataaaccaagttcagagtgataaagtagttcgcagaaatatccagcgttgcgtcgatttctttgatttcaccagacagaatagacatagtatctggtagtttagcaacgttctcaacgtactcaatgtattcagttgcaacaccttcaccaacacgaccagcaatcattgcacggaacacttctttatcaattgtcttagttttcttgagatcttcgtagcgtgctactgcttcccatgaacgtggagaagtaccaccactgtgagaaggatcttgtggactaagtgtgttaaagtacttagaaccagtgttgttgatgaacgcaacagttgctgggttcaaacgttttgcaatcgcataatcgttaatccaatcttgatgataaggaatcatctcaatgtgagtcatacggtcacgcagtggtgtagcaagagagaaagttacaccaccatcagtttcacggttacctgctgcaagaatcagtgcagtcttaggtagcttcatctcaccaacacaacggtcgaggattagctgataagacgctgcctgaacaataggcattgcagagttaatttcgtcaaacagaataacacctttccaatcttcggacaatttcagaactttaggtgcagcccatactaccgcagtttcagctacataatcttttgcttcggcaagctcagattctttcagaagagaaccgtcagttttacggaaaagcttctctggtactggaataccgcgaaggtcacttggttcgatttgagacaaacggaaatcgataaagttagtatcttggtcgattagttttgcttcaaatgcagccagttcacggcgtagctgatcagcattttcagggtcagcttcgatttgttgtttcatgaactcgattttagctacgttatctttacgcagtgggtaattttcatcagcgtattgacgagcgattgcagacttaccgatacctgggctaccccaaatcatcaggctatcttgaatcatgtcagctagtgccattgcttctttagctttctttggagtcagtttaacgttcaggatatcgttttgagtagtcatgtatatatttccttttgttggataaaatcgtttaagtttctattatagccaatccgtgggcaaaagtaaaggaactgtgttaaaataatttaacttatcagttcctttgttacttcatgaatcatccgtgtgtttaaaaggtaaatctctttgctgtcttgatgtgaacattatatcacatcgtttcaacttgtcaatcacttttttctttttttttcaaactcacatcttgtgtcgcttgaaaactttatgtctgatgcttattgtatcacatcattctatcttgtcaacatttatttttaattcatttttcttacatatgaatagaaaataactgtttaaaatcatcacaacacaatgttaattcagttattatcattgcatctgtcagatatatgtactgaccttcaacataataaggtgaagtacatattctgtcaagtgatgtaaacattatagaacttttaaattctctttgcaaggggattttggtaaattcataaagattattttctttacaaattccatacccaaacttgctaagacgtaaaccaccgccagttctgaaattttcaaaaattgacatcagaagcatacggtctgttatttctgaatctgattcatgtacttccctaactttggaaagtacattattttgatattcagtactgttatgtgatggttctggaaacatatattagtctccaacaaaaccttgacgtgcagcataagatggtgcaccaggctcattatagtgttgtacgccttctttgtcaattgatggtcccataccttcagttccaaaacaacctgcaatggcttccaacacttcttcatcagcaacttcagtactttcatcattatatcgaatgtcagacaaaatgtcacaggctttttgtagtttatctacaatttctttttggtcttcaccagatttaatcttatcaacaatatcaataagacatttggtaatatccttaagaacatcaactgctacaacatcggattcaacttcaactgaaaaactttcgtcttcatctcttccggtaatttcgtctaacgcttcaactagttcacgataattatattgcatattatttgtctcctaaaaatttcttgtatttttcttggagactttcaaaaatatcttctacttcttcatcagaatcatcttccaagtcaatgttaccttcaggtgaatcatcttcttcactttcattaacatttagtgggttatctcctaatgcagtgcctgggaattttggttcaaatttatgaacacgattttcgttcccttcattatcataatactcaggttctggacgattgtcaagatcttcatctacaacacgtctccaataaaattgattgccttttgcaattacaacaaaatggtcaccttcaacaccattagtctttagttgaccatcacgaacggcatcagcttctgtttcatatggaccataatcagtactgttagatggttcttcatcttcagagatacttagatctggtagaaattgggtatctttcatttctttatcggtagcaggattaccctctactgaaaaatcttcgtcttcttcttcgttaataccagcaagagatagcatacgactaaaatcgaattcttcttcaataatttcttcttcttcctcatcgtcttcttcaactgattctagttgaggttgaccactaaggtcaagagaaaaatcttcttcaccttctacacctggttctgaaaattcagcatccatactaacttcatctgtgtcagcaccaaaatcaccaacatcagcggaaagatcatcaactgccgctgctagtgggtcttcaactgaagtttcaattccaccaatttcttcttcagcaccaatagaatcgagatctagtggagcaataggtggaagagatggagtcatagaccccatagatggtactggagcagcaactactgggtcttgacgttcagcttgaccagcaagagctaacatacgtgatagagtttccaaatcatcagattctaaacctgcgatatcgattttaacttgtgcttcattaatttttttagccattttaaataaatccttttagttatcaatcattattatttaatgattttaaaatttgcactgtttcatcctttttacctgaaagtaaaatgtcagcagcaagtagagaaacctcatcaccacgagttagtagtactgtgatttttttagcataaggtgactctttaattttagaagctaatgattgtacatcatcaccagcaattgtttcagatttagtttctggttcagaaacttcgtctggtttttgttcagattctggttctttcttaggttcttcttttgattgaatttgctcagtaccagagtctacttcaggtgtttcatcacttttaacttctttatcttgttcatatttggcaagtaatttagcagcagttgcttttggtataaacttaccatcagcactaatgaatctgtcaccaccaacatacgaatattctttgccttgtttggatttaacttttgtaccgattttcatagcaccggaattgttatgacggaaaatatcacgctgtgctgctcgttcaacacttttagaagcacttgtgttaagttgctttttactttcgatatcataccacaagttatttttcttagcgtatgtttttcctttagaagaagtcattctataaccgtcaggaacagtaatactttcaaattcttcaatttcttcatctgcttcattaattgattctttagttgcaaatactggctgtttagcaggttgtgaagcttgttgtggcttttcacctgaaccaaaacgttgctcactatgttcttgttcacccgttaatgttggaaaatcacttgggttattcttaacaaattgctgatatgcattaataattgcatgtgcattttgttctggaattactacattaccatcattatcacaaaattctttaccattccactcacaacgtgtattgccttgaactaaggttgatttgattggaattagtttatttttagaagctaactgacgagcaatacgcataccttcatctgatagtttacgggtcattgctggatcaactgctcgtcctgatttcatatcaacaaaacggtgattctttggcacaaatttaaaaccacttacttccatacctgctggaattgatatatcatcagcatatggtggaagaatgtaaaattttaatgcattccattctttttgtagtgtttctttagaaacattatatactcgatgatcatctgccattaattcagtgatgaattcactttcagttaatagaattccatcttttgaattgaaacggttttcaccaataaatgtacactctttaccttcaacaatatatttgttaccaatcttatattcatttgaagctagattgtgctcgacaatctgttgtcgagcacttgcgtacatggatgggtattttctagggtctaccattaacatattattgtcattgaaccagaatccttcaagaaatacatattttgcaccagtatgtgacgtatatacatatccattaggaactgtggtagtttcagtactgaaaaaattatccatgtgttgattctccttaagaaagcatacgtaacagttggtcgcgttgctctggacttaatttttgtagagcatcagggatactggaaccttgtgcttttggttgttcttgttgtgctggttgctcagttgaggtcgattgtgatggttgtgattctgaactttcttcgccgccttgttggtcacggtagtcattcattatatcacgagcagcatttaatagagcagtacctacatcttttggtgtaaaagaacgacgaggattgttccctaaatgtttaatatccagattgttacctttaaaaaactgtgccacatcagcgtaaggtactgatggttgagctttaccatatttacgtccaacatatcgtttaaactcggcccacaatcggttagcttcagcaccaacctcttgtgcaccttgttctatctgtccactaccaaaaaagccttttacttttccttttgcactatcaactgcactttgtgaacgactataaggacgagcttcatttaactcattgtcttcataatctaacatttcattaagtatactcatgtgttaatcctttttaccaaaaccagcactcatatattgagagtatttattgtcttttttcgatgcttcaattgcatcatcaacggcagtgtctgcacgttgttgtccagctaagtcataactgtcttctggtttgccaaaatccactccaataactggttcatcaacatcatcaaaatcgatatcatcttccaaatcagtcatttcaatttgacgaggttcatctttactacgaacacgaatcaatgcttctgtcatgcttagtaaattgccaatttcatacattagtacatttgattgaacgccacgatgacatttaaagtcaaacatccaaatttcaccacaatctaattcatagaaatctaatggtttttccataaaaattgttttctttagtgctccaatttcaaacgcatcatagcgatccattagtcgctgtgttactttactaagttgttcaggtgttggttcaactgcaaacttaactcggtattcataaactggtttcttttcagttaggatttgttgtaatctattcattttaataactccataaggtcgtttaagttatttatttctgttcattgatgcaagcatttcattgcgggttttgtgaactacggtttgcccttcaattgcatctgggtcaccaacagactcaagttctttttttggtttcaaatttagttcaatttccattttgtcttttttaagttggagatcaactaatttaacatctgaatcaattatttttgcatgagcatcaagagctatttttagcatagagtttgcagcattaatcatctctgctgcaaaacgatcttcacaattaaatgctctatcaaaaatatcctcaaactttcgttctgccatttgtgctaaacgatccaattgggtttttcttgcagtaatatcaggtaattccctcaactgtacacgcattgctttgagcttttccattgcaatctttgcatcttccaatgatatttcagtttcagttttgtcttcatcctgatacaaatccatttctgtatcttcttctggttcttgaccagtcatttcaatccattgttgtgcactaggtaatcccagtgcttcgtctatttgtggtttagatttcattttttgtatagattcctttctgttataattttaaactccaatccggttatttttacaaaattccattgcataagcccatttggattggtttatagcaactgcaattttttcttttttggatttagccaactccatgtggcattgtttgtatggcttgacttctagtacttgagcatgttgcttaccatcagcaccaatatacagtacataaaaatcaggccagtactggtggacttgtccatctattggactaacataaggaatactaaacggctcaatactccattcaatgactgctggattattatccaatgaaatcattatgtccttttcccacgaactacggtatattggttgattattacttttatactttttaatgttttttataggaaagataccttgagcttgcttagtatttgttatctttgctgggttaaattgttgattgaaagccattaaaaatctcctaaaatgttacctaatccgaattttgaacttgcttcagaaaccaaactaccaaaccctatggcgttagcacctctggttacagcagaacctatgtttcgaattgtgtcaggagtaatgtcaccacgcaatatatcaccagcactacttattatatcactaactgacgtacctgctcggataattttaccaattgttaaaattcctttggttttgtcgtctaattcaccaaaatacttaaaaaacccactaacaccaagaccttctgtgtctgttattagttgtgctatttccatagttggtacaccaatgctcaaatatccttctggtccgaagttgttacatgcttcatatcgcatagttaacgatattaatgaagggtctgcttcactttccatagatttggtttctaattgtacgtcttcaatgaatacatttatcatgttatgtacagtatatgtttcattatcaatctcatatatgttaattgatttgaaaaagtactgattatcgtagtttccattgttcattactgaacgtccccagttaccacctaaaccattaaagttttcaggtgtacttagaacatcatttcgatatgactgtggatttttatcaaagaaatcaccataataaaactttctatatgcatccattagtaagtaaccagcaccatcaacggtatcataaaaaacgacattacttggtttgtaaacaatgtcaccagtaactagtcgttttttgttatattggtttactgtttcaatattaaatgaaaaacttggcaaagttacatctttaacaaaacatgatacattattaacatcaaaatcagtatgtgtatctggtaattgagttttaataaagtttttcgcaaaaggtgttaacacaaattctataataaaactatttttgaatttaggtaaattgtaaaatgaaaaccccatttcacctgctgtaccaaacacacgttgtgcagcattatagttctgaaaagcaggttcacgaacaatgtttatattatcaataaagccatttacaatacttgtaccagtactgacaaatgaatcaaaaaaatcactcattcattatctccttaaaatcctacactaccaaaaacacgatcaatgatatctaatccttgattgacattttcaggtaaaagtgaattaattctggtactatacatttcttcaatattatcaaattgtatacaattatctggtttgatagtcactaccatttcaactggagaacttgaactatagtctaatgaatcgtatgatatgttttgaataacacatcctgttaaaacaaagtattccataacaccagcactgttatatgaagaaccaccaataaattggtctactgcatttactaagccagcattatttgttgcagcagttgcagcatctactagtgtatctcttcctagattttctagtgtatcatctgagttacgaccactcaacatctgtataactaaaccaaatttataagaaccataatcttggtcatttcttgaagttattctgcgttgaaagtcaagttgtttttgtagttggcgtgataatgcttttgctgatgcatttccaactgaatcacgtatagatatagtaattggttcccaatcatgactacctatataggaagtattagtagtaaattgatatagtttatgagtactaaatgttacagtaggtctatcaattttatcaacatctaatgcgatgtgatcacgttcatctatatcagtaccgaaattatacacaataacacgaaacttgtattttgctttcggttgtagcattgaacgattacgccccgatggtaaaggaacgccatatttattaatcatgttatttgccatagcaacctctttttattttataaggcattatactttatttagcataaaaaaagccccgaatagattcgaggctatatattaagtttaaataaaattaattttcgtagaagttactatctggtagagtagtactactaatattagtttgtgcaccagaaatagaggtagcagttgatggattaccgaagccactaacttcatcaccgaacgcttcgccatttggacccaatttagcacaaccatctggttgaacagtcattgaaataacttgtgcttcacttgaggaataatcccaatcaccaaagttgctggattcaataaagcaaccttgacatacccaagtactcaatgttccttcaaacaagtttgttgtattttcactattagaaccatcaagctcttgaatccacatttcaaatttaaattgtgaatctgtcatgcgagattcttgactgtagtagttaaattctttacgcatttggttgtatagtgctttagcagaagcattacctacagagtcacggaaagcaacatcaattgtatcccaagtgtatttccctttgtagtgtgcagaactgttgtaactatgaacagtgacgttttcatgtgatacagatactgccccaactgtattggtgtctagtgtaatcatattaccatcatcattagtaccaaaaccaaagaaaataacacgaaatttgtattttgcttttggttgtttcatagagatacgaccaccgccagcgagcggtacgccatatcgatcaagcattgtagccatttatattctcctattatggaatgacatctttatattatttatctatctggaagtatatttttaattaactaaagtgtcatcaacagggaaccaattaatattaacacaatataagtatctttttcgtttagtgtggtcaatatagtttactgatatagaccattttccatttgtgtatacttcgtatttttcaattataccgacaatcttctaaattttttaaaaatatatttagtatgtgtattgattctaactgagttaaaactattttactgacatcttgtattgttctttttagtatttcttccatatccataatgtccccttataacatcaatataaaggtatttaattttaaacaataaaaaagggaaccaaaaggttcccttagtgttttattgagttttttcgatacggattggtacgtaaatgaagttaatactcttagttggttggattgcaatatccatccaaagttcattacggtcaatacgctctgcggtattgttactttcatcacaaactactgcgaagttataaagaccctgttgttgaacaatttcagccaagaaactattaactacaccactaaattcctgacgagtacttggagtattcaaacggaataggaatggttcggaaataatttctagttgacgacgaatataaacaactaaacgagcaacgttaacacgacttagtgcagaagtttgattagcagatagagttttatctccataaacaagcaaaccacggttaggacgcattgcaattgggttaatgttgttagtatacataacgtcacgttgaccttggttatatactactggttgatattcaccttcgctgttgataaaaccagtacttgcagcgtttgttacaacaccacgagttgtaccagcaggtggataccatacataactaacactatcgctatatgcatatgtacgcattgcaatagtactaccaggaactgcaacctcttcaccatcaacgttagtacttagacaccaacccatatactgagcagcataatcataagcagttgtacgaccaactgaaccgttacttggtgcattgttagcattagtagcccattgttgtacagcactaccgtttccggttggattcaaacgtgctggaacgtcagtaacaataaatgcagtttctttacgatcagtgtttaaagttacacattcatcaagtgtttcaacgtaaccaggtacacaaattaggttaaaatcaataaattcagaacgaatgtcatcattaccaataataacagcagctagtgcttcaactactagttgacgttgtgcagcacgaccaaatagaccagcaccatcaagacttacaccactaacaacttcccattgaccattaaccattttcttaacaacaccttcagtgttacctaggtcaacagcaagcataccattttgatacaatgccgcagcaggaacttggcttgggaaattaaagtcttggaaaatcataccatttagtgtactttggtcagtactgtcaagtttaacccattcgccatcaacgttacgatagaaatcataaccatcaatgccttgagataaaggacaaacccaaattaaacggtcagccgctggttcgtcaacttgtacatatttgttttcttcttgtactagatcccattcatcattagcaacatcagcaacatacatagttacagttagattatcggagttcccgaaatcataccagagagttccttcttttgctacactacgtggtactgaataactaacacggaagttattaacgttaattagagagtagttgttactatctacagttagtttttgtagttcagattcagcaaaaatatcatcaccactttgtgtgattttgaaactgtaaccttttgtattggaaacaactaaaccaccattagtttcacgtttaaatttaaaaccatcgttaataatttcagcatttgcatttagattattgatgatagtttgggtattaataacaccgccttgtggaactgctagtactttaactgatttattcaaataaacaaaagtcatataactatcagcacctgcttgttcaataatagtttcaccaagtggcaaagcaggagcactaattgttgttagttttgcactttgaatatagaaagagaaactcttactatcttcatcaaaacgagatgcgatataactattgtttagtacaccacttttcgcttcaatttcttggaatgaattaccagtatatgctggtacaatattccaaacttgagttagggatgcataacgtttaataacaaaacgagtaccaaaatagtttgaaccattttgggtgtaaccatcacgaatccaaatgttacctttttctacagttgagccaactggaactttgttaattggtgataggtaagtttccatttgcactagcccagaagcagaacgtttatacattagcatctgaccattgcttggtttgtaacgtagaactaaatcatcaacatttaaacctactagacttacatcttcaacttcttcagcacttacaatagttactggcttaagttgccaatcataaaaactgcttggactatctttcttcgctacatacgcttctacttgtgattgtgcggtatcaaaccacaaagtaccattggatactggaccagttggtgcttcagcacttggtgctagttgtgctagatcgatatcagcacgaattacatatgcacggttagtaatgcctagataagaatatactgcatgtaggccatattcgtttagttcatcaccttgaacaacagaaccgttattcatttgaaaaattggtgtaccataggtatcaagtgaacttttttgtgatgttagaagctgtagttttccagcgtttgctttagtagttcccgcagctattgcactgcttcctgggacaagtttgtcttcagcagtagcgattacaaatagtggtacagtgccaggagcagcagcggtactcatactttcatcagttactgaaatggaaacgccaggtgagagtagatctcctgccatattaaatcctccaaaaataattggttattcgaaatatattcgtatagtcttatttattgaaggatttaattgtccagtccttattgtttataatttatgtattagaataaataatgtccattgcttttttatgtaaatcatcaatagtactgttattctgtacaattatatcaggattgtttattccaatccaagcccactcagattcgtgtactgattctagttcaactggtttaatattaatatcccctttattataagaggcagccaaaccataccaatgtggtagaacacgttgaacttcaataatagtcccattattcgatctaatcatttttaattcatttggaaaacggcaatcagtgatgatgatatttccatctatgtcttgcattgatttttctaaactgaatacccaaatatcattatgaaaatacttacgcaaaatattagtaccataattctgcaatacccatcgaggggatacatcattacgacctaacttatcacaccagtactgatccggttcttcacgaatcttacgactttccttagttgacccctcaagcatttcacggtcccatccaaagatggcagcaactgaatcttttagattggttgcgaatgacattcgtgtgtaaccattattaataaaagattcaccaaatgtatctttaccacttccaatagttccgttaattgcaattatttgtcttcccattatactactccatgtattttatataatttctattaaatcctttcctactaaactttcaagtaatccaagaattgactcattaccataatatatagaaacataagtaataaaaaatgtttccccatcatcatcacgatatatactcgcccatgcatttattcgatctctaccgataacatcaatgattgaatctttgataaatttccagtacttttcagttgattcataatcaagcgttggtctaccacaacgatatctgttatacgttacatttatgttattattcatgacaagttcctttagattaatattatcattatatcacataatatgaaaaaagactccatataggagtccttttaatttaaccaataatcataccgagtggttcagcaccatcttgataacgtttcaaacgctctttaagctgttcttgaagctgtaaaccttcattgcgtaaggtatcaccatccatagaaaacgttccctgtggtccaggaagcgatgcaaatttagcacggttacgacccaacataatcattgcttcggataaagcccaatcacgcaaccaaggataactttgctgcctttggaacaacaatggttcaggaatattatgatagacgtgtaatagtacttcttcagtaccacgaatatcacgatctataattaattttttggtcattgggttaaattgaaatataatatcacgaccaaacatacgacctaccagttcttggaactgaaaactaaaatcatatgtagttagatcatatccaccagcatttcgtgctgaagtcaataagtaagtgttggtgaatgctagagaaaacgggtctactgagttcccactaccagaacttaagtaaccattaccataacgataaatctttttaacaatttcaacttcagttggtagcatatatacagattgtgaatcataaaatttcatatttaaaaatgcttcttctttagaagcagaactccacgctctgtaattcgataccgcattatcaattgcaatttctaattgaccatcagtaatttctacctcaacggccccagcacccaacatttgagtgataacatctttcagtttttcacgatggtcaaagttaggagcatcagggtttccacccatataatcgtaagacataaaaaagcacctcattaatgtttatatacattatttagaggtgctaatagttattttgaattatacaagcagtacaggtataccaatggagtaaaatgttcggaatctattatatatattaactgagtaacatatattccatatagatctcgtgatttatctctgtacattaacaatgatttatttaagtaaggatcaacccagtacttaatatcattgtacttcaacgtgttgttacggtaacctgatagttttgaatttttattcaattttcttacaattactcagtaagtgaatgatatcatcagcagtgaatggtcccaataccagaacttcttcaccattaccgaaaatgctcaatggtactgattgttgaccagctagatattcaatttgttccagttcgaaaatgtcatcagcagcatatactacctgctccatttcattatctttaatccatgactgccaatgttctttaaacttcttagcttcgtattcttgaacatagttaggtgattcagggttgtattgatgtaacatagtcatcccagccattactaattctttaggggatggtgtagaatctttcagtactacgatagcttggatagtttttactttaacgtcattagcagccattatatacctctattatagaatgattttattctcaggaacgaaaacttttggagtgttttcgattgctttaatagcatcaacataagcatcaactaatgcagggtttgcatcactaacactaataatgttggatttataaaaaataacatttttctccatactaacaaactctagataatcacgaagaatgatttcaccattttcgtcagtccctagttgtgctgggtagttaactacaacagcttcagcagaatcggtttgaagaactgctagtactgggccaatgttattgatgtttagtagtttaacggtcatagtcatttttgtcaagtccttttgtttattttagaatgtataagtgtttttctgcattgaccagacggtgatcaatgatttctttgataacgttccagttaccgccgcccaaatcggctccaattttcgggaaatgtacatgaacatctcgatcaactttacaaaaataatttagatgtttgaacacatcgtcaattgcatcataactgacatatttagcaccgtcattaccgtacattttttgggtaatacagtttgcaataatcaaattatcgttaattgctgaatatgcaatttgtccaattctaagaaatcccatttccttttcatatgctttataatcatcatatgccattgggtagcgattccttagttcctttgcgaaaccagaacccatcttaccttgagcattacatccgtgagcaataatatgtaatgcattttgatcatcggtaacagtactgaataattcaaacagattacctcggtgttcatgaatcattatattctccgaaaagaaaggactctgtgatcagagtccttattttaaattattcttcttcaccgaaacggattttctttaattcttttcgatgctttctagctattgtacttttgtgaagtctattactgcgttttgtgtcttttgtaatgtaccatgaatcttctggtgcatcataatcacaaaatccatcttccgtaattgttcctaaaaatgcagattttttaggaatattagtttgagctttagcctgaaattgaccttttgctaattgttcacgaaaactgagcataatagtatctcccaaattgttaagaagaactttttgttcttcacatttatttagggttgccagaaaccttcacatatttgataaatgccaaaatatcatctttactaaaagattttacaataaattcgacagcggaatcatactgttcttgtttagatagatattctttcatcttgttaattttaatctgggctttttctttagctattgaaatatcaggaattttgaactctactcccaacgtatcagctagttgttttgcacgagatgatactttttcaatatccattagttccaacgaccttctttaagaccttcaataaacccagtacaaccacctggtacataaatgtcatttacgaaaatttgaggaacttgacgaactggttcaccacaaatttcagacagttttgaaccatcgataccttcagcaacaatatctacaaactccatttcaaatttattttgttcacatacagcttttgcagtgtcgcaaaatttacaaccagtcttgcgaccataaattttaactttcatgttatttccttctatttctttgaaaagctttaacagctttaataatactgttacacattcgttcagtcaaatacttttgacattctcgtacatcaatgtacatgaacttatccaattctggatgactcttaccatatctattagtgtaagtacttttacaaactaattcatctggtattggtttgtctttggcagtataaaagaaaagtactaacctttttccctttctataggatacatcaccaagaaacagaagatcatcttcatcgatttcgtatcctgtctcttcgaaacattcacgtacagcagcttctttgaaagtttcattaccctcagctttccctttaggtaaatcccaatgattctgtccgtgttgtatgtccgataagtatctgaccatcacgataaaatattataccacaactataacgcatatcttatctctttgtcatcaatcgatgttcagatactaataattatatcagttattggttttttgtcccactatttttagaacatttgtttgattgcttcgtaacgaagttcacaaacaaaatcacgaatttctgacgtttcaagttcaccatctttgaccatttgctgaatatcaggcaattcaacatcagtataacgatcataaactttaataattagatcttcaagttctaaatcaatttcttttcgcaaaatgaagtattccaaaactttataaaggaattcttcacctccgttatttttaatattcatatccaataaaatattacccatttcaataggggtctttttacggaatgttttgatatcatcacggaaacgtttgatataattactaaatttaacatacttaactggaactttaatagcaccgttaagtactgaatcattatttacttcttcattttcaagaagaatagaccacagaaaatatggtttatatacatcagtacagttatctgaaatataatcaataaggtctaaattctttttggtcaaagatgtattaaacaccttttcgtaataaccaaatttacttagcgtcttaaggaactttgaaggcttttcttcagaaaatgatttttcgaattccacaaaaacacggtcaggaacaagatgatttagctcaccactattgaccatttcaatagcgagtttctcagtgctttcatggatagtaaagtctgaataacgagtagcaaatcgagcaagacgtaacacgcgtaatggatcttctttaaaatggtcagaaacatgacgtagtaccttgttcttgatatcagctttaccaccgtatggatcgatgtgaatttgtagtactggatcatacgcaattgcattaattgtaaggtcacggcgatacaaatcttgttctagtgttacgccttttgtatccacttcaaagccaccatatccagtaccagttttacgctcagtacgggctaatgcgtgttcattaccttctggacttagatatactgggaaatccttacctacttgcttatagccaatactttgcaagtacttaagatcagattcggatgcaccaacaatgacataatctttgtcttttgcacgaagacccattaaacggtcacggacgtaaccgccaaccaaatactttttcatgttattcccccatcaaccaatcacgtagacgttcccagaagccttttggttggtattctgggtattcatattcatctgtgccttgctcggaaacaccccaatcttcttctaacatagcaatcataatgcctccaattaaattaatctatcacgtagacggtcgtaatattttttgtgtatagctagtatacactgatatgcagaatagtcaataccaaatgtatcatcaatgaacatgtactgatcaagtgtttctggtccattatcatcaactggtaatgtcccttctttttttgatagtgtgtgccacatcaactcactttcaatatggtgagttgcgtatgtcaattctatcttactttttcgtagtaaaattaacaattcatcattgtcgtcgagtgcattacgaaatttaatacgaactgtaccctggaaattattagtgtacataacacgatgatgattgtatgaaatcaaaccacgtctttcagtactgatttcgtgttcagcaaagtactttaacgtttcattaaattttggaattttagtaacgtccaatcacataatcctcataaagttcgtataccctcattatactctgatatgtatcaaagtcaataccaaaggtatcctcaatgaactgatattgcaaaaactcttcctctgtagcagcaataggaagagtcccgtttcgttgttctgtggattgaacatcctcaatatacatcaacactataccttcatccagatttatatctatcataaaaacatcttcactataaaatatgttatatgtacggatgaagagatttcctgttctatcataacttgacacgtgtgtttcataatacattttatctaaactaaagaacaaacctgtactatctggctttttagtattttttaatttaatttcgatagcatcaataataggtttaatatcaaactttttcatagacaaatctcatatcgattagtgtttggatcatagcaataattatcattaactttaacaccaggtttaagtgttattgttgttcctacttcagtactgggttctgcatcacaataaatcatcacaccaaccccgactagtaaggatatgatacatataactatacatattgtatattccatacatttatctccattataaaaagtaattatacagtttattgtacaatataaaaaggtctttcacattatcataagtaatatcagatacatcatgaattaatgataactgaaaaaatgaagcttcgtctatttctgctggaattataacatcaccatcgtcttcgtccattttattagtgtagtattttatgtgatctacattcaactcaatagagaacgcaatgttggtttttgtataatcttcaattaatccaatatattgagatttttcattaataaaaaatccaatcccaacacaacggttatctggatatggatagtaccatctattaataactaggtgttcaggtaagtccatatcatgtgttgatattatagattttacaatttccatccaggaataattcataattaaaactccataagaaaagggacagaattaatctgtccctttagtatatattactcttcgttttctgtcaaatcatcaagaactgggtgttctggatggtttcggcggtgtaatttaatgcttttgtctttactgaatacagtttccattttttcaaatgaatcaccaattgctttgtataaatctgctgcatcggcagtaactgatttactacctgatgttagagtcacagagtattgagacttatgctctttcttcacatgaacttcaatatccattacagttgaagtacggaacttttcaagacatttagcaccatcgtaaattgcatcttgaattgctgtagtaaaatcaacattaccttgaatatttaattttagcataatttacctaccttttttagagtgaacttaacaacaaatctgctcggtttgtaacttgacgataccataaggaattcataatttcttttttaaatttcttagggttatcattttttacactgttccaaagtttattaaacgaagctaacttatctactcccattgtatagcacatttcaaaaagaatacgttgttgttctttggtcagatttactgcttgttttttctgcatcaataataaaaagtcatcatatgttcttttcatatcttgcattaaaagtttgttggcttgagctttggtaataccgtttctgtacttgatagcatcagattcttttcttcccaaataatgcccataaccgattgtataattacctttcatatccttgtaaggatgaaatttagaattgtggaaaggaactccgactttcccaccaagtaaacggcgtttgttcttggactgaaattcaattgaaccttcagcttctttgatgtgattgacaatttctggatcattataatcaaacagtacagtcacatctggtaacaatacgttcttcaaatcctcttttgttgggataaagataccctgagaagtatgaagagtagcatttaaattgatatttttcaacaaaataacatactcttcaagttgtacatttttaggtttaaactttttagcaatagaataataactatcaccaggttgaaccgtataatgcttctcgccgcgtggaacatcctttgatatttctacctttggtaattcctgcttttgaatttgcgtaacttgtggttttaaattgtgtacctgactttcgtccgatgatgatacacgatcattttgagaaaaaccataaaatccaatcgcagcgacaagtactgtgcaaactagaacaccataagtagtcttagttttcagtgcttttttcgcttgtttcaaaacgcctcctttgttgattgttaagatgggcaatcacaaagatggcaaagaggccatttgcaaaagcctcatcggactttctacagtacaaaaacgttcttttcaaatgtttaagtagtatagcatatttttattttattacaagacatatttactgtaaaaaccacattaatcgtagtaggttctacctacagtgatgtgatatttaaagtacttggttggtagtcctagttcatttctaatatgtgtgatgaaatcatcttcaaattcaatgataaagaatgaacctggattctttttatcttttactatctcaatacaaggattgaactttatctttactttcattccatcgtattttttccagtactctggatttggtggcacttcaccacgaacgatactgacatgtgctccccattgtgggtctttaatatcaatatgtaagtcagttctgatgaagtactggtagtatctaaccaactgtaatggaagttgtagtactaaccagaagtccttcttctttttcatagtgccacgatctggatcatacaccagagttccttccatatcaatcatatgttacctataaaattacatatatgtttttattttcaatacgaacatatgtttccaaaacatctttcggaattttattacttgttttgaaccatgtagtattctctactaaaacaaaagtttcaccttcagtttcaccaaatgtacttagtgcataaatgaagtaattgggagatgcactacaatatatatcagcattaatttcaatcatacttttacaccacaataaaacttaatacaacaagtgtaataaacacacccacaatagcagtcatttctgggtttgcatcatatgtatagcgtatacattttagaaaatctttaccaaatttctttagtccattcatatattttccttttatttcttgtgtaaaggttcatcactttcataataaattgtatcattatttcgctctatagtaaagctcttttgacacaactcttcagctaaaccctttgcatagtttaatacatctcggttgagatatacttcttcttttggaaagcgtgggtactgaataatacgagcacacatcccactttcaagaccgccagtgtagatatattcacagggaattaattgtacacaaaagccatacttaaacgcaaattttcttgtgtactctcttgctgtttgaatatcaccagcaatatggatattccagtactgtgtctccactgtacctttatcgatgtatttcatactcatctccaattatagcactaaaaatctcactttcccaactcttctatgattctttttattgaatcatggttttccagacataaagtactgaaatttctacctgttttttcatttagttcgctgatttcaagcataagatatccatatgtaatatcttgaaccctacttcgttttacccttgagtacagcttgattggtactgatacacgagtattcaaaaagaattctggcaaatcataacgatataccaggtattcattcttgtaacgtttacgactgtacgattcgaaacactgcggataacgtctatcaaacatactacttcttagttgaagtatgattggatctaacttatgtgagtaatattttttgattattttatcaaatctttttacatgtcgtttacgccatctcatgttctaactcctttcaataatacaataggaaaatactgtgtatctgtatcagaaatactattacagtactcaataatttcttgatggagtgtgtttatataaatgctaggatatggaattggtgtttgtattagtccagaactataaacacaatcagttctttgacaatcaatatagtgtgttgttggtatatctttaccacgttcctcaactacaattgagtacgagtcagcaataaaaatgaacgcattgttaattgatacatattgtagggaatacacatcatcatgaacttcaatcaaaggaccatcaaaattcatcaataccgaacgacgatatcctaacacatcactcattgcatcgaactgttcttgtgatgaaagataacaaaaacacgtatcacgacatacgtcaataaaacgcttaaatgtttctgtttctataagcatataattttccttaaaaaagaccccacatagtgaggtcaaatacatttaatcgttatcatcatccaatgcgtcacggtaaacataataaacatgtgcacctagcagagcaataagtacaataaagattaaccagaatggtacaaaatgcagtactagtgaaaacgccagtactgtaataaccattacaactgaactgaaaataagacttactgctttttcaaatccagatagtaattttttaaagatttttttcataaatgaatcaaccatttttaatcctcaagaaagtatgcttacattttagtttattaccatagaatgaaataggaacattaaacatttcaatcttatcttctttcaacaaacgtagaatatcaggatcgttttttgtttgaatgcaatgaagaccattaacctgaatttctaaacctttctttagatattcataaattttttgacgacgcatcccaccataactatcattatgtaccacatcacgtaattctttatattcttgcttcaatgctcggtctacaagtgttccatctttcttcctgatctctgcaatacatttatattgatttgaacctctaagagccatgttgtacctcattagggtattttttcatcaattcgtgtaaacgctgaatctcttgttctttttttctatcactctcgtattttcgagaaagtttcttttttgtatttgcttcttctaatctaatatcagtacagaatttgtcatttttaaaaaaattgatacgcaatgcatcgaaaacagacttgaaatcgtttcctaattctttagacgtgtcagtgtaattatgaaaatacatgttatttgtcatatttacatgttcaattactgcaccattatgagttacgataaacattatatctccatactgttcacgtggttctgtacgatatagatatatatgttgacgtaaataatcttttaattcatgttcaatgccactttgttcataactttgatatactaaaacctcaccatcagttgaactgttgtcagattcatatggttcgcggataattataagattatacatattactccttataccggagatacggtactcaacattagtaaagctgtattttcatcaatttcatgatagttgtcgcatacaagtgtttccaacaaatcaggatgataataataatgttcataatcagtatcattaggaatatgatgatatacaaatacaatatcaaaaacatcatcatcattttcactcttgaaacgctttaattcatcgacactttcaacaaagccatattcttcaaaagcagttgtaccatctggtagtttcatccatgcacttgcaacaattttcataaatttgtgaatccttattattttgtaatgtttagtttagaaacgaagtattctttggcttcttcatatgtcattgaagtatacataggattccatttatcgtcaagatcagtaagtactttaacttccattacatcttctggtgtatagaattgccatgtattgtgatctggctcatagttagggtccagtacaaaaaccgtaccatcctgaccataaacttctccatcctctaatagctcacggaagaaatcttctccagtagttgggtcttcgtatgcattataaaaacgaaaaactacattctcaacatcagttcgggtagtaccatcttcttcatcatattctaccaaacggtcctgatgaaatactaggtcaatagcaccaatgcgaggtttattatgtggagttttgatttcttgctgggaattataatcaatacgttcagtactgatgaatactccactaggggtaatttcaataccagacacattttctggtgaatagtaagcgtcacacatgtcatcaatgtgcatgtgctcatgatacacttccatttcaggattctgcaacaacagtgctgctaagtcttttgctttcaatcttcaatctccatagaattatcatcatcataatcatcactggtgtacttagtttttacctcaataccattctcatgtagatatgtgataaaaccattaccataaacgaattgattataatatgtattttcttctacatgtgcatcataatcatcttcataatatgtgggtattgtaacatcatgacctacactttgcaagtactggaacaattctttcagtactacttcgatatcaccttcttctgtaccataacaataagcaggttcaccgtgagtgaatttgaaacctttacaggaaactgtataaatgtcactcatttgtataccacaatcatcacattcatgtatagaacaatgctggtggaatttaatctttttgatttgcatttaaaaaatcctgtaaagatgtagtagacattggactatcagcaccatcataccacagtgatgtatatggctgaactgaactaatatcaatacagaacccttcacgctcacattttcgagcgaattcttcagtagttagtttgttaccaaaagaaatctcaaattcataactagacatatcaatatcagtactgtaaatcaatgcaccatcatatgtaatatggagtttagaatctgcgtcaaaaagacgatctgaaatagcttcataatcatcttcaggaactgcttcaataagacgtgccattagtccagatgttacgcggtaatcactcatgttcaacctcttttatttttcaattttatcaatcatagaaggtgatacttttacattgaattcagaatcaggaaaatctttagaaaatgattcattttgttcttgtgaaagttcttttttctgtggaaataacattttggctaaatttttaccacattcaattgcttcatcatatgacatattttcccatgtttcatgccaagtattaggatcatattctgtcagtactgaaatgaaatcaatatcatcagatgtataacaaacagcatattgattagagaattgtgttgatttatttttacctaataaaacaattggcttttcataaggaatgttaaataccaacccatattctaagctaagaacagtttgaatatgtgaaccctccaattttggagtaatagtaccatccttaaagaaaatttgcacatgacccaagaggggggtttcgtatggtgtaagtacattttcagaaactgatgtaggttttaccgttgtgaaaataccagatggtgtaaccattaatctattatcaaaattctgataatgcaagtcactctctgcatcataatgataaatttctagatttggttgagatagtagtaattttgctaactcatgcgatttcatattatttctccaaaagaaaaggagagtcatagcgactctccatatagtttattgtaaaactttaagtttgtaaagtgttccttcaacaaaactcataatatcttctaatgtgtttacactgccgtaatcacccgattcttcaagcatatcatgaattgctctgcattgctcaacatattcttcaagaattggtacacaatcttcaattggtgtaaaacgataactattaccagtcccaacttgcaaagcaccacgattattcatgataccttcaacaaatgcgtctacatattctggtaattctttatatagttcatctaattgtaaatgctttgtataaaaatgacattgtaagtgccagttatgtgcagcagaacttaaaaacaaactattttcaataaaagttaatagtacttcatcatatgaattatcttcttcagtacttccgataaagtccattacgtgtcgtaaatcattaatatcttccataatatctctccttagagttattctcttattatttagttaataataaaggtaatttcaggattcatttccgaaactgcattgcgtttacttctatcccatagtattctgttattatacaaagaagaatcacatactacaagtaagcaatttcttaatctacttacagtactttgattatttaaatcagtttctgaaataaaaaatacattttcaggaactactaaaggaatagatttatcaaaaaacaaaactacaataggtcttgttgtatgaactgatttaacgaaatccaaaatactattataaaaattagtttctttagtaattactgacggatctttaattcttttcaaatattgctgtggtaattgatgttcgtcttttatctgaaactcaaaatattctttgaataacatttgtgttaattcggatttatcggatattttcgttgtgttactcattcacttcgttctctcgtaactcaagaagtcactgcgtttacttcgtaaactagttccttctgaaaatgataatgtactttaaaaacttgacgggatttgttgaggactattacatccccccgcaggggaatgaaggtaataaaaaagagacaattaagtctctcttgacgatgatggcatcggatattatcgaattgcgaatttctcaaattttggacggatctttcttgtaccaaaatttagagagcgaaagcgggttgctcggtttctctctatcgcagtcatatgcaacggtcgctggtcttttcatcaacagcactcagtactaactctattcgatcaaagtagtacttgttctcaaattttggacgcaactttcttgtaaaaattgcgtccgctattcttgaactcccttagcaaatctggtaaggtgcgaaccttatacatctatctaggaactctctgtatgcttatcggagttctttatacagccgtgtcgccgtgattcgtggtcttacatcgtgtttgtttgaatgccagtactctaacaggtttcttctgctgttcgctacaacggtaaagctcatctatcctttacattttcaagagaagtaggttctcagtgtccatttttcaatgtccgttgtcattttctatatacattatatcattggaacatataatgtcccattacatgtatactttttttaaatccttagaacaacgatcaaaaattgtgtttatgaattcaacatcttcgataatattcgaatcgttagcaacattttcatttcttgtcgtgttcctatatgtgtgttcaggatgattgtataccaccttgactacattatttaggtctataaaatttgacgttttttgcgtataggaagcctgaagcttgatgagtttaccatcattctcaagattggttttatgaattagttcttcaatgccagttaaatggctatagctatctttttcttttacaaaagtaatagtaataagaactgctttctcatctcccatatcggaaatgttttttacagcactgataatttctaagtttgaaaaatctaattctttaagcattttacaaatatttccacaaagttcgataagtgataatttcttctctggtaacagaaacttcattgcacttaacaccatcagtttcagtactgaatggttgtactggtctatcttctgttaaacctcgttcataagtacaatgataaaacttatttgtgctcatgtcaagaaatacgagatcaaattcttcagtccaccttctgtgccctttgctttcattgcagatgattttatattttacatctggtttaaaagtttcagtactgtcatcccatgcaccatagtcagtatattcatcattttcatctaactctgctagatgccacattaattgtggtaaaaagattttagatttcatttattttctccaaaaaaaaggacttgaatactcaagtccctataatatcatatcaatcatgtttattcaatttcttctgttcttttttcaaagctttcatatgacgaccaaactctcgaacatgccatagatgatcggtttcccataattcttgacgtaacctacgttcttctagtagtttcgacttgtcaatgttatttttctttttttgtacattaaagaaattattcatatgttcttggagaagattacgacctttaactttctcaagaaactcatcaactgtttcagttttattcgaacgtagttgattacatctggagcacatagtattaaagtttgactctaaatcaggtccacccttagatgccagatgattatggtcaactgtcattaaaacttcataaagaccacatacagcatatacatttaaatgtggtttaccatatactggatcagaacataatgaacgttcaatgcgtacttcagtagcttcaatcccacatgccacgcattttggattcttaacaaaagtaagaactttttgtgggaaatatcgaaaagtaataccatttaaagtgtagcgtttcatcttagtacttcgttgatttaattcgtcaagaagtgataattttgtcgtatagtaaacatgatatttgttcattttattccttgatattgattttaatatctttaccttgtaaatcacgaatagttttaatcaatgcgtcgtgttttaaagcacattcattgtagactgcatcccaacgagtaagtactttaagaatttctgcaccatcataacctttaaaaccatttttgtcaatcataattttttgtggtagaggtgtatcatcatcacatctttctaacagaatttcttgtttaattggtgcgggggattgtagttttacttgctcggcacacccacttataattaaaaaagaaatcattggaactaataattttttcatttgaatttattcctcgctgcttgagaattttgttttagttcattcagtacttttacaccatcttcatctaaacatacattcttataaacttcacgttctacaataaaaggaacctttgtttcaataactttagcattatcttccatgatttttttagtttcaaggtaattttttgcattttcttgttgcattttatccaaggcggtatcaacttttttagctatttgttgctctatgctttgttgatatccactgtaataagtattagcttcccaaccagcataagctgaaccgccaattaataatacaaaagaaattggtttccaaaatggaataagaatttttgaaacaattatttctaacatactcataataatatctcctatagttgatgatattatttagagtatacaattgtatagttttacaacattttttgaatatgttctactagttcatacagcttcgtttcattattctcgaacttttcatcaacttcaacattgaatttttcttctagttccatgaccatttcaatccaatcaagccaatcaaaattgaatttttcttcgacttccaatttagtaagattgaagttcgctgatacctcattctctgatgtatcacagtaacgagtagtgatgaatttgacaatttctttttcaacatcgtttaattcacgagtttgatattcgggctgaagataccaccattctcccttattaatagattccaattcttgtttgatttcatgcattactttataacggtcagtacttttatcaatagaatttacttcttggttcaatacatgtagtgcatttttaatacgttcatttaacattttatcaccttataaaaaagagaactccatatgaagttctctgattatacataattactttttctatgtcaagttataaatcacggaaacgatttggtgtgtttaagcggtacattgagtataatcccaatccacgcataatctcacctgcccagaaaccaaaaaacataccattatcagtaccttctctaactgctggactccatgaaccattcattggtgaacctggatttacaataacataattcttttgaagttcgagaactaagttatcagcgagtgttgttagaccttctattttacatccagccaatccagcagcacaagccccagctaaccacaacccacacatatgacctgtaaagtcccaatctggaccttcaactgtgccatctttattgaagattgttggtgaacgaccatcattatctttttgaaattgaattaaaaagtgaatccaattctcacaaaattcaacaagatctgctggtggttcaattcctctctctgcgagttcttgccatgctctggcagccccaaagaacgcacgtggttcatacccactccatgcttgatcaccccaatgtagcatagtaaatgtatctggttcaccatattttaagttatcccagcggttccaaacatatgcttgtgcacacggaccaacagtaccgaattgttgagtaaaccatgtttgggaatctttcataaagcttaacatgtttcctaagcgtgtgttatctactggctgatctttaaaacaatatatcacaggatattgataacctggatacggtaaaccacgccatcctgaatactgattcgcatacgggtcagtgatgttagaaaatggtattgttcctggtgtgtaatgcaatgagtttaacaaataatctttgattacacaatcccctaactgtgcagtatatggtgattcacctgcaattgttattgaaaatgtcatagtatagtcatcaccgtcagcatccgtgtataattctggaatgtcattaatacaataccaatcaattattgcagcaacaccatctactggggttgtatcaggtaaaatagtaatatcttctagttcactataaactggtgcatatggtcttgggtcagaacttggatgatttggctgatacccagataaacgtaatgtatctgaacttagtgtgattgtagtccattccccgtgtgttgcaggaatcatccaccaccatctccaaccattatcatctacaattcttatattgtaatcatcttcatatgaacgataggtaaaagatttaacttcagacttatttgttgctaatagccaaaatccaataacagcaccatcatcttcaccacaaactaactgattaatggtatcgcggcgtgtaactaatatatcagtactatatatcatttcggacgtagctgcaccataaggaacaacaattctactatcagcaattatataaggggaaccatctgctttcttttctctaacaaatgcacttaaaggtgttaatgaatgtgtgatattttggtctttactttccggtaagccacaacgataacgaacaacatcatggtcattttttgtttttgacaattccagtactggtttaaatgataacggcttaccatcatcacatacaccaccatagtctacaagtaatttagaatcagcattgaccctgaaccaaatagcttgttgttccatagtactttgtgcactttggtcttgcctgatagtaatatatcctagagaatttctaccaaacttagcaatagcatcactaggataaaaatattcataggaaataccatcagtgaatggtgtggttacaattgtactttgtctgaaaaatttatctctggagtcaatatcaccataagcataacacgttagtagtgaacatttccaacccaaataatgttttctttcttttgttattttatataacaaataagaagcatcactaaaccataattctgcatctgatgcgttatcagcaaattccaaatcaattggaacatgaagagggcggttgtgttgcatttcatttcgttgaattatcacaccaccatattctactggttgacgatttgcaaaatttaatttatatacaccattaattgttgtattctttaattgaacagttcctttttcagattcgtcaaaaccttctgctaaaatattaccatcccagtcgatttttctacccatgaaatcgataatccagtcaacatcatattgttcacctggtgtatcccaatcaacactaccatctggtaataatgcttttactgacgcatttatttggttccatgctaaagcacctttgaatgcaaatgttactttatccaagaactgaccataataaggtgcaccatgtggtattttacattgtccatttgtaaatgtaaattctacacccttgaaaccaccatgtgtaggccatccatcatcagctaaaggccagttagccaaaatcggttctttggcattaactatccagttacattgcagtggggttggtgggtctggtaattcacgcccagcataaaagtactgatgatatgcatcccagtaccatttggctttatctaaaaacattggatcatttgttgccagatacgcataaatgtatcctaaaattaatagactttgaccttctgttgtcccgtcaccgtttggttgaccttccattgcagaatagttaataaaatgacggttgttcgccaaaacaccctgattattcaccacataatgttgtactgttgggtctattgtatcaccagtatttctttcaataaatttgtgatgcccataaagaagttgtacaatattatcaatattattgtttaacatatcatactcctgctctaattaatgcaccgtaccatgtaactcctttatcatatgtttctaatgaaataatatctttttcgccaatttcataagaaagaacaactggtctgttatatgaccatttaacattagaaccccaattaactaggtttgaacctgtttgttgtgttaataggatggtaattgaataaacttcagtaggagccgcaccaatcgaaatagtagtatttctatcagataaattaatattaaaaacagcattacccgacagtggattaattaaaatgttattagaacttagtacattatataacttattacttgcactatcatataatgttacccattctgtttcatgattctcgttagtagatttagcttttatcttaacattattttcagaatcagtcattccagtccatccagatataataaaagaactgtttttattagttccgaatgatgcaatcacagaatcactaagagaactatcttcaccatcaatagatccgagtactgacaatgttaaaaccatcatttttaatgtctacaccagttgcacctgaaaaattattttgaaatttaataactccggtagtgtggatatctgtgaaaatttgttgtgccatacttaatccttgtgttaatttatattgagtatttattgagtgtaatggcatttttagtaccattacacttgtatatgttacttataccattgcatttctctaatatcaatgataatttttgatgctaacttgatgtttggttttttaggaagtactgatttcttatatagaacatcacgaatgtattgtactttatcatcgaaatattctaatacttcttcatacttccatttaccattacgaatatccatcaacatttgtgcatctggtcgtttaacttgaataattccactttgtaatgcttcttctgcactattcaaaagtcggattgtgtgcatagcatgtttacaatcgtatccgtgttgtgattctaaaatagcacgtttggcattacgattttctttccatttatgataacttttcctattctcactattttcctgatattctttttcgttaaatttgacaattagttctggtttagttttcaactcttcagtactacgctctttagaaaaataacgcaatgatccatcaccgttgatagtgctttcattcggatttttaataatcgcaaaaatgttttctccgtaatgaattagttcatagccattattaaaattcaataaattgaaatcacgatctagaattttgtcagtagtgtagttatgcactaattttacaaaatgatattgctttaatggatttttcgaaactaactgcaatgacgtatcacgcatatatttttcaaaatcaatctttttagcattaaatggatgtaagttcgatgtatctaaacgttcaacaagatattgtggaaatgaatcatacatccacgcaagaacctcatcgactaggtgttcttctaaaatctcatttaaacgtttttcagcaatacgctctttatccatccaaccgtggtgatttgtcatacgcttaatctgattatatgcatatccagtatatgaaaatgcaatcttagaactaagaagtttttggttaaatgaacgaagatagtcataaatctcagtactttctacaatgtgttctggttcgacccatagtgattccaatatattagggttggcttcagtgtataattttaaatactgatttaactcatagaatttagtatcttcttcatttttatcagctacttctttgaccttatagaatggcgtaagaataaattctttattagcaagaaaaataccacgataatcagtatcactttcaggtgtactggttccgtaggcttgtgacccagccaagtgtttcactattgtttgttcaacatattggttattcatagataaattgttaactcctttaagaaaccgttataataacgattaaagtcatgttctaatgttttataatcatcaaaactaaaacctaaattgataattgtatcttcttgaaagaaagtttcttcattcatacattcaattggttcgtaattaattccacctttaaaaacttttgtaaaaaatattccatcattattaatttcaacatacataaaattattttctgggtcacgagggcagacgatattcagtgaactatttccactcgtgttgtactcataagaaattatatcaaaagaatcaataccataacacttagatttttctttatcaccaaatacttttctatctgtactcatattgcgtatagtgctgtagatatcatcaactgtagtcatcgttaaccaccatactttgacttgtatgtttcaagtgataaagaaatacgattttgctttttaattctttcatcaatatcctttgaattcttcacacttcggtatacgtcagctagtaaattataatcttctttatttgagctatgctgtgcccaacctatctctgttttaatacgaacatttgctttatttgacgagtaaaagaaactgaatccattggacccatcaaaaatatcaaaagtatctacccaatcaccataaggaaagctcattggaactgactcatggtctattgtgatatccgataaattttttgaacagtacttcgcaaagtgataaacgattggatcacattttgataattcgtatttgtattcaatgatagtttttctattagcatcattgatagcatattcttttatcaatggactttttttgatgataagagtccatagaaacgattctaatcctgtttcatcaactttttgtttctttttgaaaaatgaaatcatttatataaacccttaattttctgtctattatgtatatcattttgctggattttcaatttagtaaggttgtttcttacaccttcaacaccacgcattatttgtaacataattagtgattcgtcatatgttaggacattgctattattatcgatatatactttcactccactttcaagataatcattttctttggagttaaagtttctaataacaaacttaacgccatttgatgcatcactgaaaacatatcgttccgcaccgtagaatgtttttccacgaaataaaccgccgtcttcccacttccaacgactagattcataatcattaacgtaatcaatgattaaagaaagtaaagggtgtttgctcaatttatattttgcatctaacaggatacgtctatcattatctgtggtgataatatcctttagtgagtagcttttagatataattttaaagataatttcatgccaaattaaagtactgttttgttttccaactgatccaaaaaacatatccattcctcattagtataaatcagtaatgtctttgtatgcattaatctgtttttgttgtaatgaaagttcattgagtttagttaccattttatctacaccaacacgtgtatagaaaataataaatgaatctaaattgcctagagtaattcttgaactgtaatttgaaagttttcttgcataaacataaatttcttcttcacttggtaaacgtttctcaatctgcaagatttcctcaccattcggctcataatcgatttcaaattcaactcccatcactgtgtcttgaatgcgatccgtatatgaaccaccgtaaaaatactctcttggtttggatctccaacgaggactaaatgggtcagttgtgtattcttttacaaatttgtaaaaggacattttactgagcatatacttcatctcaattagtgctttgcggtcatcatcagttttaaactctgctttgagcgatggacttttacacagtaactgaactaaattgttgtacatctttaatgtacgttgttctttcatttctttgattttatgacgttttggtggtggtagcaaagatttaaccataatttcctcctatttttattcaattatacacataaaagaaaagcccgtcaatagacgagctttaaaattatttccaacgtgtgcctgacccagacggtacaccagtactggcaggtatcgctgaaccacgtttcgttgtacttgggcgatatgtcaaaaaacgagtcactttttcagtatcaatcgaagtaattcctgaagttccagtaactatcttaccaatgtaagtgctagttaaagattcatcaatagtttcagtactaataacatatgaagctttcttagtattcctgttcatttgtatatacaaatagaacgtagtattagctggattattttttacagtacttaaatctacactttgtataggtagtctgtcgaaaattccacctaaaaataccggaacttcacgtgtaaagtacactgagaatccttgtgcaacgtcttgtgatactaccacaatcttttctttaacgctaccatttccgctaattaaaccatccatttcagcagatgttgtaccaaaaacgctgaatacagatttggtttgatagtcagaatcttgaaaattgtaatatccaaaaccaacaccaggaataacaccatgttgatatgctgcaccgagttggatgtaactagatgataaaaaacgatttgatgttatgacaccatttactgttttagctatcatcatcttaaattgtgcattacctggttgtgaaaattgatgaactgcatcaacaccaatataaccaaatcctgaatatttagcaactgttagaccagtacaacgtttcatatatgcttcagtaataattcctgtaacagaactaagtgtctcatatctagtacttaccaatgtagctgaagttatgttagatccagataatacaacatcaacttcggcatagattgcataaccttggttattgttaagattatatgctgaaactactgcaatggatttagaaaaagtattatcaggtacataatataatacaatttgtccagatagtgtaccaacaatgccagagtttcctagattagcaaaaatatcttgttttaatgattctaataccgttggttctattgtatatgtttcatcaaattctaaagtatctgggtttaataatccaccacttgttttatatacaccttcaatgaatgatgttccataacatctaacactaccatcggtatcaacaagagaaatcatagcagtgtatgtaaaatcatcacctatttgtttacgattagattgtggtgcaaaaccatttaatgtagtattattttgaactgagttatattgatatgttggttgtgagcctatttcagaaaaaacagtattattataattatatgttacatcatcatacgtaccagaacatgctaataatatttttctattatcgatgaaacgtacacctaataggtttgcaccaacagcactaccaaaaactggtaaaacgtttgcatttataacgttacttgcggatctagtactagcaacccatgaatcaaacggtgtaccactaaccttatatcgttgtagaccataaaattcagttgaactccatctaaatttagatgcaaatactaaaccatctttggtttgacataaaccacctgcgtttcctaatacaccagcagcagttgtcccagtaaagttgaccatattgatttcaaatgggttagaaacttgaaatccattatcatatgaaactgtagcaggagcacgagcagaaccatctagtgacatagattttgagtttatattataaacaaaactgataccagtaccatacactgttgaaatatataaaggtgtaaccattctatgggttgggtataaagttacacgtattttggataaatcagtactaacgtttgcttgtatattaaagtctgtataatccgaaaattctacacgtgagactggtgatgtaacttcgaataatgaatccgagctagtaccaacactatataatctatcaaacactcttatgttattagatgcagaataacttgtatttcgaacagtttgccctgataatccagtaacttttgttaatgatgccattgagcttgctttcacatcacttagctctactgtataaattgaaagtgctaatcctaaattagaaacacttttatctttacaccaaatatatacttttgttccaacaatatgagtatatataggcatatcattaccaaaagaagtacttggtactttagcatgaatatgtgatacttcgttgaatgtaccattagttatagtaaaaatataattatcttctgtacttaaacatccaagcatttcataaccattagagccaataaaatacttaatattctctgtactactcataattgaaggtttatacattgaattggttgaaataacactttcttgtgaaatcatggttatatttctgatttctcgtataaatgaataataaaaacctttagtactaccattggttccgctacgcagaacaacggcggttccatcatcttcaataattgttggctgaactacttggtcacttgacataggtgtagcaccttcatacgacccacttacgtttaatggcaagtaatccatttctcctacacgtgatataggcaacatatctaaaatactttgaacttctgaacgcttatatattggatattgaacaattccagtattggcattcggtgaggttccattaaaagtacgcatagcgtacctttgtccaattgccaagttcccaaggatctcggcacttcctataattcgttttgatgacatctttcttttccttaatttaccaaccaattgtaccagtttctgatggttttccagtactgactgggaatgaagaacctttttgtgtaacactaggtctatatgtactaaatctggatactttattaatgtttatatttgtaataccacttgtaccaacggtcagtgttccaataaacattataatttcagattcttgtatttgtgttggtgatattttataaattggttcaccgagaactaacgttgcatatacatattgtgtttgtgttccagatgaaacagttgaagcaaaaatagaaactgctggaaatttataaagataaccaccaataaatgatggtatctgtctattaaatgtaagactatagcctgatgaagtaatatttagactagcgtcatcatacaattctccgtattgtgtaagtggtaatccattgacaataaagttaacttcatctttggtaatagaggggaatgtacattccccatttgaatttgttgggtaataagtcatattattacctaatacaccaagtccagtacttttaccctgtactgtaacttgttgcattgccttaaggtctgctcttattttaaatgccattatgtaatcctttaccagtttatggttcctgtttgtgatggtagaccgtagctaactgggaacgatgaacctgctgattcaagtgaagcaccaaatatatctaaacgtgaacgtttttgtatattaatagtttcgatttgaattgcgttagtttgaatagtacctatccaaaaaatattatatgcagttgttcctgtttcggaaataacatcagtagttatgtagtagtttgccaacccttgttctaatttaacatatacataaaatgttgtatttgctggattagattttatagttctcaaatcaatatttgaaactggtagtgtaaaagacttacctgatagtataactggtgtttcctctgtaaaataaacaataaacccttgagcaacgtcttgtgatactacgttaattgggctaccttgtggagtccagttattatagtcggctatcgttgttccatatttttgaaatgacattttatttgtataatccagtggatcaaaaataccaaatccaataccaggcaacgcagtgggttgtcttccttgttcataactggcatgagaaccagtaataacaaaacttgtaaattgtgcagttgatttagttacatatgctctaaattgatgagttgctgtatttcctattgttggatgtgttaatgggtcagaaccaccaatgaagtagaatgaaccaccatcataaattgttaacccaacagaagaagatgcaatcgaaccattaccattaggtgtaaagttttcaccatatgtattttctagtactaaacgcttaaaggtaatagatgttatatttccaactctagtattaacgttaacttcagcaattctaatatagtttttatagtcatttgttatagtactcaacataacaaaagccggaatgtcagtttgttgtggaacaaataatgtcatatcacgataagcttgtgaagataagttccagtcacttagaactttagcatattctgtatttctaaagttatctagaactgattgtgtaacactaataacaccagtaccatttaagtttttatcatatgaaaatgattgtgaataacgttgaccaaccataaaaataccgccattagttgttacagttgaacctgaaatactactaatgaaaattctattattggcattatcatctacataaccacgttcagttgtaggttcataaccttgtatggttcctaaagataatgatttaaatgtaaaattaggagtacttttatgaactgcatatgatggtctaaacccaccactaccagacgcacgtgaatattgtttagtactattatctggtaacaactccacaccattaataaatgaaccaactgctgaaccaaaggatggtctaacaactccacctttaaaatcagttgattgtactgcacgaacgttaatcatactataaacaatttgtataggaaactttgctttttgcataagtaatggttctgctaagtttggacacacagtacaaaaagcttcacctgaacttaagtaaaaataagaactataaatgtttcttgcattagcatgattatataatggatcattatttaaaacgttacctgtaggcactaatgcagaaccagtattggttataaccaatggtgcttgatatgaacctatgtcattcccagcgtctagggtgcattgtttagtactcatattaaatgcaaagctgtagctatgttgtggtcgggcattatatgtcgccattgtaaaccatgcatcaccattcattctaaaacgaaagttctgtgttcctggttgctgtgcaacatacaaatcaatggatgtcatataaatcccaataccacgtaggttttgtggtacatacacataaggcttatctgctatattagttgaagttacttgattagtaataaccatgttattctgtgcagaataagttgtattatagaatgtttttgtagtccatcctgtaatacgagttgccgtatatgttccattgctaatattatatacaactcggacaacaactaactgtagttggttattttcattaagaacactaaagacatagattgaaccatcttcagccatcattgcaaattctataccaccttcagggcaaatatctgcttgatttacaaaaaaaccagtatgtaatttatcatctaatgtaccattagtaatagaaataaacaatccattagtactgttagaagtgtctacatatctaccgagtaaaatatttggatcagtattgtataagccaattgcgacgcgatttgaaccgaaaaaaccaggcttgtattgacgactggtgttaattgtacggctcatgtcatcaactgataatgcgttagccaaatatgaataatataatccctcaacactaccgtttgtaccactacgtaataatacgagtgtaccatcgttttctaataaaattttatttctacgttgggactggttttcagatgcaccattgaaatcaccagatacaccagcaggaagatagttttgtgacccataatgggaaattggcatcatactgacgatatctagtacttcatctcttgaataagtatctagctccatattgccattagcatcaaatacttgatcattgataccttgtattgttcttttaccattaactgtcacattatgtgtgacatccaagccaccatatattttctttgacattatatatcccttataaattagatattagttaatgtatttatatacataacaaaaaagcacccaatgggtgcttatgttaaaaatctttatttttatatagtattctttgattatttgaaccacggaaaggtaattttaaattcttttcggactcgataaacttaccatcaactaatacatctaagtactgaagtatatctttagcatgatttttcataatctcatctaaagtatacccactccagcaccaaatagttttactaggataagtttctttaactactttgcatagatttaaaacttcatctatattctttttcattaatggatcgccgcctagaagtgacaaaccactaacatatggtttttttagttcctgtagtataatctcaactgtttcagtactgaactcttgtccacttcggtagtcccatgcttcttcattgaagcaaccatcacatccgtgcgaacacccactaacaaataaagagcagcgaacgccctctccatttactaaatcatccttgattatcgtctggtaattcatctaatattgcactcactatttcgacaagaacatcgccgtgacatgatttgggtttacagaaacaaccaaggcgtttccctgcgagttcaagtaattcatcaatcttaacttctccacaagaaatacgttcaataatgtattctctgaatttttcaattgattcttctcttgtactaacaatgaattcggctttagtttgtttatctttaatatgggtaaatgggtttccccatttagacccacgtccaatatacacatcatacggttctttgtatttgttaaccacaattggctttaaatccataatttaccttatttgtgctgaatacgctcacaacactcttgttgtttgcctttattgaatccacgcgaagaaggattacccaagtaaccagaaacacgacgaatcactgagattgtcttctcattacgattatcacataccggacagtggaaaccatgtttatctacactgaactcaccctggaagccacattcataacaatggtcaactggttggttaataccaaaatatggtatcttcgtgtaagcatagttaactaatgtttcaagtgcttgaatgttgtttgctaagtttggagattcaacataactgatgtttccaccgttacttaggtaagcaaagccttcttcataactccatttatcaaatggagaactttctacccatactggttgatggaaggaatttgtgatgtaatcacgttttagtactgaaggatattttgcttcaatacaacgtgcaaatttataacaaagtgactctgctggagttccatatagactaaaagctatattactctcttttttgaactcatcgcattttactttcatataattcagtactgacatacaaaactccttactgatagaaccagtgaggatttctgaacattcaacaagtccaacataaccaatactaatactagcataaccattgtaaaatagcttgtcaatggtttcttctgcacctaaacgtgctaatgcaccttccatgaacaaaattggattttgctttgctttagtgccttttaaacgctctacgcggttcatctgagcacgatatgcaatattcatatgctcgtctatcttatcaaaaaactctccgtcagaagtactctcaagagcaattagaggtaaattgatagaaaccacacctaaattgaaacgaccgttgtattgttcatttccatttgaatcttcccattttcctaagaatgaacgacagcccatcggtgttacagcagtactactacttccagtcactttgtgatttaatggtactgaaacaaagtcagggtagattcgttttgatgcacaacgcatagctaactgtttaaggtcataattactatcgttggtattcatgtttataccatcttgtaaaaagaaaattactttaggaaacactggagtaatcttatctttacctaaaccattctcatggacttttaagtactgttcagtgattaatttgccaaatttagaagtgttaagacctaaactaagagaaataaatgcagcttgaccattagtactaatcattgaattagtttggtaaagtaatgtttggcagccatcatacacttctttacgtagttcttcttcaatgaattcatcacttagattatatttcttttgtttttctaacagcttatcccatgacttttgaacgtaaggttctaatccgacatcaatgtgagccaaagattgaccaccatactgggaactggcaacagcttggacaatttgtgtcagtactgtgcaagctacactgaaactttttggttcttcaattttagcacaaccaatagtgaagccgtttttaagcatatcaggatagttaaccaagcaacaattggtcaatgggctaatatagtaatctaaatcatgaatatgaccatatccatcattatgccattgcattaactcggtgggaataacatcttgtgaataatgcttagatagaatacctgctagtaaatctctatgtgtattgacgcattttgcatctttattagcgttttcattagtaagatcagtattactctgatttaggaaatttgttacatcggtatataatttatctaattgcattgtacattccttgtattttgaaatcatctgggggtgaagatatttaatatcaccagacaacattatagcgtcagaacaggttatttctcttgacctatatcaaggaaaagtcacattgctttttatttgcacaaatagaaaaagcaccacaagggtgcttttaaagtactgctaatataacaactgcccaaattagcagtaatacattggttggtgcggaaaaaagcatatatgcagcaagtgcactgcaacctatgacaagtttagctagtctcatctggactccatgtaatagttactgtgaacgtcccttcttgaaaaccaaactcatcttgtgggatttgttcagctaatgggttaaatcttgaatcgaaggcttcatgcacatctctctgaatatcatagagactttcaccatcgtattcttttttaaagatttcattctgcattgatacgtaacgaccctcgtattctgtctggatagccatcaaatagttcaataagttggtttaacgcataagaactgaagaatggattattctttgcaatttctattcgtttttcaatatccattaatataatctctggtctactgaaattacctttacgtctatatgttagtaaacgctctttgtgtccgttgaactgaaattcaaaatatgttgatgatgtataatcacttccatcaggaatcggaattgagaaatcaacattgtacttataaccaaatgcaaaaaaataaccaccatcttcgaacggtatagttgtatcatttaggtggaaatctatttcatctcctaatatatcaaatatcttggtacttagagacataaaatcatcggctaacattttttttaccttattttataactcgacagtagtactgaataatgtaaggaaataatggattattcacgtatgtagcgaaattagctattgtaacttttttatagtacgaattatgaattgttataagagtgtggggatctattgattctctattagagagttcaacataacgcccacacttcatataagccttaccataataatcgtaaattatgtcatatttttccatttattctggatctttgtttttatcaactgtgttgtttttattcaaatcaatttgtaaagccattgcagcttcagcattttcttcatgtgtgccattgaatttatacccattcttaatgagattcactgtgtagtacttattgtaaagaaatgcccacacgaccattgcaattgtacccacaatccaaaatgacactgcgttgaggatgaagtaaattacaaatgcaccgatgaacgtaataaagtcaccacgaaacaatgcagggaatggtccaaagaatagtgttgtccatgagaatccaaagaaaccatctttgcgttgtcctacattttcattttttaaagaaatagttttagccattttaatctcctacttattatttgggtttggtatacagtacacatatactagattactaaagtgttcagtactggaatattttgctaactcagtaatgtgaaagttcttgtcataaaaccttccactattgaatgttgttatttggcaacaatgtataggtctgaaaatataataataaaatatatcattttcaactacaacagtatggtttgtataacgctcgattttcttcatgtgtggataatttccttaaccccgtattccataattgctaatgtgcaaatttcacatggtttggcaggtacaggaataccatctttacttatccgtgcaatcagtaaagtatgaacatcagcacgtgcagctaataagcaagaaatttcagcatggagaaattcaccttgtggacgtccagcacgaattgcaaaacctttctgtactggatgtgtctgtgtataagaatttgtgcgtgttgccagtactcgaccttttttatccagtgcacgagcaatcacacgataccgcttgtagttccctacttgctcaataggtggcatcctgcgtaattcttcaacaagtttctccaatttactattcataagtctaagtctatacccttttcaagtgatttttctagaacccaaagtttacattcttcactctccaaatgtatctttgcctcttgctgttctcctattgtacaagactttatgaatgcacgcaaggcttggattgtattttttaaattttttatgtcatcgatgattttttctttggtttcttcatcgattacacatgaactccaactgtgtcgttcctcccaaactgttttagcgggattatatattgattgtgatgcattgaatgaatgtattttatgaaatttatcatctgcttcctgttgggtataatccccatatgtgttcagaacatttttgtataattcatcaatggcctcttcatacgtatcaccaccacaatccaattgataatcatgtgcttgtacccattcgtcgtcttgctcaatatacattggtgaaagaaattctacccaaaattgagtctttgtattcaatgctttgaaatcttcaattcgatttgtcattggacacacatcatgaggttcaatatcaatcctagctggaaccatatctttgtttatgaatttaggatgacccaaaatccaccagtacttttccgatgtagtcatagtaatctccaattaaaaagtactgcacacgatggcagtactgatgttaaacgtaacgtttctttttataatcataccctactgctttgtaaaagtcaaacaaagaagcatgttcaaatgtaggtaatagatcatatgggtgctgatagttcgcaataccaacaatagccatcattgattcagcagttcttacgttatcactatcccattcatctaaacgccaaagtgagcaaagtacctctcgttcatgttgcttacccagaaagaatccagcttcacggtcacgaaatgcacctacactgacagtacttttgtaccagtctttttcaccatataatggcatacggataatatgtttttctttagcttctccaaagcgatgaagaaatgctacataatcactcataatttataacccattacaggtttggtatgatccggttcgtaagacttttcagtactgaaccctctgaaatttccacgtcctggatttggacaagccatcccttgtattgaatgcttacccttatctttgccacaatttttacatttgtagccaattacttctttcattgtgcatccttcggaacagtattaagacgtttgcgattcacaatcttcctgcacatgaggttaagatcttgcccatgacgcatagtatgacatgcgtatagtgttccttgatgatttagttttgttaaaccttgacggatgatttcagcatccatctcatcaactttaggagcacaaccacagagaataatggatacaaatattgttaatgtaatgaatatatttttcatgatattttttctcatttagtaaaacacgaattattactgataagttcatcaagtactttttgtacttcgatagaattaatatcaactttgtaataattatagtttttaactctaaaatgttcttttgatatatcaactttaaattcaataatatcaagattaccaataaaatcagacttatcagttcttaaatccaaaatacctaattccggtttttgtggtttacataaaatcaaaccaaatttattttcttcaaatgcctgattaaacatatcataataatcactaataacaaatctaatattatcagtgcttaactttcctgattttccttttttataaacagaaacaatgtttagttcaaaggttttaccaaagcgtgtgattttcattttgggctataaccacttttaattttagaaattactttcttctcgaagaacttacgtgcttcttcaatagtttcgaattcttcaccatctgtagtactggttttaccaatagcaccgtactcaataattacttcacacactggagcattcaattcaatattatagaatttgtttgaagaaccgtgaacatattccaaatgtacattatcaggaatgttctgtacataatcatagttcttgaagataatatcaatcatattttcttcgccgcgatcaggaaatagttcagtattattcagtactaaacgctgtgcagcacggaacatatcaaaatattgttcgccttttttcagttcttttgtatcagaacagaaatgaccatagtattctacataatcattccaaggataaattccttcatcagcagtttcagacacgtaagtttcatcttgtggaactttaaaaccacgagtttttggatgagaaattaagcacagtgaaatattatgaccgatatctgaatcatcagtaatactaccaccaaccatatgaacaacatttttaatactttcaaaatctacatcttcaatttcatgatacattaaatgttcttcaatattacttactagtaatgaattaccatttccggcatcgaattcaaaaatgaaaagttctacacaatcttcttctttcatttcaatagtatcactgagtttaatatactcattttttaattgttcaatattttcatgagaaccaaaactataacgtgaactgatataactactaccgtccaaccatcccatatcccaaggttcttctgacatgtattctgagctatagaaatcagtcaaatcatctctctgagtacaaaccgtaagagaacgaacattactaagaccttgaacttcaagattcagtactgtagtattgccaattttttgttcagaaataattttagttttcatttaaaatacctattgaattgatttacgccatttggctagtttaacattcatgtaagtaaggaactcacgttccatctcttctgaactcatattatcgcattacaaagcgaacatgtcaagtgcacaaatgcaaagatctacagcttcacctttgacaccatctttacctgcttctttatatgataacccatcacggatgttcatatttcatatcatcctactttttcgattggaacaatgcaatctgtacgcgtgtgatgaactcacgctctacttcttcagcactgtgtccttcatattgtgtcttgaaaagttccattgcttttagtgccatctgtacagaaatgtctgtaatactttcagtactggtgctttcaaatacgtttttgatggttagttcaccatcacaaacatcatcaactacaactggggtattgttttgttcatcaatgtaacgtaaagctttgtactctgcttttgttagattttcataccaacgtgggtggtggaacaaatcatgcattgtaacttttgctgcttccatgagaagtaatagctcttcatttctgcgaatatgtttttcttcacctttatgatttttgtaagtatatgcacaacgcataatggctaatcgaacttcacctgctttggtgatagtgtatgaatgtattgcattatcataatcactttcccatttctgaccagcatattcgtaccaaagttcattagtttcccatttaatgaaatcaaattctaacaaactgtcaatcaacttagccaaattaccactgtactcacggctaatgatattgaaaccaccattgtactttgcaaggtacagaatcttttcttgagttacatttttcattacatgtaatccttgatgtattttagcagtttagatttctcttcggtacttaatgatttcttgttcattaagtgtttcatttcttgacgttcaatttcttcacatcttttagattcagcttcaattcgtgtattatattcttcgtcagtttcttctctggtccaaattacattgtatccatgaaaaccgccgtaaccactgtctggtgaaagactaatgtgaccgttatattcagcacgatacttattaagagtgtcaataaaggtatcaatgccacacggttcaatttcaatataaccaatcactacagtaacgtcaattttgttcataaagttcacctataaaattagggagcattagctccctttgtattgatgtttacgttttgtactgtatttccagccagtactatgtcttgttctgatatcgtcccaatacgatggtaatgaacgcatcttacgtcttccacgtatatcaggttccccctcatccttcagtactgcacatgccatacgacgctcttgttgagtcttaggacgcttgtatcgggagtggttatgtttgtacatatacgaacgcttatgtcgccattccgtatcacgagctttacgtttatgttcccagtactcattatagagtatcatgtattcacccataagtaaatcaggagatacaagtaatcctttttcagtacaaagataataacccacaaacttttctggaaacatttcgtaatagaaacggttcttccaaaatgtttcacgattctttttgttgaattcagctaaatcgaatttcatcttactgtggaaacggtctataccgtcatgttccgcaatgtactctaacagattatcaataatctcaactttaccagaatcgtgatacaacgtaaatgtttggtcaaaaaacatatgaaatctcctttaagttaaaataacctaatggaaagtcattcttcctttaatacatgttctcatgatttgttccttttgtcaagatatagatataaaaaatccctgccaaaagacagggacgaaaaactgaaataacacatggagttctttttaatttaataaaaagtattattattcttataaaagtatttattaagaactccacaatattgcttcaaatgaatcaaaaacctttctgagctactagttcacggtactgtgcacgagttagtacaccttgcttgcgtagagcttgtagaccggatagggtttcactcttacgttgttcgtacatacgttgttctttggattgaataactttctctttcttaacttttgctactggttcttgtttcttaggttgtttagccattttatatctccttctgtattatgataacaacattatatcatgtatgggacataatgtcccatacaatattacatattttcttcagcaaattcagccagtggtgaacgaacaacaccttctagttcgatgacacgacaacctgcccaatctttaaacttctcagttacatatgtcaaaccactgttaacaggactaataaacttactgtcaatctgactcaagttacccataattactactttacagtttaatcctgctcgtgtcaagattgttttggcttgtgcaggtgtaatgttttggaattcatcaactactagaatagtgttggtgaatgaacgtccacgtacaaagtttagtgctttaaattgaataacattacgtttcataatctcttcaatactaccttgagggttagcatcatctttatgaagaaactctaacgcgtcaattgcggctccacagaatggaatcactttttctgcttctgaacctggcaagaaaccaatatcttcaaactgtgagtcttgagttttagagaagatgattcggtcgtatttacgtttttccagtactaattctaatgcagtagcaatcgtaattagtgttttaccagtaccagcagaacctagcagtactgttagatgtacatcaggatcgagaatactgttgatggcgagtgcttgttggatattctttgctttaatatcccatactttagcacgtaaagctactgattgtccaatatcttggaataccaaaatatcttctggtgttagtgttccatcatcttcctcaattgctgattgaccttcgtacacaaataatacgtctgcatcatcatatagataatcaccgatgcatagattttgtgggagcaaatgctcaatcaagcttttggaaatgtaatgatacaaacgacgaccaacttgttcggattgaatattagtattggttaagttgctatatacttcccaaaaattgatttccaaatggtgttgaccaatgtgaatcaaatcactatcaccaataacaatatcatggcgataatcttgtacctcgacaccataacttagtgctttgatacgcatgttgatatcacgagttaccagtactgattctgttgctaaagctaccagaatgattttatcatcaggtactgtgcttttgagaagggtttgaactttctcttctgaacctttagtacgaattagtgcttcagcttcttcgtttgtaataacaaacaatttgctatcaggattcatattggtatgaacatcagcaatattaacaccagtactactaatctcatcatgtgatgcatctgcaataattgcttcaatgttacgaatagcaacacgagcatcgcgtgaaacatctacattacgactcttaattgaatccaattcttccagtactgtaaatggtagaatgattgcagcaccatcaaaagcaatagatgcattagggtcagatagtagtacgtttgtgtcaattgtatattttttcataaaacatccttgagttatgagtacatccttgtactcgactaatgttattgactcggattattacatatttggttcgtattcaacatagcaacgtgaacctcgaaccttttcttcccagcactcctggtaaacaagttgaccaattgaaactggttctcttgatagtccattacgtacttcaccattttgggttttatacataaatgaacatttggactcgctacattgtcctaaactaacaacttctgcggtattgtagtgaatgttggtacgcttagtgttctcgtgatactgtccgaaccaaagaactcctgcacctaacagaacagtacaaataagacttttgatgtgtgtttgaatcataatgagttaaatccattgtttaagtatgtttcaatattaattttaccaacaggattactactgtgaacaaagtactcaaacggttctttaatattattatcaaacatataatcaataagaaacttagcaaaagaatatccagtcttttcgtcttcgctcacatcacccaagtcatggtcgaatgatacaaatgctggaattccattttcaataacatattcacatgcacttttaaagtcacgacataccaccatatcttggtttggataatatagatttgcatcacgaatatcatccaaaaacattgagtaagacatgttaaactcctatagataactaattagtaagttttctttttgaaccagatactccaattcttgtcttgctgtaccgatgaagttctgtgtcataagattattatatcccgcttctcgattttgtcccttagaataacgagaaatatgacataaatttacaccagcaacttctgcacttgcatgtttagcattagtgtatccatctctaatgtgtttcaactcgtcataggttacttcatagctaaaactgtgactgtttgcacctgggtaaatttcaaaagttttgagtggtcgaagatgggaaacaaaaatattgtaatccatttcttcttgaacttcacgacgcaacgcatcttctagtgagatatcagtactttctacggttccaccacatccaccaagaagaccatcccatcgtaattgcagtaatactaaatttacttctggtatatcattcaactcatagtttttgtaagggttgcattttcttgcaaagaaataacaaaatacaaaatttgcacgtgtgccatattcaccaaagggaacttctttaacactcatttcatacgttccttaattatagtctctagatgcggtattgctttggttgctggcttgataactttttcattaaacaaaaaatcattatcatttttacgaatgttaacattaacactataacatggtaatgctgctgctaatctcgaccataccagtactgtatcgctactaccaattacaataactgtatcattttcattaagagatttcaacacattatttcgttcttcgtaaattggtaagcgaataccatcaacataacgatgatattctccaatcattactacatttggtttagcaaaaacatcatgttttggtatgtatggttcgtatccgcagttaataacattataatcatcggaattgatactataattttcaataacttcgcacaagtttccatgaagtttaagctcatgaccaccaatacgagtataaagatcgtccatgttagaagtcatatgaaggaagcaatcaccatattgatcttctaacgattttataaaataatgcattgcattcggttcgcattgtcccaattttacacgtaatgtattatagaaagaatgaacaacatgatattttgtagttaaactagcaatgttacatacatcattaattttaaatgtatcccacaaaccatcatcaaatcgaaaaggttccataccactttcaacagaaagtcctgcacctgatataatcagtaatcgctttttaccttcattgcttataaatttttctgatatcatattcaatccttataaaaaacaattaaatatattgataataacagaatgattccaatatgataggcatacataaaattattatctttgtgataaccattggatttcaagtccctatataagcatttagcattgttataaattacaacaatagaaaaaactataaaaaaactcaaaacccattcataaattgtgtatgccatcatctattctctcttataatattagtacttttaatattttaaaacatcaaactcttcgcttacgcttgttacattatcactaacaattttaaaaattgatttgatacgttcgtgtagtggttttttagattcgttctcaacttcaatatatgcttgcattgctgcaattgcatgatatgtcccactacctactgcggtaattcttgttttaggttgtagtactgaaaagtcttcttgaacttcatagattgtatgattgtggagaatgataaattgtccacctcctacatcttgtgatgcatctcgtgcaccccattcttctttaaacatttgacgaataattggaataactttaagaaccaaatattgtgaaaatgtttgactagcatcttgttcaggtaaattaaggttataatttaacaactgacccatacgaaatgatgtagtataacccaatgccattacttctttagttctagttagtccatcatcatgtaacttgataaattctttctcgaatacctttggctcagtttgaacagtttttgtaaatccattgcttcctaacttatccccagcaataaaagaacttactccgtcagtgtgtgcaataatacaggtcataaaatagctccaattgcaaataatgttgtgtataagatataaattagtgctcctaacaacattaggcacaccaagtatgaagttgatagtacataataaattattgcttcgaattttgaattgaacttcattgtagttgaatcaataaagccattacgataatctttgtaaatgaaaactgttagaaaaataactgtagcatacattactacagtagcataaaaaataatagatgtcaagttttggatgtttgtcatagttatataatctcaatataattaataacaaaggaagtacatcataatcatcctgttattttaattatttttattgtttgactgaaccgtaaaaaaccagttctggttttgttaatattacaacatcttcaccacgagaacgactaactctaaatagaacttctggtgggattccatttgctgcatatagtgaaaaaaggaaacctacctttgttgccatttcttcggtaaaagttgataactgtcttacagacacaaatgaattatcaccatcagtaacattacttttaatcgaaatgttatgaagacccagtactgagcgatttgtcatatatcgcttttcgggagatacactaaagaataccacagtacatgctgaattgcaatacctagaaacaattaaatttatcccattgtctctaacaaagtttgccattcgaatacctgcatcaaaatcaccaccaggagatgtaattgtgatggtatcatagtgttctttatcatacaactctatcatacgcttgagtgacccatctgtaatatctgatatgaaatatacatttcgggtttcaggattatactttatcacatttttactttcaataccagcactggctggaaaatttattaacaatagaaacattgctgcttgtatcacttcaagccatagtcttttcatataacaagtcctcaattttgtttaggaagatataaataatatagtacttaaacacttaagtcaaactttttctgtacttaactcaaatttttaaaaataaaacttaaggtgtacagtttataacagatcatatcataccactgatgttttgtcaactagttcatggtgcatctgatgtaaaaaacaaatatatttcatacttatatttaaaaaaggaaataaaatatgaaagctatcgcagcacaaggtaaactaccattcaatatcggcgggttttgtgtaaccgcagctaatataaacggtgaattgaaatataacttgaacatctttaatcaacgttctagttgtgtttacgatctcattgatactgattttaatgtttatcgttttgtaactatcactagttatgataaagataaaattagattagatgcatctaaaacagcattggaaattgcaccaactctagccaaaaatactttttgtattaagattgacgatagtgcatttgctgaatcattccagtttcataaaattaaattgagtactggggcgatgaaatatcacccttgggatttgtattattgcaacctcccaggttaacaaaaaaggagccttgtggctcctttttttattctacagtattaagcttctgacaaatcatatcagcttctactcggtctttataataaatggtaaatccaaatctacttgttacccttttctcactacggtgtatacagtttacaatatagtacttattattttgtgcagaaaaacgaacttcataatttcgaaaagaagtattaggttcatccatagcaactatatataacataaaaataaaaaacactgttattagaaaagcaataataattattactgtcatttatcaagacccttatcataaatgcaattaacaataattccagcatcttccagtactttaatagcttctggtggtgtacgaggataatttttgagataaattacacgtgaaatcccactacctgcgatcaacttagaacaagtataacatggttgtagtgttgtgtaaagagtagcaccttgacgttcagtaggagaactatagagtaaagcgttcatttcagcatggatttcatgaatattactccactcatgatgttcatgctttgcttcatcactaacccagtcttgaaaacgtccatcattgactaagtgttgattcacatcacaacaatttggttgttttgatggagtaccattgtatccagtactcaatactcggttatttttaacaataacacaaccaactttttgtgaaatacatttactttcctcagcaactacttctgctatcttcaaccaagtcgtatgtttcattataagctccaatacttaacaatgcgtttttacacaaatcatgaattttcataactcgaatatagtttaacacatctgtttcattaatttcaaatggtttatctgcatatgtagaccacgtttgatttaattcaataacaaatgtaattttatctgtatccataatattatcacaaaatctacgaaaatcttgctcttcatcggaaagtctgaaatttaaatcattttttaaaccattaactgtgaagcaaataccagtactgtaaccgatgcaaatatcttcaatatcatataatccataaattaatttagagataaacgtgctatatttgtttctatgataatagtttaatatttcttgtttaatattaatttcaatatcagtagttttttgtaatgtaagtttaattaattctaatgtcttgattatgttatctaaccagatattagtatcatctatacttaggtgtgtgtatttcattatgtccctctagattccaatcatcaacgagtttagaacaaacttccatatgattatagtacttttcatccaatacatacggtttattatgatattgtcgtacatcagtgaatatatcataatttctatatatgaatgacatatttttatgcattaattctatagttttccaaattttctcaatatcatatagaattgtttctaatgacaaacctgttaacttggaaattctttcaactttaaaccctgataacatcatagtactgttgtgtttagttaagtaactatatccaatagaactatgtattaactcaatactatcagtgtatgtgattgtttttagaaatgattttatatttctattaaaccaataccactttttgtttttattataacaactataccatttcttcaatatatcaattgcttcagaattaatttttaaagcaaattcatcaattaaaaacatatgatggtaaaaaatatcactttgttcttcagttaaattatattgctgcatattcacctaccctagtaacaatgattccttgggtatttagctcatatagatcaaaatatgatcaatggaaaattgatatacagcaataaaaataggaatcccatgataggattccttttcacaatattatttttgatatggggtgtactgatatttttcacaatcagaaacagttagaacaccttcatcataaccatattgaagtacaaggtcaaatgctttatcaaccatagcaacaacatctttataacgaacaatcttatgagattgattctcaactgctttcataatccccattagcaaccagcgaccttcatcggtgtgtaatttagcaaaacgtggacgctttgtcgctgccataatatcagtccattcagctttaaaaatgtgtggacgttttggaatatcatatagcgtagtagggaaagttacattatttttcttcattgcttctgcttgtgctgcacgatagccctgacgatataatggatgctgcatttttagctgttcagcacttagaactacttttgctttgtatgcgtcataaccatctttatattgtgcattggacatattattcttttacctcatcagtttgaatgtattttttgtcagagaatgtaccgtgttctttacgcacagcttctgcatgttgaaccgcatcaactggattaatgttctttttaattagtacttcattcattaattcaagtacaattgcaaaaccattcagcacacgctcagattcatctacattttttaattcaagtgctactgcactaatttgatcgaacgcaacattaataaaatcggaatcttctaatacatttgctacttccgtattattacgtactagtactttcatataatctccacaaagatgatgccccatattgaggcatcaaaatctatcttacacccactcttctacaccaccgcgacgcttaactaagtacttgccttcttcgttacgtggaccaagaataataccatcaatgaaaccatgttcaccatattcaagtgcttcttctgcatttaaccacaaatcgcggtcagcatcttttagtaattgttcatgtgatacacctacagcttctgcaatttctttggtcaacaatgtattcagtgcatcagaatgttgtagggaaatcttctggtctgtaattagaccttgtgtaccagaacttacttggtgacacatgaagtatgagcgtttaccacctaaacggaaacctttagtcccaataacagattgtgtatagcaacccattgatgctgcatagcccattactacagtgcgaattggcgaaatacaagacttagcaacatctgcaatacccaaacctgcgtgtactgaaccacccggtgaactaatgtagaatgtaataggggaatcaccttgtgagtctaaccataccaattgttgtttgatgatatgtgccatttgatcattgaaatcagtatcaaggaaaatgatacggtcttgcatcatacgagatgctagatcatatgtacgttctgaaccattaactttctcaactacgtaaggaatagaaatgttacgtacttcgccattagcataaccaccaaacatgaattgttcaaccattattaatttcctctattatttcgttgttgtgagtattatatcactaagatttaaaatgtccaaactattttactggaatatttgaaaagaaatcagtcatccaatacgccgtctctttgttgaataatactggatcaaacttaagtaactcaacatgacttgtatcatacacgcttgtatcggtaatgtcaaacaaagttttagtactgaatagtggattactcactagaaagtagtaatcagcagtagtgctaatgtcatcataaaacacaccgtcataccatccatcatcatatacataaacagaatcgtcatgaagatagtaaacttctatatgtaaactcaagttcttcatggtttcaatcatttttgccgtatgaggatttaacttattgacattttcaaacacataagagtgttttttattcatatcaacaaatgaaaatattcgtactgaacgtatattcatattactccaaataaacaagtgaattaatgaaatcatatttcaatttatcatcaacataattcaaatcaactttaatcatcggagcatgggaacgtatagacagtgtttccataaagtactgattaagtttgtatgtatggaaaagatgaatatctcgtttcaataccaccattacttccccgaacagatcacagagttcaacttcagtgttagttgggtcaaacccataacgattctttaatgtacgtggttctttatttcgataataatgcacagctttattactattcactaacaagtgatgatatgcattactataaactgagcaaataactcggcttggataattggtatattctggcagttcaaaataaattaatgacacaatatcctctcattaaatttcaaatacaaatttaggattgtaatcaaaattctcacaagctccactgtatgattcatagcctcgtggattacaaatgatacgtgtcttaccaatgtggtagtcaaaactactatgaacatgaccatgaatccaaacatcagcacccaaatcttcaatgtactgatccatatcggaacagtaacaaccattcagtgaatcatttttatattttggtgaaacactttgataacttggtgcgtgatgggtaaccacgatgaccttgaaatcattatcatgcataaagcgaactgtgtcaatagaatttttgataaattgtttatctttgtgatgcataaactcagtatcatctggtgtcagtttcttacgccaaggctctgatgttgttccatgacggatatgtttgtaatcgttcatcttcagacgagcatcaaacttcgtcaaagaattacctttatcgaagtctgtccacagagtactaccaacaagcagtactccgtccagccatacaaatttgttttgcaaaaagatgaaatttggaatctcatcttgcatatcggacagtactttatgcgttttgtggatattggaaccataatattcatgattgccaggaaccagtactacattcttaaactgcttacatagtgattctataccagtacggtaacgactgcgtttaacttcatcgaagtccccagcaataatcagtactgtatcactgtaatcaccactatggaggtaatcagtcccaccgtgtacatcagatgttacaacaaatttcataatcacctccaataaatggttaacctaatgcgtcaataatactgtttgagaacacttcaacagcactctcacgaatttctaagatacgagtataatcatcacaagtgtttttgtcaaatctaaattcaataaacactggtaagaacagtgatggctcaccagtacgcttgtcgaatacaatgtcattacactcaactgtaaccactttaccaataagttcttgcattctttcccaaatggttttaaatgtccattcagcatctttctctttgataccagtacccacattaactttcaatgaaccacaagcactttccagttgtaaagaacctaggcttcctttacgtttaccttcaccttcattgaaaccaacaatacgtaagtccagttgcattttcaatttcattttcaactgcttaggtgaagtatgagatttccagataccatcttcacatttcagtactgaaccctcttcaccttcgttcattagttcactattgtactcaaatgcttctttgatgtttagaactttacggaatccaaccatacgaacaaaatcactattgagttcgttaattgcatctactaagatctcgcgacgttctttacgttttacatcccatacaccttcacaaaatgcatcatatggaacaacatcccatagaacgaatacagtacgcattgcttcattctgactgatgctatctttaccagctttctgaattataccgttgccagtagtgcgtgggagaatggtttctccatcattgtccagtactacaccttcccccataaagactacaccactactaaaacgttcatctttactttggatgatgtgagcaagacctgccatctcaccatcacgacaacccaggaagtcgtatagtttaccattacgggatgtagaagttaatgaaccattaatgacaacgtggtttaagtactgaccatccattttcacttctgatatagcgtaaccataatctttgaagttgatgttctttgcagtctttttgtcaatcaaagaacaacgcatatatggttcgtctttgatgaatcctttaccaaacacatcattgcagttcttctcctgaataccacaatcaaggttcttagtgagcattctacgtagaacttcctgatcatcttcagatacagaacccagtactgaagcaatgaaatcacgccccgcatttcctgtcacatcacgcttgtaaatgcattctagcttatcaattgcttcatctaacgtcatatgttgatatacgtcatcagcggcagggagcttcttatagccactaacgatagaagggtctagagtatatttcagtactttttgtaaagttacattatctttattttgttcaagaatagcctttttgcccagagtactgctagtatttttaatgctttcaagaattgctaaaatgctcattgtatattcctttatagataatactttccaatataaagtggattactaattgatagttgaacgtgacatggtttgtcttggtagtaacgagtgcttgatgttttgcgttcatttggtgggaagaatggggaacgatagccattccatgtactaaatgatgagtgttcattaatatcaacatccattaccataatcccattatcatcaatttgaactggatatgcactaaagcgttcaaatttatcattataatggatattataatctccactacgcccataataactacgcgttgtattattacttacaccaaaaaatacgcgatatgtttgttcattatctttagtcataaatggtacgttctcgttgaaacgtccattattcataagatcatcaacatttatttcttcgtatttaattttaaggtcttttgctttaaatgatttattgtgtaccagtactggaatgttagattcacctaatgggttatgtctgtttgttctatagctttgccaaaattcattagcaagtttaatttcttcatctgccgtagtcttcttattcaagagtgcacgaggttcaagattgtaattatccaaacgttgattcaatgcataagttccacgagtactgttaaaaagtaaatgataaactgaacttttgtcgggatatgcaaattctttagttttctttatacaaattgcatgtactttaccgcagtaatagtaatcttctttaagataagtgaaaccatcaccaactttaagacctgctacagtttctttttgttgttcttttttattttctttttcaactaacttagcaaacgtttttgttttaccattaattaattctaagttattgttgaaaaacattgggtctacaaaaacacctttgattatatcgttattgataattaaatcattcatgttttttgcactaatcataaattcaaatccttctgggtgacggatcgtgaaatatgtttctcgtgcatgagttgttaatttatcaactacacaaaatcccgtagttggaacgttgtcaatatataacgatggaagattgttcttctttgcccagtactctgctctctctttctttgtttcaaacgcttttgtatgtgattttgttgcatcgataataaaaccatcaacttggttgtggtttacataggaacgtgcaacaaataacttctctggaaaatccatcaaattgtcctcattgtgctgattgcttttaatgtgtcaaacaatgcaccatattttacttgcattagttgatcaccagcaggaagattcatacgcataacagccatgtcttcaatcatttcagacgtacacagtactgctacacaggtaatagcatcattcaatccagcttcattgaatttggcaaacggaacttttccctgtttgctaaggttgttataataagaatttaacttatcatgtccaccagcatttagtactacaatagtttcgtgttcatagtaccattcatcaataatagtactgaaagcagtaccttcatattctttaattagtttaacaccagcatggaatgcttgaataccagcttggacaccttggcagtacatattagttaagcaatacaatttcatttccatacctcttgtttttctacgtagcctttcccatcacagtgtggacaagcataaaagctgcggtaatcttctgacggtacttgttgtgttccattacatgtaggacatactttacgtgcaccagaaataatacgttcatggtgttcagcttgtttagctgaatcaaaaatacgaccatcttcagtttggtatttttctaccataacttgaattactttcatttctatttccttataaaaatgttaaatcttcagtacttaattgtgataatttaccatcatattctatttcaacatatacatcttggtcataaacagcaactacacgtttaataactccaaccttcacgacattctttttgtagttgaactcaactgaacaaccaataagtttatttgatagaatctcacgtatttgatttgcatggtcttttaggatagaattaatagattttttcataatatatctatcattcaaatattttttaactacatcatgcataattattaccttttgaaacgattgaatgagtactcatctttttctttacgtaagtatctcatcccaccactttgtggagtagcgagagttaagtcacccgtcaagaactgactatcaatccaaatgcgattaccgtaaatgagtgggtctgtaactgctgtatgtccactaaagacacaatgcactccatctaacttaggtgcataatatgtattattagttctacaataatcgaatgtttttctatcccacaagcacttatcaattatatcagcactaagtgattttgtcccattaacaaatcgttcccatgttgtatattccaacggaactccagcatgaactaacccaatcttcaatcctcggtgattgatttggataatcatagggagatcctttaagtactgacgaaagaattgaatgcctgttcctccaacttcatcaaggaatttatcaccaccattacttatccaacaatgataccaatctcgaagtgtttccgaatcaacgcacatcatctcatgattacccgcaatcatgtaacgattttctccgaacaaaaattcaaaaaggagctttgaattttgttctccacggtcgataatatcacctacactgaaaacataatcattgtgtgtaataccaaattctttcactgtagcatcccatagtttaccattaccatgcaaatcacctacaatgtataaatctttatcatcaggtacagttacttctaagaagtgtttcattattactccaaccatataatattagtgtgtttagtaacttgtgttccagcaaaagaaccatctttaagataagtattaattttaaaacgccattcaccaccactaatatacatatcagtaataatatactttccataccctctggagtttattaatcgtacttcttgaccaatatattttggcttcagatcatttataaaatcatcagccaaagacataagatatcgcaaatgtgataagtcagtgttgaacattatttctttctcttatatttgttaataatatcttgggtaagtgaaataaaaatatatactaatgttacaggccaaataatagccatcagtgctgctgtttggagattcatgataatcatgatttcatctttaaaacaaccccaattaagtactagaaagttggttataaatgtaacaaatgctacaaaaccatatattgcaaaaaatgttatcataattattcctcatcatccactaaaacaagataatccaaacttaactcggtatctatgtaacaatcacaattcaagtactcaatttcagcacctatagttctcccattcttaaatatctcaatgattttcattctagtattgggattaatgtgttcaatgtcgtattcgtattcagggtcaatatactcacttgtcatacgtttgatgtattgttccgaatatcgtacagttttacctataagatcattactcaacgtctgataaaaatcatcttgaattttgaataatgacctataaaaaatattatgttgaattagtggtttcattgacattaatcacaacttccagacgatgaacttgaatcagaactagagctatcataggaacaagaatcagaggaagaactgctgtgacggctataatcactgtaatcatcattgttgtagattggtgatgttacgattgctgctgcggtcgctgccgttgcaatttgtgcagtatggtcatgaacacctagttgtggttcatccttagatttacctttgttcttacctttagtgtaacgagctttctttgcagttttagtatttttctgtactttaggagcttttggtttcacatcttcaacgactggaactacattcactacaactttaggatcagtttcttcaagtgtattatacactttaacttgcatttgaacttcaacttctttaacttcttctttaacttctggaataactgtttctggtgctggagtgattttatcaagttctttagtaataaagaagcttgtatttttctcacctagcataacaagaagaccaatggcaatcactggacttagtactgtaccaagtactacataacctagaacacttcggttatagttatatgcaagcataccagaaataataataccgattacatatgcactgctaagaataattggggttaacatattctactcctttgtatataaatttactaacttcttcgatgtataaagacaaccctgaacgttcatttagaactaaccaagcaccaaaaccacatcgaatctcggatatatgaaactcttctacactataaattgaatacgcgttaaatggacatatttcatcagatatacttaccacatagttattattaattgaatctaacacctgggtattgtataaattattagtactgaaaatctgcattaacgagctagaaagcatctcggttgtcttttctaatattgttaaaaacgaaccattcacttcaacttctccctattggtgatgtaatcaaattatatcaccgaattctgatacgtctcatgatattcgcatttcatctatatataatgaacatgattcagaattatcgtctaaacttaaacctaaatcgaccatcaaaccgcaatgcgttccccagaatttctttatgtatagttttttgctattattacctaaatcataaacatattcatttttaaatatactttttaattcttcacatatacattttattatcttcattacttgattatgatattcgtatggtattccatcaagttcgttaattattaatgcaaaaccatcatcatagtacttaagtttattgaatgtttgtatatccatttaatatataatctcactagcttctattgtgtagacaccatcatcagtcattaatctaactgcaactttaatattattagacattcgtgtaactatcaatccaataattacaccattctttaaagtaccgttatggtatcttacttgtactttagttttgttatcaattaggtatcttcgaatttgatgaatttcagttctaaacagttctaaataaacttcactatattccttatctgaaccgtctgaacaccagtacaataaatttacttgttcaaataatttttttatattcataaaaatctcacagatttaatattactggttacatgatttacccaagtgttatcgaacttgtaaacaattgtattaagtgatttatgaaaattaacctcgcacactaatgccttggaaccattgattgtacagaccgtggatggtaagttgtttgctaatatctctttttcatctaaacatagtgaactaatacaatcataatagagaggttcaagaactttttcagtactgagaaattcaaaagaaagatcatctattagttttatgtaatcgaataaattatgataatattcattcattgtagatccttttaaatttagcattattagaatatgtatatgaatgaccaaaatcatttacaccatgtacatttagtacaccgtcactgaaataaattcgatcaatcgtgagttcacgtttataatcccaatcatcataccagcacagaacacgaatgcctttgtactttgtagttaaatcattttctaatatagtcaagtaatcaatatgacttttgaatatctctaagtcctgctcaaacatcattgttcctcgtataattctatatcatcaacaccaacttggcgaattgcagtacttctgttgaatgtatttttttcaaacaaacatactgttaaacgtatttcacacttcaatgcactgtaataaatcatatcaataacaccatatgtttcatacatttctacgtatacatttcgacctaaatacttttcttctaaatcagtaattagactattgataagattacctatctgtgttatatctgtgtgaaatttatccattataataaacctctcacataaaacattgatgaaaatagataatcattagtacttgtgtttagttgtttagaaaagttatattttttatctttattttcgtataaagacaatctatagaacatttctatattttctaagtattctttttgtaacaacatctgtgtttttacattcattataatataccttaaaagaaaaagggaccaacatatgatcccttttgtattagaaatttccttctgcaacttgcattactttcaagccaagtagcttacgccacatgaatacaacttgatcgcggtcatcataaacctttttaacatcgtaatgatcaaccacatttttcatgtacaggtcgaattttacaacatcatcgggacgtttatcatctatgtctcgcataaacaatgcatcgtaaggaataccccaattcttaagccactgttcggtatcagcacgacacccttcagtacgcccactcatgacgataatcttgcgtttatgaaaaactgcttcagcgataatagacaaaataacttcttcatctggtgtatcctgaagaacagtactttcatcgtaaggattacgaccccatttatgagcaagagtaccgtcaatatcaacgataacagcagcttctcgtgaattaccatagtaaccaacgtgcatggccttactataatagtacgtatctgccatagtgtcaatgatattatcttgtactgaacgctcacgcatgaggttacgtttcttacaaagttttacgaactctttaatcttaaagaaaacatgaacatctgcaccacgatcttcattaggtacgaaatcttcgtagaagttcttttctttgtagtcgtattcattatctttagcccaacgtttccattcatcacggaaatgttgtttaaggttcgtatcggacacaatgatgttccaaccattctctgctgctgaatttgctgcactgaactgcattttagttacgtactgctcattagcatcgttgaatttgtaagcatcatgtgacccagccatagattcacgaatatcatcacggttgatgttgatagtctttgatttggcatttttaatttcttgaactgcccatgtggttttaccacaaccaggcaacccaactgttagtgtaatagttggcattattactccttgttactcaatgaattctacatcttcgagtttgtgccatcctcttgaaaggtttcttgttccgttattgtattcagtgtatacaaagcattcaccatttactaaattaccaatagcagtacgcgatactttaacatcaagaattatagtactgaaccattctctgattgtatgatcccagcatttaactttacatccaatcaatgttttcttaaaatcgaaaacgtaatcttcgaccattgattcgacagattctattagttccttttcaatgtactttaacttttcgatcctctcaaatgcaagttctttattcatatgtcctcaattatctagaacatccactatcaaacaagcttcaataacgaaacaatcatctaattcaaagagtaattgatagtcatcagaaaacttcactttagtaatgtaagcactttcaattccaccactatgataagaactatataaaatacatttacctgtatattccttacggatacgactaaattcttcatataaatgagtaataaacgtatccgcagttttgttgtagtattttaggtcacttactgtgctcattaacttttcctactccaaatcgtttggagattttcacaagtacagattcatcacaacgaatactagctgtatcattggatgaactgtactttaatggggtccactgtaattgagattcttctaggaacttgatacatctgaagtaatctttcagagaaagaaatttaactactgacatatcctgaacaatactatgctgaacttcaactttcatatgaactccttatagtggatcaaatttattttcacgtttcgatgtatagcgagttacatcatgtattctcggcttaacaccttttggtttccttttcttcttgtattcagtactactacatccgaaggtattctcgattcgtttcttacttatcttcacacctttcattgagcgtttgtgctgtaattcatcgatttcttcttgtattttcctgaactcagtcggagaaagggaaccgtcatttttatacttaggtttagccatcacttctccttgtgcttaggctagatagtactaaaaatcctttagtacaattttcatgtattttataagagtctctttgtaatcaactttcttattgttatacattgcaaaggccaagccctgacgattcagttcattagttaaacactcctgaaccttcattgcgaattcctttcgctccaagtgcttgtgttccttgacgaagctttctacttcatcttgtaatgcattatagcacgaaaataccaattgttccattcttaatatcttttgcatagcatattcatcagtactgaacaattgttttaaatcatcacttgaaccatttaatacggcttcatataaatgagaatcaataataatactatcttttgtaagatgtaatgaactgtaccagtcagtctttattttacacattgtcccattatttaggatgcacacaaaaccctcaatatcaagcattttatgaacttcctccacgctttcacggaaggtatttcgtaccggaaaagtgtgatgaatatcttttccggtcatattagtactgtactgtgcaaggcatggaaacttatcacgtagtgctttaccacatagcaactcaccactcacacgatgtcgaacgttcagtacaaacagttgttctacctgatatggtaatacaattcggtactctgggcttgtatactccatattaactgtgtaacctaaacgttccgcttcgtcgatgtactgatacaaattctggttctcgttaataagtcgagtactgttaatcgcatggtcagaatacaatgcagtatgtgatttacaacgaatctcaccatcattatcacgataagtactgatgatcgaaccatccaacttaggcataactaccgcaatgtcatcgcatgtggtgttagcagggaacattgtagcaggattctcgtaagcattgaagaactttttcattgtacgtgctgcacaacgtatcatgtcaccttcttcatcaatttcccacatagagccacgggtttccaacgcatttggttgcatgaaatcagtgtatgatgctagacgataactgaatacacgatacgtaccaccagcaggacttttatgatccacataaaaaaacgcatcgtttgtattacataagtgcattaaatcttcatatatttgtaaaagggtcattttattacctctatatctacatcagttccataatatgatattaatccatcatccgattcacactgaatagacaactcagattcatagtatgttactttattcactgttagtacttgttcttcaattactccagaaaaataattcatctcacgtacacgaactttagttcctttaggtagttcatctgatatttttcgaacaagttcaaaagcagcctgttcaagtgtgtatagtaattgtaatctatcttggatattcatattatttccaccaactggtatcacgaccattagaaaaagattcattgtactgatgcctaaaattagtttttggattattgttcatagtactaatgaaattaaatttaacattttcttggatatatctaataacactatctttaaatttaatagtactgaaatctaaatccaaatgttcatacaatacaggatggcaaaactcatgtgtacgcaatgatggcatggtatccttaatgtattgtatagtattaatcattgcattgtactcaggcatagcacgcatcatcattagctgaaagtgttcttcctctgacattgactcatccaaatcaataacgacttcatcatttttagagtcataaactttaatggtactcttggttggatcaagcatagcccactctggatacaggcatgttttccaaaaaggattattgcactgaaacatactaatgagattttgttctttatcaaaaatagcaaatccaagatccgaacttggttgtacttcacatacacaaatatcgtaagacgagtcttcagtactgagtgaaccaactacatttgatatatgtgaatatggagtttctcttgactccaactgaaatgtactttcaattcgattgatttgtggatgtaatgtaattacaccccttagtacatataaaattctatctaaatctttaatcaaaattctatccccgtatcggttaatttcgttccgtccatgtacttgacggttatttcaaggcgactctcagtactcaatttttgaagatcattgtagtacaatttaaattcttcaaagaactcaagtggtggaatatcgtataaagtactaatctggaagtgctcaggtaatccaaattccaatatatcaatcttaggcataagaccatcggctgctgcaccttctggagtactgctgtctgctacataaaacatagaattaccatgacgctggataacgaatatgcaatcatcttcacttacataaatcatatttccaaggtatggatcgttatcacaccaattatcatggacgagttgttcaacttgaagtaaatcttttataattccctgaccactatcgtcaactagaatatgtaaaccagaacaatctttgctcaaccagcggtatcttgcatcacatcctgattccataaatggatattttgaaaaatccatatcagtaccattataaaaccaatcgtaccactcgttacgcatagtaatcagcttagtacttaattctaatacattcattttagttttatcctcttatttttatagtactggctggatattctaccaaagtattatctggtaatcctatacagtaataagggaaataccccatctttatattaataccaattaaaattcctgttttatatgaagtattaattccatagtaatcgtctatatcaacagcaagtccatataatgatatgttacaatccttgatatatcggtcaaacattttatacattgcagaatataaagttccattggattgtctcaccaaatctgccaacattttgatagtactgttaattaaatctatactgaacatctttgtacctgcgaaaaaagaccagcaaacgctggcctaaaaatttaaattatttcataaagacaatatacaccatcaacgccagcatcaggaaaatcaacatagaaattcacactaacagtgtcgtaatctatatcagtgattcgtccggttttacctacactttttacaaatatatcagtaccaagatacacgaactcaaattcgtccgcatactcttttatgatatctgcgaaccaacaaccacacctaggttctgtgttaataatttcaagatataatgtaatatattgttcgtatgtccatgtgtgtagataaaaatccatagcagtttccttagaaatatatcatacccatcaattcagaatcggcggggcgagtataaccttgcttcttaactttaaaatagaatgattcatgctcttctaaattataacgttttttcaagcaacgagtgtatgtctgacaatttgggtgaacccattcataaatgtgaatgccattttcgtcataaccatttatactacaacgatttccttcatgcttcataaagtttttacttttttcagtaaattctttcactgtagttgtatatggagatttgtattcaaaaggaacttcagtcatacgaaaataatagtattcttcgtcttcatcatatcccaagagcactgtgttagtttcacgtacattgtaatgattcttactttttaattcattttcgtatatatctttcagtacttctgcaaaaacttcatcgcttgatgcattaggattagatacacctgatactcggcgttcaataataaaatcagtgaatttgcggtcttcggcaatatcttcgttcatataaagactaacaaacttatccttatatgtctttacactatattgcttactttgtacttcactataaacatctgctaacatattctcctgaccacactgcacaccacttacagaataagcacatgcatgttcagccattactgatgttaacatttggaaatttgccatgtttaattcattcgccatctctgtagcgaaacggatacggtcaagcatttcacacactccttgtgttaattattgttccttacccattattatatcatgaattaaactattgtccctgtttatagcaataaagattctctaatttaaaatctactagatcacattcagaacgtactcgattcttgttccagaataaaatacgaatcctttcataatcacgataaacactaataatgcttctgtgcttggatttgtagtactcctgtactatccccagatacacagtcctcaataaagacttagttggatatggcatattctgtgctgacgtgatatcgtaaatcatcttcattgtttcagcaacaagtacttcatttgttctcattgtaatccttacatacactatgtaaagtaaatcctaatccaacaccgacaaatggaaatagtaaattgatataccaagtattaattgatgaaaggaaacaaatcccacatactgtcagtactgccaatgaaaaaagactccagataaaaaatactgttctcataaaaatgttacctcatcaaatgaaaagtttaagtacgttgttgaatcttggtctaaactatgaatagtaatatgaccattgaaataaaaagaaacatcaactatttgaagttttgggtattttctagtactgaaataccttcctactactaagtcagaaaacatatttctgtattcttgtgttacgtttttgtataggttatgtagagcactttcttgtgaatcgaaagtaatggaataatctttcaccaatatagcatatgttttctgcattaaaatgatattcataaatctcctaatatctcaaaaattattgatattgggtatactgggttatcagatgaagtaacacatactattagtacgttttttccaggtgctacatcctttaccgtgaaattaatattattaagaatcagtgatttaccaatataatgctctttcaataattcaacaaaataatccagtactggattatctgcactatatgataactcagtacttgatatcattttatatgtatgaactattagttcagctttagtcatgaacacgctcacaattaaggcaataaatgcactcaatgtcaggtcgccatgatttatcaaaatctttgtgctgttcttcggtgtattctgcatcatcattaatagggaagaaatcaccagcaccagtcgcccagtctgaatctaaacggaaacgagctaattgagtactgttacaatatggacatttattcaaaatttattccttctaactgatatacgtttaatgaaaatgacccactattattatcgcatctgaaacacagtgttaaagaaccattaaaactaacaacatcagtacatatacatttttcaccattggatatgatagattttcctatatataaatctcttactatagtacggtaatgttgccataaaaaataatacacactttcatagtactcatcttttacatatgacaagtataagaatttataaaatacttgtatttcctttaagttgtttttcattctccaactccagtaaatttacaccaatccaatcaacatcactatcagtacttaattccaatcgtagcttaccgctatgactaacaatatcgcggaatttgtatattttattatcacgaactatacacaaatcatggtaatattcatgtaattcatccaaaaactttatccatagcgaacgatagatttcatcgtagagatattcaccagcatcaaccgtagcgtattggatatacaaaaatttgtatgtgaattgtatatcatttaataacatatgtaacctcttataaattcaccaacttcacaactttaatctcgataaatcccctatcagttatttcaagaaattcaacatggataatcccattgtatgatttaactccagagaactcgaatatatcatttccatcgataaaagtactgtaattcttttttatatattcacctactgaatctaagtactcaatatataaatcaataaatggttgttctttgtatgggttatgtgaacctattttgttactaacaaggtatacatcatacaaatcatataggatcttataagtgaattgtatatcatttaaatttaatcccaagggaatatctccaacggaatactggtaaatccaaaatcagtgtagtactgaacctcaactttaccatcacgtctaatgattatatcagaaaattctgcatggtcatcaccaataataacagtactgaatttttttttaatcttaccacgaatcgtatgaatcatttcagtgcatgtgtcttctagactagggctatcattgtcgtgtgctaaatctcgaataatcttgtatgttagtaggaaatctttataattcataaatctgccaaatcaatagaatatatttcatttatattattattgaaatatgatagttttaatctaccaccataactattaacatgtagtaccttctgttttttaccatgaataactatttcagtgttaataaagtatgcacgtatcatctctaagtattcaatccatattttaaatgtgaatgagtcttctcgaactgtgttggtatttctgccattatgatgtaaatcaaacaaaacactgtatgtatattgtagaactttataattcatatatccccttacaaaaatagcccgaacttatgtcgggctatgtacattattcatcgtcgtcatcgtcatctagatcgatatagatactatcatcaccatcatcaaagtactccacaataactcctggaatattaagggcagtaaacattgcatcatatttctcatcagatggaatcaaaacaaattcatcaatgttttgaacttctggcattttatcttcggggatacccatatcaacaagtgactgaataatcttttctttgaattctaaaaacttctcttcagattcaaaatccataataagctgtgcaacatatccttcatcgttaccgaatgaaattgacatttgtgcatcagtgccgacatagcaccaaacacgtttacctgtgtgctgctcaataaagttttgaatctgtaacacaatgtcatggcgagaactgttagcaatgttgttaagattttctacaccagcattaattccagtactgtcatttgtttcttcaaattcaccataatcacccaatacatactgtacaccttcatgatgtaatgcatatgcatagtcaaggtcagcgagtgaatcgcactttccacggatcggacgtagggaaagacctaagcgaagataacggaagtatgtattagtatttgtatttgtcaacgtaatgctccttaacaatataaaagtagttgctgttattgtcaaaaaagataaccatccctttatagacatttacaccaattttgatttcacatatgttatttgatttactcgcttcagtcaataacattttgtgctctttactgaaagtgtggaacagtggtttgacatgccacatttcgataccatccagtactgaaaatttttcactaaatttaatcattgattcttgtaaaaaatatcctgtaagatttatttcatcacacatgcaagtttccaagaaaattaatcacatctgcatgtgataatgtatcattaccttctagtacattaatgataaacggcacttggcgatatagttcagccaggaattgtacctcatcagatgtgtaagaatatcccataggaacaacctgtgcagtccagtttcctagagttttgttagcaataattgcaactacagtattacctttgtattcaacatggatggaacgaaatcctgattgctcattttgatcccaaagtactggattggttttgaacagtactgacataattatttcctcatgtattttataacgtcttcaaataattgtatttttaagtcctcgtcatttccaggtaaaaactcacgaaaactatcaaaatcttcattttttgcgaagttacgcatttgtgttgagctatattgacttacattacggtcaatacctgcctgaattgcttttatactacaaaaattatacaacttaccattgtacatgtcaagagttttttgaaaagaatcaatacggtcagaaccacaaatgaaaagaacatctaagtactttccatccagttctctcattatatcaaatagattgtcttctgtgtagatgttctcttgcactgaaggatagaatccctctgtataatacatttttagttcaggtgggagtgggttttttatattgtcagtactggtgcttagatatatttttaaatcagcattgtactgttcttgtaatgttttggccttttcaaaaactaaaccatgtccacgatgtacaggattaatacgaccaaacgttaatacacatgtttctttcatagattcttcatcaccaatccgagagatttaagataattaattttagcagtagtgaggtacttatcaaggactataagacacgaaggaaatggtgctgaatctgttttcttatcaggttcttctggaataccaaaacgtaatctacctttgataaaacaaatacaatcacatattttggctgcatattcctgaaatgctattgtatcagtcctggatggtactagaatcagtactgtagcacctttattatacgcatctactgccttggctaaccaagtttttaaatcactatatgggggatttaaccaaacaatattttttccccagtcttgttcaagagaattatcatcaggtgtaaaatagttatcacacaatgcagtctcatcaacacaagcagcatcaagtgtaaatccccataactcatccaaatcttcaaagaaatctttgggagttgtccagttgtcctttccagtactgaaatgtactgaatgttttttcgaagcatccttcttcgacattatataattccttttgttagagacagttgtgtactatcttatcaaaagtactactgtcaatgttatattcatataaaaatttaaaatgtgaaccgtaacgcatcatcagattaaactcttcttcagtattgaacttgtaatcatgaatagtctcaggggtacattttaaacccaagaactctataatttcagatgttacatcatatcctgaattgaagtatttaacccaaacacattttccttgtgggttgtattttctatattctccttctagttctcctttaataatatgagccttaacacttattgaattattactatatctttcttcaaaataattaccatactgggcttttgatattgttggtttttgagtaggaagtaatttaactgaagtcacttcaattccattttgtaattcctttatataagaaatgcatcctttttctttaataaccacatatccagtaaagatatcttcgtcttgtgattgattaatgcaatcatcaaaattcaaagttttataagtaacagttttttcttttctaataaatgccatcattattcctatggaaacatcaatgaatatacgtgacgttgattgcatcaacatcagtagaattatcatgctacgcatgtctaattctacaagtactattttcttttaattaatattgacggggtttgcttgagcatatttcatccccccgcaggggaaagaacaaaaaaaattgacgctggtggccttcacatagttcatatcacgaattctcttacgagacgaaagcgggttgctctgtttctctctatcgcggttcttgtagcaacggtcgtcggtcttaaacatcccgacacataatacaaataccatatgaccagtacttgtatttgatttcacaaaatttggacgcaactatattgtataattccgaccgcatatttcttatgaaatctcccttagataattggtaaggtgcgatccttatatgtctatcgaggaactctctttatcctattggagttctttatacagccgcattgccgtgagtggttcaaactatgccatcatctaacgggtttcatctgctgttcgtactgaaaggactactcatctaccctctacattttcgagtggattaggcttttaatcatttccttatgggaacctttcaggattaaaaaaggtgaccaacatattatgttgtcaccttatattatatcattaacttatcatttgtctcagttatattcggttttttctgtgaaatttgttagtatatcaacactaaaacttcgaataacctcaatcttgcttggcatgaaacggtgtttatttttaatatacaactcatcatcttcaataaaagatgtaaaaatgaatgccatatcttcacgtggaatttgtaaaatatcacacatttcatttgccgatgctactggtgaatcattatagtactgagagtatgcactagattggcgaccgattataatagaatttctgattagaaaattactacagtactgaaaatctttgtagtacttttcaataatgtacggcataagtgcttctttcacgtcttcataaccattagtactatcaattgctatacagtaatcttcacgttcttttttctcatgatggtaatcataaacatactcaaagaatgaatttttatttaatgaatcatttaaaccaactgacccactatagtatgattttctatcattcattcgatcatctgggcatgatgcatacatagaagtgtcatgtgatgatgtaccaatataaattttcttagtaatatgattatacgctatgtaatcataatcttgaactccagtcagcattaactggaacattaaatcatcaggaacatcaattaacgggtactcaaacttcgaatatctactgcggcagaagttcttttcaaatgctcggtatgcgataaaatcttttagatttttacaagattcatgttcatgagcactactgctacgtacattgacattagtcgatgtgcaatatccatccgaatcttcggtgaagttaccagcataatccttattgtagtcaacgattagataaagtttcatacatctccagacaaaaaaaggacgagataacaaatcccgtcctttggtttattagtgacttgcccagcagtaaacaggacgtagattttccattggatttacttcaggcttcagtactgttacacgtacttcatatggagttccatctgcgtgatggaatgtttcataatgaatactttcaataaatgtttcgtattcttcttgtgaacgtgaacgtactgatgatgaatatttctttttagaatctgctttaagtgtaacactaactagttctgattcctcaccttcttcaagtttgttgaaatcgaactctggtacaccttcaaacatatcaaatttcattccattgtcttccatttttaaattccttttatataatgttaattagatatttttaataagcagattagattgtgtcatactgtagtgttccgtgacggaatttttcaagtcgtgctagaacttcttttcgttcaacaatttctggaacatcttcttgtagttgatcacaaacttcaacaatgaagtcccaatcactctcacaactttgtcgtaccgcctcaattgttttccaatcagtactgatatcaccatcagcattttgatatacaggccaaacttttccataatcagcaatggatttgtcatttagaatacgaatggcattgaaaatctgaccagtactgaagtgttttgtattcttcatatcttctaaacagcatagctttggctcaccttttacttcaatgagtaaaacaccaccaattgcttttaggactgaacttgtattcatctatatctccgttatcaaaaaaagatgtgaacattatatcacaagaatctaatatgttcacattattttcattagattttaataatattgtaccagttatcaaaatcctcaattgctagaatgaacatattttcatcattgaaatctaaaatatgttcattgtataggtaactaatgtacttgtttttgcatagtctagcattcattagtaacatttctactgcacgttcataagaacaaggaacaaggtataacttagtaccatcttggtgaataatttcctcagcaccatgtggtataaaacgttctgctgtatgtggaatatacggcttagttttaaaaataattttgaatttagtatccataccaaatcctccagatttataatgtttcttttatgttatgtaacatagtattaactatgcacatcttaccacctaacttgtagtaatattctaacttattaataatattactttttaatatatcaaatatttgatattcatttggatcgaaactaagttcgaattggaatgtatataaattgttaaagaggtgaactaatgatgcatctggtgattccattgtaactgtatatttttcacgataaccagtactaatcactacttcggatatatcacctttcatgtatatgtcaatattgtacatcattggtctgcctgtggcaatatctttcatgcgaaagaatgcagtactacgatatacaatgccttctgaaacctgttcttgtatagtgatatttgaaacttcactctcttggaatttggactcgaatgaatgagtgtaatttgttttttcattatccgtgtgcatagtacatgtgtattttccaaaatcatctctagatgtatatgatttatcactgctagttttatagaacgaaacaccattgatatgttgttctttatacatcatcgtgtcatgggatttgtagtatgaacaattaggtgttgaaagagattcaaacttgttcacgtcatgacagtaagaaatagaagaatcgctatacattactacatcacgaattgcaacttcttttgtaaaaccttttttgacggaaatttgaaagtcattgtatgggaagattgtatatccatcgtatgcatctgatgtactgataccaaatggtgtagtagaattcagaaattcgttgatatgttcaagtactgaatactttttaaaattaagaaaatctgaaatatctaacatatacaatcctcataaatttagacaaaaaattagtcgagaataaatctcgacttgtgttttactttaccatttttcatttcttttttacgatccacatgtgtctgaggcttgttaaactcattcatgtgtttctgtacgaaattgtttactttcttagccatacttactccaaactgggatctttaactgttagactttctatgtcactcgcataaagaactacattggattgattttcagacactttaaagtcgtgataactgtctttgacgataaaattatctaatataaaccctttactacagcacatcataattttatcatctttgattgtgtaggtgtttttctttttacgtacttcagattgtggtgtaatactatcgttattacgaataacacaatcaatatattgttcatttgtactcataggcatacccatgataaacgagttttcagtactgattgttagtataaaaacgttagtatttgggttgtgaaaaaaatcatgcattgtcttgctacacaaaaatagacattgaataatgtccttcacattaaacattatatcatgaactttgaatgcgtccaactctaaaatgtcatcaattttcccattttcaacagttttaatctccatgatctatccttgatcttctaatgcactccatgtgcgtttttattaagtcactgcattatacttctctatagcattagtaatatttaatatagcttcaggaaccatttctttattgtattcacgttttaaattttccattttcttaataatttccaagaaaaatggcaaaatgcatgaagtatctgtaaaattacatgagtacaaagtactcatttgaaataattcacctgaatcaatattaagagatttgtattccttaacaatgttttcgtttgtattgaaaatatgaaatactgttcccatgtgatgaagatatacaccattctcattttgaatattgcatggtgtgattacaatagcagtgttgtcaatattatttactattgataaacgtagactatgtaaacctaaaataacagtacaatcacttgaactgctttgaatttggtcagcagtttgtgtaacacttgtaatattttccccatcaagacaactcttgattttatcaaatgaatttttcattgatttagttagatacatttatgaacaccttcgaaatatttgattaatgattttatcatatcgctactaatgccatgtaagtcaacacctaaacactcgtattgaaaaaaatcaatatcctctagtgtgtttagatcaatttccaccttatcatgacccaacgaattcataataacgtttttatcattaattgtcaagaaagtttttttatctgaacctaaaaagatttttacgtgtttttttggcattacatcataagataaagattgtgaaccataaatgtatatgccttccattgaaccaatatctataaaatatagacgaatccctttgtggtattttgactccttagtgatcgcctctattagttcatctgtggttgttaaccttgtttctttcttctctaaattgctcaaatgcataaaataataccttgatcatttgtaatgtttctgacattacatcagcagaaaattgaacatcagtgtattttaccatagtactttgagtaaagaaagtagcttcaatatcatcaaggtcaaatggttcatcaaataaattagtactgaacatatcagtttttttcttataagtcaacataaacttagcactgtatctcaatacaatttcatctttacttactaaaattcgtgcaatgttctgtctacccagtgttgtaatgttaacattaaacgtattctttcgtgcctcaacaatatcaacgaaataaccatcaccttggtaaacgttatgacgaacttctaatccttgttgaactgtattgaacagtgcgtcctggataaaataatttgcagtatcgatgtttcctaaaatatctaacataacttctcctttatagctgtcatatttagaagaaattcagtaagcaattcctccgtaacatgctctgtataccagaatatcacaatatcttttgaaagtcgtgtattcataaaaatatctactaactctttgtagtactctagcgtttcgagatttgtgagaattaacgagtactggaagagtaattcttcagttagattaaattctggataaagtaaatcattgaactcatgtgatgcagtttgaacttgaattcggtcaaagttattggttatacaaccggaataaatatttcggtgcaactctctgtacaacgcagcataatctatgaattttgctttagggttaaaatcaagaacactttcacctttatatgacaatcggtggaacgccgagaacatagtcacttcccacggttgcttaatatctagctcagtaatatcaatattattggacagaagaaccgtaaaaatctcaccaatctttaatagtaacttagtacgtgccagtgctaccatcgggtcagtcattatacaccttcatattcatcaagaaaatcttcgataatcatttcagcttcatccatatgcatagcatcaacttcaatgatgcgaactttagatgcatcccaaatcataaagctaggaacattgtctggctcgtaatcatttttgtactgaacagcatcataaccttgagcagtgcaattctcaataagtgaacgccactcatcatcactgcctaaatcttcacacagaagcacgttatcaacatcaacttctaaggtatgcaagtatactgtacatgcgtctactacgttcagtgggcttctcagcttgcgtaatgcagcttccaaagcactgtgtttacctcccatatgaagaccaccatacgggatataaaagttatcaatttttacagtactcgcatgatacagtttcatatttcattcctatttcagtactttagtcaatgctttcacagcggtttcgagttgagcatagtcgttaattgtaaggtaatgaataccatgtgccttcatttcagcatctattttactatataaatcaaacatgtcaaggatatgattgtatgcatatgaagtatttgaaacacacaattcttggaacaaacgttcttccaagtcattcacaacttctccatgaatgtcaagtactacaccatctttgtaagtgtagtactcttcactccactcttcagaaagtcggaacagtaacggattcccgccgaacacttccatgtcataggaatttatctcactaagtagtgtttcacctggttctggtgtgaagtcaaaatatgcgagtgttgtaccatcatagtccttgagtgatataccagtatgatttaaggttacttcaccataattattattcttgaacttgattttgatattaatctcaatgtattttattgtctcatcatcactgaaattgtaatcaactttatactttttccaaagaagtttgatatctttgaagtactttaatttactttcaatttctttaaagtccatctggaaccaccatttcttgaatgtgcttacattttatatttgccatattggtatgtaatataatgctgtgtttacgcaatgattttactttgtagcactcattgagtactgaaataattccccataactcttctacactaatagtgataggttcacttgtactcagttgcatcagtgctgcttgaacatcatctttgttattaatagtgaactggattcctcttttgagaattttagtttttggattgtactcagctaatacatcaccttctggataaccctcatgaagtaataatgttgtttcaaaatcaccgcagttgaagttaatttcatcataatcaggtacacaaatgttcccttccccgtactcattaggttcagattctagtgttaaaatacgctgagtctcattgctcaggatgatagaatcattccagtactgggtagtgaatgctctacgtttcttttgaaagcacatactcgacattgaaccatacttcttgtatatggacttcttgaactcaatagcagcaggagccaccttgataacttcacgaattaagtcaatagcttcttgataactttttctcatttatcgtatccatataaaatatgatctagtgtactttgtacttcttcatgaaagaatgaagggtaaacttgtatcaatttatctttaagttcaagggaatggcatagttctaatgttttgtaacaatcctcgtactgtgccagatcatgtaatgtacttaactgaaaatgttgttcttcggagtacaataaatcataaaccatattatcggataaaagattagatttgattgaaggatcaagtactgtctggtggtgaccaacccaaaagatagcttttgagttaatgttattacaaccccatcctttccccatcttttggtgaatagcaaatacacaggaatcatacaaattaatgctcagacgttcttcgtctgcatggatagttacaccatcaatagatagtgtatatttgaaatccatagccccctcacttcgtgcacgagaactaaagaccagatatcgatgaattatggtattgattttatctgtccatccatcaacacatttggatgcacataatgtaaaaagatcatgattgtagttcataaaattctcctttaggacaatgtatcatacaaaaataccagagtcaacccctggtacgaatttaatccatcataagtgggataattgcccatatctttttcataatcatatcttcagtaaaaacaaatgttttaggagcagtatatgatattgacacaccaaatggaagtttgattgcatcatcaattatattatgaatatcaaaccatgttttaacataatcatacggtggaagttcatgaattgtacttaactgaaagtaattctcttcaccaaaatcactatattcaatttcacaaattttagtgaattgatgattccatttagatataatactatttttattattgtacatagtagttctatgcataaaaccatttttgctagtatgatttgatattacgttttcttcaatgtcagtatctattttaaaattcatatcaaagttgtagtacggacttgacgattctttgaattttaaatgtaaattgcgattgttattaatttcaatttcaatacaaaacacatctgaatcaaaacgattaaacttgtaatcgttatcttccggtagattctgtatttttttcataatactaagcatagggtgtactacacttttaataaaatcatttgttattttcatagtattcctttagaactttatatgattcaacaatactatcttgtgtataatttgaactatatacaacagcacttgttttagttgaccatagatatgacataaaggttataacactactacatggacttaatgtattgttttgaaattcaatttcttcaatgttatcagtactggtatagatgaattggaaagtacccattgatttattggacagcgatactatagtagaatccgtaccaggactatacatgaatgtctcattactaattgaactatcattagtatatgatggtttgggaatataaatcaaacgcatgatatcgcgttcaagacctgacttattactttccaccaaagaaatcatatctatatttgatatatgttcaacactgacatggaactttttgtcgagaatcacatctccatgagaatttttatatgaagacaaaatctcatacatctcaactaattcgcgtgcatttaataaactcatgttttgtctcttaatgaaagaatatccttagtataaactgaaacagaaatatgattatatttcatcattaatttatacacataagaagctagtactaaatcgtaaattaatttagtattatacagtacttggtattgtaacgcaagtgaatcaatatcatctttactttcaatatccagaaatgtaccgaaaaatgtagtaccgtagagatgaaaagtggaattaatgcaatcaatgcattcattgtccaatagagtagatgctgatgccctcggtgaatcccaaatagtcactgcgtgtatgccctcaacgaacaaatctatccatattttgtgtcgttgtcttttttttgttttataattttctggatttgaaagtgtagtttcaattatatcccatatgtacaaacaatcatctcttgtcattgtagcaccttatccattgctgcatttaatgcttttaaacgatcaacattcaaagtattgaagatgtacgttcctaaaatgtggaaatcgaattggttctttttgtatgtatgataaattaaactacaaaaaacaacagtactaagaacctcttcaggtataacagtgctcatctggaacagttcttcttcaactgtacttgaatctggattgatagcttttaacacatactcttcatcaccgaatagtactttaatattatataaaacaccaatagtactaatatggaatgggtgatgtgaaaaacttccatcatccttaatttgtatatcggttctaatctcacactcttcattacttttacttttattttttacaatacaaatatttctggccccagaaatagtaagaataccgtggtcgtaatattcatttgaccaacatttggatgaaattgatacatcacggatgagatattgtttttcaatttctttcgcactaccaacaattgatagcattttttttactgatatcatataataactgatggcgttctgtcatataactataagcgttcatatttttccttaacagattctatattttgaagtagtgtattcagaacatcagtcttgcaattgataaaatcattgtacataactagttcaccacaatcaagaatttttgcagtatcgtaacaaagcattaagtactcgaattctttgtaattgtccaacaaggatttctggaaaatgaatgcatctcgaatatcttcactttggtctaattctggtggaacatccaacccaataaaaccatcatcttcactgaaattagattctacaattttattcattttttcatgtaatgcattcgcaaataccatattataagaaatagaaccaatacgttcacgatttctggatgtgcgaatgtacatagtaatcgtatcccatgaacttttaatttttttagaaaattcataagttttatatacatccaactgaactgaaccaaaacgatgtttggatttgttttcaattttcagtcgataattatcaaattcaacaatttctgtaatgtcatgaatctctgaaagttctgcaatgtcatgcatgagtctcaaaattttagttctgatatggttcattgtgcatcctcgaatttaacaggtacatgttcattaatgaaattcttaagagcctgtactaaatcctctaattcttttgtactgtattttaaaatagttttaaagtgaatcaaatcttttctttccatgatctttggaattttatatgctaactctaaacagcgtacagtactggcatcatacaaaaggtttgcgttgaacattagaacattgtattcatcagatgaaattttataattatatgtatcaatcacttcatgtgtgtataaattcttatacacaattttattctcactgaagtttgagcaaacacacagataatcgttgtaaaatgaagaacgataatcttgtttacgttgtacatctgctatgatttgtaatactgtatatttttcttcagaatccaactcaatgttagcataactgctcgcagtttcagatacaaggatattgatgttatatttctcattaactttaatgtactggcgtgaaccagtatcaggaatgaacttaaaacaatgcttcagaagtaaggtaacttctttaattaattcagtactcatatcttctcctgtactctattaaaagcgattataacacatctgaatgctactgtaaagacgtaaacacaaaaagacccaatacgggtctttattttggtaaaacactgtcaatgtacgctagagcttcatctctgaggtatgttccatctatcgttaggtaatagttcatgggaatatcactcccaaccttctcataaattttcatacatgatatcacatcttcatcacaaatggtactcaattgaaaaagtacttcatcagttaaaggtacgatatcatgtttagatataggattggtattttcatttaaaacaatatcaaacaagttgggagtattctttgacgaaatgtaacgatgtttactacgaattaccattctcgatagtgaaatactggaactccatcttgggtccacatcttcgtatgataatgaaactaacatttcataataatcttggaatttcattgatgcataatatgttttttcctcaccgtacattccaaatgatttgaattcaatgtcacctatattgtgtgtatcactggcactattcacgaaatttaacagactgttgattagtctaattagaatatcatctttatccattcttaaataactccaagtgcatgtcgtataaatctctgaagtcttcatagaaatctttttctaccagaatatcctttaaactaggaaactcttccataatttcttctatatccgattctatgaaaaaccctgatggtttatcgtagttttgtaacagataactgaaagtaataatgtaaagaagttcattaggattgtgaattaaacttagctggaacatagctgattctaaatcggattcagtactaagatcaacccaacgtgaatttctataatcaattcgtacttgacttgtatttggattccatgtgaagcaatgtgtaccaatatgacctatacaaccaacccttgtactgtctccggtatcaacactgatatcaacaaatagttcaacacagatatcggatgatgttacacgaccttttttcagaaataaatcattatccttacgaaattgtttggatgaaagagtgtcaatgatgcacatcaatgtttttgcaaatgcaacacaatgacgaaattcaagcctatgaaattggtaatcattgatattcataattcaacccccaatattttatcagcaattgatataaccttatcattgaatacattaccaatctcaatccttatatacatagcaggtggaatctttccttgtagtgaataatatgtttgtatacctaagtactcattatctgataatgaaaatttgattctctccatatcaatgtctgttactggtaaatcaatcatttcataatggtagtcaacgttttcagtgtatattttatcgaagtaatttgaataatcactactaatatagatgctatcatcacgaataatcactttataatcagaaggttcaaatttatctttagaagaaaagaatgcatcatctatcttctcttctcttataccgaataacattttaccatcatattttacatcaagaatactacctagtatattaatggtacaatgctcatcaatattatgacgtaaagaacgagtcttgtattttgggttaatgaaaattttcattaattttatacaaatgtcagtaatgcattttacattctcattttctatgtacattaaaagccctctttaattcttttacatttttaatgaatactttcattgcagaaatctcaaaagataatgtattaaatttgcagtactttttaaagtacgacattatgaataacattttgagttctttttctgtataaattaaactgttttgaaagtaactttcttcggaaatgtccgtaagaaaagaataaaatgtattttgcttgtgcacaattttaatactatcagaccaagatttgtatgaaacgtaatcagtacgtgcaaaatcatatagtgaattagatgtatctgtgtatgtttccgagaacacaatcttatatatcttatcgtgaattcgagaacatatgtacctatggtcatctgtctcactgattgcaatgtatctatggagtaaatctttatgagcattgatgaactcaaacacttctaaacactccttagcgaacttcatagtttctctgtactttcggttcattagtctctccaaactttaccagggaagtgtttttcgtagtactcatcatcacttaacatataatcaggagtttctacttctatggttttgaagattgtttctggaatgtgtgtgactttattgggttgtactttatgttcgcgtaaaaccttctgtatcgctcctagacgttgtaaatcgatacatgtaggaagaactaagctgtactggaataactcatcaggggtcattatagacacatccttagcttgtttgattttattgttggcatcaatgaatatatcaaatccatgtacagcattatagcttacataggttgttttatttttgtcaataggagcacttaaacgatatccatataccccgtgttgatcaacaagacagcgttgcataattttaatcatttctaacataatttacctcatatgtattgtaacaccacggtttaacaatatctatttgtatatcatttgcttcatgaaaatgtttaagtaccttttggtattccattatttcgtacacatcttcagtacttatagtgttctcctgaaacaattcctcttctgataaagtactataatcagggatttttatttctgaatatatatcatttatctttccattattttgataaatctgaatataaaattgattgtactctggaatataggttacataatggttgtagttgattacatatcttgaaacaaagtattcagaaccatcagtcatgtactgaattgttttcttattttgcattcaaataatccacgcatttatagtagactgctaaatctaaaaagaatcgttgattgtatttgtaatgattaagtagtgcaccataaaataacatagcattaagtacttttacatcatgaatacaagaaccctgaaagtacatttcctctgacatgaagactaaatcattatacggaacaaatactgcttctctaaatgtatcaatattaatcttcaaatcagacccagggcaatatgaaatgtattcggctttgtaatgaaagtcattatcatcaaagtactccgcgtagatttgattacctctaccattagtaaatgctagtcttcctttagatgaactgaactcatcgtattgaaacataccaccaaaaggcattccaccaaaaggcttaggacttctgaactcctttgcaatgcgatagatattttctgtaaattctaaaacaccatagtaatcatattctgtagtaatcataaaccatttttctccaggtactcaataatacaatcgacattgttcaggtccaagtagaaatgatcactatcggaatttagttcatttttaagggctgttaaaatcactgaactgaaaacaatcctctctggatacacagtactgtactggaagaactcttcttcattgttaattacaatcgtatcaaagtattctcctatgagaatactattgtagtatttgaaattatctgaacttggaaaatggtatgaaataaaatctccgtttggtacagtatcaagtactctaataccacaagatgattcatctgaactatagagtaacccatccataaaggaaaggtatccatttcgtttaataactttatttttatcaattaaaaaatcttcagtaacattcgcaaggaatttataaaccctgataatgtcttttgctattttttgtgcattggtgaatgtgagttcgttggacattgtgttataaccctttacaattaatataaagggattataacacaaagaatcggtgggtgtcaagagggattgcgaagttctaccatttctttccaaactaattggtaatcttctaagtccagatagaagtcttcattccagtgctcatgaaagtacttatacatgaatagaactcctaaatcgtatgcaggaaacaataatgatagttgaaagtagtattcctgatttaaaactatatcaatgaactctaatgtacgtatgccacctttcgatgaacgtatctcaatgtgtgaggtatcctttatactgtaacacatgaaaccgcctctgaattctggatcatattcacattcgaactgctcactgttgttatagaaatctctcccactttcttgatctttcggtctacgtactgatacatgaatatttttatcacggtacattgaacgatttagtattttcaaacatttgaacttatcttctttaatgaacttgataatatcaattatatcttgtgctgtactgatagctgattcgaatgtatccaacttaagatgattatattgggttccagagttcatttttttatctaacatataaacctcataattcatacatttttgatttgaactgcatatgaccacctatttcacatggataacaattcataattttgttcaataaaatctggtattttttaataacttctatatcaatttttatattactattaaaaactaatgattcttgaaataattcaccctcgtcaagtgaagtaaaatcatttatcttcaacggtatattgttgcatcgcaaggagaatgtattttcatcacgaattaaagtatagaaatcattatgttttttattataatcaaatttcacaagtagtagtttaatatgagtagcgtacattactttcactaattcagtcttcataacggaataaaattctcctgtactgctccggtccagtactcaatctcttcactggataattatcaaagattcttttcatttctttctggattaaacataagaaatcaaagttacaatcgtacttattatcccatactaaactttcttggaataactcatcctcttgcattagtgtagtgtcaattacatcttcacgaacatagctatatacttcatagctcttgaagccatcttctgataattctaattcatatgcagccatatcaaacatatcatcatggtttgtcttcaatgatattaaacaagtaactaattttttagttgtatagtatgtaatacttaatgtgttcatttgttttatacctcagtataaagcttacaatagctttcatcaaaatcacaaacacttctcaagtactgacacaggtcattgaaaatatttacatttgatatatatacattatcaaattctgttcgttgaaagaatgtatgcatagaatttgtaatatatcgcattgcatcttcacgtcccatagttatatcatttgtgaacattgcatcttcatcagtactgatgtgttctattttaaatgatttcataaatggaatactctttcctagggcataaccatcaccatatgatgcttctactgcacctttagaataaaggaattgatataagtccgaatcacgattataaaaagtacgacatacggaggaacataatttattatctatatgaaataaaaatcttttagcatttttgtctaatactattcgcaatgcatcactctctagaaatatatcaccatcaagcataaatgagaactgtactaatgctttttctaaatccgctcgtttgtgataaatcatttcctgcatatatataatatcatttgctaatttcttaaaaaacaaatgcacatctgcactacaacatttatttgcatttattgacataatagttccttatacatatgatgtactttacaaatctcattatagtatttcatatcaatgtcatttgtattaaaaacggaaacagacaatactgctaacttatcaattaagtaattattatcggcgtactcttttaacttattgaacatatagatgcattttatacttaattcatcatgcaacacactgttctgaaaaatattctcttcagtattaggagataagtaatcttcaattatatacgataaactactatcgcaatctttatagattgaaattgatggatgtaatgtgtcatacattacactaaacagatcaccgtcatatgtggatattaaactattattggaaacagtaggatgataatatttcagtactgaaaactttgaacaatcagtgcagtaaaaatgatccatccctcgacgactttcgtatgagaatagtttacttgtatattcaatccctttggtgcgacggattgtttcatgcatttctgcacattgcattaaaattaccatacgttcaaacgcaatatctaaatcatcgtacataacggatatccttcttcagcgaattaatatattccaaaataacttgttcctgatattgggttcccaagtacatcaggactttcaactctttgaattcagtactatatgagtctgtttgcatcattctagtagaatatatattgaatagtttagcaatgtcattttggtctattattttcatatattctcttctggattagttcctgtaagtgctgaatataacccttcattgcaacatcctgtttgttagagccaacgaagaacaagagcttaaagtcatggtaatccatttttggtttagtagtgaaccatatgtcccacactgcactcacagttctcatgtattcaattcgattaaatgtttttgaatacttcatcaatgttaatcgccaataagttaatatacaaattactgttaaatgctatctgcaattccatatagaactgaatgatagcatagtcagggtcagtacacgatagttgaaaacactgttcgtcaaatgcattgtaattgtacttagggatgtgaatttcacgcttcaaatcaggttgaccccacttcatcgcatacacaccaatgttattgttctttttccttttcttaaatgttaattgttgaatatttccagcgttgtctaggaaaatagtattattcgacacaggtgcaccaatagaaaacaatgatgtatcaattacgtgtgtctcacgcacctcacacttctggaatgccccagtaccctgtaatacataatgaaaattgtacttctcattaacaacagtactaggatcgattaaaccagtactgcattttttgagtactggtacaatggtgcgaatcttttttgataaatcttgtaatgcatcaaagtcattgatgttaactttcatcactcgaatgtagcctcttcagtagtaacaaaattggttagtgtatccagttcagcagtgtcaagataaaatacatctagtacagatttctgatatattacactgaatgtgcatagattgtcaagtgttccttgttcataaacagtactaccctggaagtacccttcttcagtactcagggataaaatatctgaaattttaaaagattcttcagttgcatgtctttctatattaactatattgccgtttcggttcaatgaaatataatcgtatgctaactcaattagactataattatccgcattagtgtcaaataaagcgacaatttttcgtctcaatctctcatcgtgatcatggttttcatcagctaagtattcaggattttctttgaagaatttaacgacgcgtagaatatcatttgctttcttgattgcactttcgtaactcataataattcaaccactccatctctaaagtacatataactaccaccattggatactgtgaattctattgtccccaataatatattatatttttttatttcacatgtagtacttgtagtgtaaggctcaccatctcctaagtacattgacatatgacatagaacttttctaccagcatatttctcttcaaacgattgttcaaaactatgcataatttgatttaaagctgaaatgtaattaataaagtcaggtatttctgtcaatgaattataaaccgtacaaagtgaatcaaattcatttttagtcattatatttctatctcaatgtaatcctgtgtgattaagtaattccaatgatacttcacctgcttttgtaattcaattaacgtaaagaagttgatcgatttatcccatacgagcgattcctggaaaataaatgattcatgttcatcgtaataatcacactctaaaaaatcaggtatatattcactatcgtgaatgtattcaacaaacgaactagcttggcatttctttactactagtaataatgaattatcatgatcaaacagatacaataaactaatttcaccaggaacgtactgaacactgaataagtttttcattctataccttctggatctttacgaagttcttcgaaatccaaataaaatcgaggacagttaacactctttaagtaccacataataactaatgcttcaagtacttcatcatcgtaaacagtactgttttggaagtaatactcttcactatcccacggaccttccagtacttcataattcaaaattaatggttttttgcgattaataaaacgaatgctaccattttcaacataactaataaattctgcatctctattgtattcagaaaacgatataggactattggaattcaacccaagaataacccttacaccaacggagttattatacatttcatccttgtagtagttgccgttctcggctttgtacacttctttgaactttcctgcctttatatcgtcaaagtatccatgtagttcttttgctttttcaagagcactttgtaatgacattaccttctcctacagtattctctacatattcataatcaaaatagaaactactggagtcaatacttttgaaataccacataattacaataacatctaattcttcttcattgtacaacgtactattctggaagtaatattcttcactatcccacggtccttccagtactgaataaggaatgatagtgtcatcagcatcactatctgtgttgtagatggtaatatcttcattacggcaataactaatgtactgattgtacatatgatattcacagttatcactgtcaccagtatcagtgtgcagtactaatgtttctgcacatatctcggactcgtcataatcatcacggtcttttacaaaaaattcagtatcagatgttttatatacacctggtactgaaccttcctgtaccataatcatgtactcatgaatcttctttgcttctttcaatgcactttgtaatgacattacaaatcccctgtacttaaatattcacatgctccccagtcaagaaagaatggttcaaaattcaattccttaaagtaccacaacacaaccaaggaatcaagaatttcttggttaaaaatgagactctgttggaagtaatactcttcagtaccccacgggccatcaagtaccccgaagtcaacaggtgtatttgttgtgtcaaaagtaatcttagtacctggaatatatacaaaaaaattagtatattgactacatgaagagtactgtatagtattgtctttatcctgtcccataagtaaaatatcatcagagtatgtctttatacctgatagataatactcatcaccaaatgcacttactttatcaccatagaacccactttttatgttatcgtggaagtgatgtattctgtgtgctagttcaagtgcacttgctaaactcatatatcctctttaataactcgtagtagatccaagtccaaatagaagctaggacaatctgtattattaaagtaccacagaatgacaagcttgtcaagtacatcttcctcgtagatagtattctgctggaagtagtactcttcacttccccagtcattatccagtactgaatacggaagatgtttctctgctgcaccagatataatgtcagaatcttgtattaaaatatcagcatcacgacagaagtacatgtaattatcttccaaattaacatcacacccattgagtgttgtttcagaagaatctaagttttcttcatacatgtgaatgtactcactactgtcatcgtatctcattcgacaatatgatttaccttccttgaatagatatccattaagacaatttgctacaatttctttgctgcataaatcaattaacttcgcaatctctaatgctctttctaaactcatttcaacccctgttaataccgttatctacagttttctttacgtatttgtaatcgaaatagaagttcccagaaccaatacttttaaagtaccacataattataataacatcaagtacttcattatcatatacagtactttgttggaagtaatactcttcactatcccacggaccttccagtacttcactcggaattataatgtcattggaatcgctgtcagtactgttgatggtatctgtatcattaatatagaccatgtactcattatgcatattaatgaagcattcataatcattagggtcggtatctagtatgcacgtttctgtatctgagcagtcattataaaggaggttatccggtacataatattgagtacttgtgtctttgaaaacaccgtaaactgaaccttcttttgccatattcatgtactcatgaatcttctttgctttttccaatgaactctgtaatgtcattttataatctcatatattgaaataataattattcgttcttgatggggatggattaaatacgttttctttttcaaatctcttcatttcattttgcaaagaaaccatttcttcaaatgtacaggagtacttattcttatcaaacactaatgcagcctgaaatagttcaccatcgtccagtactgtataatctataagactctcagattcatagtcatagtcgtcatgtgatacatgaataaatttaaaacaagaatctttgtaatgcatatataaactcaactcatgttccgagtcgcccttaataagattacagcacaagtcccatcctttaggtaacttataatagtacatagaataatcatatgtcattcttgaattcctaaattgaatttgtattcttgattaatacttgcattgggtttatgaaaagcagcatactctttcatttcattttgtattgcaataacttcttcaaatgtacacaagtacttcttatcaaatactaatgattcttggaatagttctgcggtatccattaatgtatagtccggcatatcttggtgtggatactgtaatgaactgtaatcaatgaatgtaaatttaccctgagtgtaatgaatatactcatttgcactgtgcattaaatcacctttgtttaaattacaaaagtactgataactgtgcttgaaagtatgtactgatattaaaaaatcaaattccatcagtactcaacctctacataaatagattcaggaaacttagtcatataatcttctggatagttctgcattactttgatcatttctgcctgtgtagcacggacgtattcaattggtgctcctggtaaattccagacagtactttcctgaaagaattcctcttctgacagtactgtcagatttacaaaatcattacggtaattttttgaatcatcatatgtgaagattttaaaagacccattttcatatagtacaagaacaaaatgggagaatttttgtaatgcaccaccaaggctttccacgaccgcatgattcagtgtacagatgacctcttttttcctcataccgaattgaattctaatttcttttttcataaaatctccttcagattagtactgaatttgtacagaatattagaactgtatacagcctctgtatctgtatccataatcaaatcacctttgtttaaattacaaaagtactgataactgtgcttaaaagaatgtactgatattaaaaaatcaaattccatcacacttcccctagattgaaatgattacaaaaatcatcttcaccagtactgcaccagatatctatacattccctgtgaatacatttaattctacgctgtaattcaatcatctcttctaatgtacagatgtacttcttatcaaatactaatgccgcctgaaacagtgcagcatcatcaagtactgtatagtccaacatctcggttgctttacccctaaacccagtactaaaatccatcaaataaaagtcagcattccagtactttaaaatcttgtccctagcgtagtttaaatcacccttgtataagttagagtgcgtaactaactcaccagtgtacatccatgtccttgcacaaaattcattatattttatttccatcttaatctctactataattaataaggtaaactccaatataaggagaacgttcggcggcggggtattttttgtttcaggaaacatgaactgtactctgaaaaacacaatataaaactttatattaaacatataccttagcatgtttttcagcggaaatttttttgaccccccctgcggcctgtcaaaatgaaacgtctctatttattcagcctagaaaccttgatttcttcaatccttttcattgcacaaagccttcgactcgtcctctcgtatatattcaatactcgctgtaatgcattatctgtattatctgcaactgcaatctgaaccaaatatgtatccttcaaaatagaatccatcatgaattcaaaacctttcacactaaagcaatatgccacttccggctcttcaaacgtaatcataattccaatcccctattccctctaaccttctaagatatcttgcgtaaattatttcgaaatatctgtgcaacgaaattacggattgctcataatcatcattcctgtacattgtgcatgtcagaaaatcatttaacccaaaatctaaactgcacttgaacttctccttagcaacatctctaaaattattcataatatgtcctctgtacagcgtaggtgtactgtgaactcagcaccactaataggtaatctatattgtaagcacgatttcctcgttgactagcacggctggaataaagaatattatccacatatgtattgaactgatcttcaaataactctttcatcagcattataccatcacataatcatacatcatacattaacaactttatcgatgtaatcttctaacatatcaatatatctggtattggttctaactaaaaggtatgcaaatccagaaaactcctgtgtataatgctttacagcgtacatacaacgaagcttatcattgtcatacattgtactgtactgaaacaaactctcgtctgatagctctaataacgcttgggcttcacttctcgtgaacttcatagggtcatgtactgcatcacaaaaacaaacctgtgtctcgctattgaaaccctgtgatagatatataccttcacactctgaacgcaccgatactgcattataactatgtgttgcccccatcatatctgaactcaaaactaaaatcaacccatttttatttttaatcaacaaatctgacttaagggatttgatctccgtatgggaaatatcaccaaatcttcctgggacttcaaacttatcaacgttgtatacaatcttttgtacttgctcttttaaacgcttaattgcacttctgtctttttctaatgtatctaataaactcattgaactcattgtactttccttacatatttgtaccgaacaaaacggaactttgaatgccattaatcgacacttcatgtacatatatattttgtctgaacaaaggaactaattgaactaaactcgtttgtataataatatgcatatgtacattgtcatatgccgtttcgtattggaatcgtgcagcttcatcttctatgaaattcggaacttggactggattctcaaaatttgtccttgtactgaactgtacatcattgtcctgtaccttaataccatatgaattatcattgttatcaactacatcaaattcaattaaactaccatctttactgacgtttactatataaaccgaaaatcgactcataaacctatttcctctaaatctttgacaaatgtatcataatccgataatgacaaaaatatgtctgtactgatgttctgacgtaatgtattaaacaaattatgtacctgtaataaatcaggtgaataaatcagggattgctggaaatacgattcttctgtatctaatatatccctgcactcaatttcacgaactcgttggtatattgaatttaataatacattttcatctttgagcattggaaggtatcggatgtacatgttctccatcaactcatcttggattgaacccctgaactgcaacacgtattcaaaacacatcactacatcttgtaggtaattggcactgtactgattactatacacgattttatgacaactgaactcggaatcatttctgaaccaattgttaccctctttcctgtacttatgactaagcttcccatcctccaacgctcgaatgaacttcataatgttaattgcaaaatcatatgaatgatgcttgtgttgatgcattttttacctcaattctgttcgaaaaaataaccaaaatgtttaaagcaagaaagcattactatgttcatcactctatcatcaaattcatcttgtgtttctgcacataatgtttcactgatattcatatgtaataattcaagctggaaactatcggtgaaccaatcaaacttacggtatttttgtttaatatcaattataagcatactatatatccaacccttttacaacatctacgaaatgttcaaacacttcttttgaaaaataacctccttcacaaaaaagcatactaaacggtggcagcatgtccgataactctttagctaaattgatttctgctcttaactcttgaacatcaatgatatcatgtactaaagataattgaaacatgaatgcatctacatcctcattcatttctgaattgtaatataactcttcagggaatttgtcggtttcgtaataataaaaaactttattgttgaacacaccactaataggaacatcattttcatctttctttgaaatgtttgtttcccatgactcgatgttattaggaacaaaaaaatcataggctgatttagaaccctgtactgaatccaactttattccataatattccgtatccatgtatttctgctgcaatgtaataccacgtgtactgacattcacttggaatatatcatctttatctggaacactaaatggaatacataacactgaattctcagggtatttggcaatgaatgcatccagcactttattaagcactggaatggcaaatttactgtactgcatcaaatcatacattttaattctggtcatatcattcacctgtgtatgttttcacccttagcgattcaaaatcccatacatcactgattgtaccattgtgcctgtaatcataatattctactaatacattatacaataacttcaacgatacaaattcatgattccacggagctttattctcatgaacacatttggtgatataaggtataatatataaactaaacaacactaatggtgaatgtatacattgcatttgaaaatattcttcttcttgcatacaatgttcaggaataattagatcataatgtgtctcaaatgaatgtaaacctattgtggtttttttcgtatcacatgcgtaccatattgtactatccgaaataaatggaatgataccattattgtttgcaatgtacatcatatggtaagagcgatttgtcttgttaaatatctcgatactttcgatattactacaaatcatgtattcaatgcaatcaatgatcttatctttaaatgtaccaatttcattgaatgtcattgatttctgcacttcactgctcatatgttctccttaaaaaaattcaaatactcttcattgaaagcatatgtatcatcttttttgttatgcaccacataatcataaagagctatgaatgcagggattatgatcttacatgatttattattgtatttgtactgctccaaatcaacggtattcaatttagcaataagcatagcaacaaagatatcttcatggcggtgtactgtactgtactgaaaatattcatcctctccaatatcaggatgatataacggtatatccaaattattacgaattgacattttatatttttgtaatgcagctaaatgcatgaaccacaatctatcttcattgaaatatggaaaaataatttggtctgtgctaacaaaaatttcctcatttttatcgtattccacaagaggtgcatacattttaatttttgcagatctaataattaaattaaaaatataatgaatcttatgaactgcacttgatgcatcttcgtatgtacttgggattatgaaactcactatatgttctcctttaaaatgattacacatgataacagctttgcacttctttgtcaataccaaaacgaaaaaaagcccatatcttacgatacaggcgtgctgggaatgttgatttggatttcattgtacaaatcatcaatatatagacatgaaaaaaacacactatcttttaatatattgttgtggtaaagcattttaaatactacataaaaaaataaatcaatatcatcgtgtactaaattatgttgaaaccaccactcttccgttaaatcttcggcattaaaatcatcaggaactacaagggatgacatatcaccatcttttgtgtaatcaaaccacatgtcgtcattcggataacgttcatgcttctctgggtaacaattgctgggattaaatgttaaaatattaaaccccgtagagcaacgttctttgttaagaaatgtattattccatacctgatatttttcaccaacatcaaactcagatgatactgattgtattgcacataatgtactgtatattgtttctatcttgtgaacaaatttaaaggcagcatctaaactaaactctaaatcatacatgtactgcataaaattacctcaactaaagcaaggactgtattgaattccaaattacttgtaattccttgaaggtacatatactttgctactacatatttctgtactaaattataattattaaattcctcaaaattgtaatttagaacaaaatctgtactcaaaaataacttatgcatctctaatgcactttgataatacgcgtacaactcactgatatcaatactggttaaattatattgttcatatctatgatatgggatggcttcaatttcaatactataaaaccattctcttaacttattaatatcaaatgtattattcagcttcataactcaatacctccattaaacactcatacacaccatcaattgcataagcacaaaaattgaaattaattttgtgattcttgtgtaatggactattgtgtactgtactaataaggacattataaaacaacaaacgcactggcacaagcaatgaaccttggaaaaattcttcctctgatttatatgtattgtactctattgttttgttcgtttctgtatcatattttaccattactaacggggcatttttattataccatgcgtactctaaatcattctttccaataacagcaccaggggcgaaatccaaaagaccaataacactacgggaatttggggtatcaggtgtattgaatcgtttatcaaaatgactcgtgcacgcaatatatgtattgtacttcgatggaataataccaatacatttgtggaaatgacgcttgtgatatttctgtgcattatataaggctgcaacaatacaagctaacttttgtcccataaggattgcattagcgtaggtgtactgaatttcattgtaatcattgctttcattgtacttccagatcatggaacatccccattttacctgaattattttggattatgaattcattaaccgctttctgaatattccttaataatagcaaatcaaatccatttgtatcaagcacaaattgcatttggaaaaattcttcttctgataatgtattaaaatcgacaaaattatctattattacgtcattatccaaatgtgccatgtaccatgtatttctatcgtgtcgtttaataaaattccatccatctgaataatcggattctaattctacatatatccctgatactgtattaagcattttatacttcataactatatccttgcattaataaatcataaactacatggactaaattcaattgaatataaaattttaaacctttaattaatggattcaaatgcattgtactgaataacattagatacatcatctcatgcggttttgtgattaatgatttttgaaatacttcagcttcatcataagggtctatgaactgaaatttgtcttcatcataatttgtattggaatgctgatatataaaataatcatcattggtattgtaccacaaatacccttcgaatcctgtacttacatttcttgtcaatggtgatgctgatactggatttgaactgattaatgcacctacatcaacctttcctgatgcatcactgttctcgatttcaatatcaatgtaattccttgcgataacttctgttaatgtcaaatataaactaccacctgtcctctgactcaggattccatctatctgcgatataggatggttgttattgaggataagcattattgtactaatcttgtgtgctaataattctatctcattcataattcgccttatggattcgggtgcaataaatgatcttggtatattaaatgctcttgcgatattgcactcaaataataactaaaattttcaataccaccatttaaatgaattttataatataaatttatactcaccaataaagaatcatttaaaacatttatcgtttttgtatttttgtgctctgtgtgcgtggtgtgcattaatgttcttctcttaaaaagcgtttgatggcataatctaaataaaattcataacacatactatctctgttctttatccatattttgtaatcggattttatattacgcaacaaataatttgtattaattgtgtaataatctaatcgccctaatcgttccatttaataggatactcctttccttgtactatgtacgacaaaatccatccgtaatgaataggatgatttttgtctgaatcaggaataaaatataaagctgtacttggattgtgactgaataaatctttattgtcaaatgtaaaatgatctaattttattatacgcgttgataaagaacgtaatacatttttaacactgaactctgttcctttgtatttttccgataattcaaataatgcatctgtaattaaatcactgaactcttgaattacaaaattctgataaaatgcattaatctctttaaactctgtatacatttcacttcttgtattcaaaaggaatattacttgtttaagatcctgtactattgttgggttcatatttgtttatctcattatgtaccttaagcatcaaaatttgcatatgaattttttgttcaaggtgcttgataaatttctgtgccatttcttcttgttccgatgtaccaagataaaataacagattaaattctgataatcgcaaagaaaaatcttcatcaccaccctttaaacaaaaatccctgtactttgtagcgtacaaatattggtttacttttttataataccctgtgttttgcatacgatctccgttcgcaatgaacttatataataatgaatgtattgttcttgtgaacgtgttccaagaaaaataaacatatcaaactctgttctttttaaattcaatgcatcttttgttaaactagtactgaattccctgtacttttgggtcttccattcttgattaattgtcttgtacattgacatatatggttcttccttgtgtgccttgtattagcctatcaaacacatcgagcatcactttttgaatattaattagtactggcatcgtgcaaatatcaatgtcatatactaagctgtactggaataattcatcttcctgcatttgtactaaattaggtaaaggataattgtctgcctcttcatcctggtacttgaaatgcataacaccatcctttttgtacaaaagaatgtcaatatcacctaactcttctgcataaccaaaaatacatatactcgatgtttttgctatattaaatttcatctccacctctctccgtcagcacaagagtactggtacgttgtcgttagggtagggaccatgtttgtaatgggcatgttgttaacaataaccgtaacaggcataagaatcgtctcttctctactctgtcctgtccttgtgcaattcatcttctgcatttcatctgaatccatgaaatacaatacaaatggtgcaatcccaagaacaatacacaaaacgataaggaaatttaaaaaatttaacataatttttaccctatgattaacgttagtgtactatatcagtaatgaaaagtactgtcaagctagtattgcactgttctaatgaaagtacctgaactcatggatttaagcttatgaacctcttcctgcatacccttgattaaccctaaaggtataggtacatcatgtactaagctgtactgaaagtattcttcttcagataaagtactaacatctggaacgccaattttagttatataatcttgatgtgttgaccaataaattatatcttcagtagaattgtactccccatatactgaacaatattgatgaatatctttcctgtacccttgagcaataaagaacttatctactgcattaccagcattaatagaattcacttcgattgtcacagtacttgagcttgtataactcttagtattatcagtacttttaatactcaactgtgtgttcttcataatcaccattaggctcctgtttagattctttcattagtactatcatcttatgtactaatggcataggaaactctaaatcccatactaatgattcctgaaagtattcctctggtgataaagtacttaaatctttaatatcaacgtgcttgtatattttattttcgtaattaacaaatgatatatataaatcactaacataagaatcataggtaattgtgaatggcttacccttgtaatccattacatctctacatagactacttttgatatatgtatgttcaaatgatttatataccttgagttgtatattagttttcatatttctctttattagcttgtttggttttatagtgaattaaatctattaatgtaatcaagtacaacgtcaaatagtactcttgttgatctgtacctaatgatacaaagaacttgtgctcatagattaaaacctgtttctcttcaaatggacatttaatcctctgtataggcttaagtaaatgatagtacttattaaatctatgatacatttctagttctgtcagtactttcatattaaacacatactccattagctgtagcatcacgtaaagctgtcaaatacttctgtacggcttgctcttgcttatttgtacctaaaagtatatacatccataattcactgtaatgtacatcttgtgtataagggtcattgtaactttttgataatatagcatcaaattcagatgcatgaacccttgtgaacttaagaatatcttgttgtgttatgattctcatatcttttcctgtactatctgtataagaatccctatgtgtgaattaacagttctctcttggtgctgtgttcctaagagtgtcagtactatcatatctgaacgcaaaagatttttttcaagttcacttatatcagttcttgaatcaagtgccatatatttgtgattattcttcctgaatagtgccaagtactcttggtttgatattatcttcatagtttacttttaatttccattaaaagtgctctaatatgctcattgacaaatcgctcttgggaatctgtgtctagggtgagaagcattcttaaatcggaacctctgatggtatattctaaatcattctttgattctcgcataagtttctgaaaggatgagaagtgtaatcccatgagttcaatgtattctgctgttcctagtggttttggcattttagttcaatcgctcgtttaagtgtattaatataatctttaatgtcgtgttcttgatagttcgttccaagggtagctagaacatagacttcatttctcttaataattttatccatatctggtatatctgatgtgttaatgacgaagagcttcaaaaacagtccatttatgattgttaggtattctacatcggtaatgattttcatttgcatttgcattttctcagtactgattctttaagttcattgatgtagcactctacatattcttcttgtaggtttgttccgatatgtaacagtactcttaaatctgctctcagtacttctttgtcatcttcatctatatcagacagtgttatgtttaagaatttacttgaactctctataagtaatattactgaatcacctttgcttaaaattttcataatctctttttgctttcctcgccaaaaggtacatatacgattcttcgtattgtgcttggtagtttgtgtttaagagtcgaaacaacttctgttctgctagaacgagttgcttatcttcataacaacgatagcgtatcaactttttgtattcgatgttgattacatccattactataagcccatgttcatcatctgtcaagtgtttcatgcattttttctttttcttatatgtttagttaaaaggtatattagttttctattgtattcttcctgatagtttgttcctaatagtgcaagaagttttgcttcaactaaagctaattgacgttcttcaaatgtgtgttccagtatgtactttgggtttgattttttagcgtaagcactattagtcttcattacaatcttatgatattcattaactgttaggatttttaaatacttgatcatgtatcttttcctttatagagaatttaagatatcgaagcatactttcaatgtaatactcttgtctgtcagtgccaagaaagtacatgagttgaatgtataaaacttctgcactcctttccgctggagacttgtttgtgtcgtttggaagttgatttgtatgttttcttgatttaattagtcgttcttttaactcatcgtctgttaagtatttcattttcatttactttttccttaatagtgattttaagatatctaatcatacgtgcaacatattcctcttgtctatcagttcccagaagatatggtagtgattggaataatacttctgcactcctttctgctggggtttggtttaggtcaattggacgtttattggtatatctcttggcacgaactaatctctcgacgtattcattataggttaagtatatcatttcattttgcattaactttttccttaatactcattataagatgttcaatcatattttgaaccataaattcttgtttatcagttccaagaacgtatggtagcttctgaaacaatacatttgcagatacttcagatattgattgatttggaacgaacttaagagtaatgtttttggtttttaacatcttctcttgaaattcttcattcgttaagtatatcatttcattttgcatttactttttccttaatagtaattttgagatatttaattatacgttcaatgtgatactcttgcctatcagttccaagaaggtatggtaatctttggaataaaacttctgcactcctttctgctggggtttggtttgtgttgtgaggaagtttatttgtaagttttttggatttatctagtctttctgttaactcatcatgtgttaagtatatcatttcattttgcatttaatgttccttacatgaattgtctggattaaacaatcaatccaagtttgaacatatcttgtttgatattgtgttcctaagagactctgcattttaaactctgtttccagttcatatctcttttctatagaaaagcttaaatgaccatattccttttcgtatcttttcagagcttcccccattctggcaaaactttctgctaagtcgattttattaattttattcatagtattcatcgatcagtacaccttagtggttgggtcatttgataaaagtacagcttacctttgatttccagtagtaactccgcgattaagcgatttacttctgtatcttgatagtttgttcctaagaatacacccatctttaactcacgcatcataatcattttcttactgtgttgaatttctgggttgtgatagattgtattacgtttgtgcgtaatttttgtcatacgctcggtatattcatctttacttaaattgatcatttgcatgttaattacccttacatttattttcaatactattctttagtttgtagatatagttttcttccaatatatctcttaagtgcgattatgtattcatctacataatactcctgatagtttgttcctatgaatgcacccacctttaactcaagtttcataatcatcttatttccgtgtttaatgacttctccgtgatggatttcattaagtccaggtgcaattttcaccaggcgttctttatattttgcttgagataatttaatcattttcatgttaattacccttacatttattttcaatactattcatgagttctataagatagttttctaccttaccttcctgatagttagtccctaggaagttgcacaacacggcttctatgattttgattcttctggtatcaggtttcatttttttgttattgaatatttgaatccttatatctctggatgcatttaaacgtttttgatattcatggtaagttaaattaatcattttcatttacgtttaacctctcgctggagggcatcaattaacatcagtacagcattctcttgatagtttgttcctaagactgaaagcatctttatctcatttactaaaatcaacttctttgagggttcaataatgtgactatcataaacggccttacgtgctggataagttttcgccagtataacataaaattcgtctttacttaaattaatcatttgcatttacttttaacctctttctgtagagcgtcaatccatagatctacatacatttgttgatagtttgtgcctaagagtgcacctacatagagttcagttactagtgcgtgcttaaggttagcttggatgctcttatcgcttgatatcattctccttctgcttccacatgttttcaggagtctgatgtattcaaagccttgtaaatttctcatattttggatactaccttgttacgtaaggaacttaataatacgtcagtgtagatgttttgatagtttgtccctacgaatacacccaacttcatttcagctattataacacatttgtcctcttgtgcaatagatttgtttaacacaatactatacacttttgatttgatagtttgtaacctccaatgatactgatactcattaaggattatcattctctttcctccagatttcggttctcatgtgttggcagtgtgcttcgatgaacatatctattgatttggcaattgcgtttttatcagtgcctgtcatcagtacaagcatctctgcctcactatgaattaaacgcatgatatcatagggtaatatttcagatacagtgtcatagtgtttctgtgccagtgtctgcaatagtttacaatacattttgtgatttagtctttgtcgcattgtttattccattcttttttggctctatgggttttatattggatttggtttctcaatgctgccaggtatcgtagaatgaacagttcttgatagtttgttccaatgaatttcataagataaacatcaccgttgataacatccaattcaggtgcaccatgtaatgcatagttttttctaagggtgttaagaatagagaagagggcggtttgatactcagagcttgataaagttttcatatttttccacaattcgttcatttagttttatctgtataagatccattagttgttcaagataatcggtacaatatttctcttgatattgggttcccacaaagtacagcaaccatagctcatgaactttaactttcatctcgttccatgaaagtgcatcgtcatcgtagattactcttgcttctggggtgagctttcgaattctaagtgaatattcatcgttcgtcaagtgtttcatttacatttatcccttattagatttgtgagtgcaactatgtgttcatggatataaaaattttgatgagaagttccaagaaagtacagcatccatccctcactctgctcgacttctagtttagtatcgagttggtcagatatgttaatgaaaaccattagttcttttcctttctttctatttgtttcataagaacattgatatactcacccgcaaacctattctgatactgcgtccccatgaattccaacatccatacttcagcaaccttttcttcaatttcagtccattgtaagtacatcatagtgaagtaaatggtgttctctttttttctggcactcttagcacgggcctcgtattcaaagttattaatgatgttcattacatttgtccataatgtaattcttgagtgcaactatgtgtgcaataacatactcttcctggaagttcgtccccagtacagccatcatgcgtttatcggtggtgtttatcctgtgttcccttacacataaaccttctttgtgaggaagtgtaaaatatttgtttattgcagctatgataattttattcttctcggagttacttaaatgtttcatagtttactcctgatataattctgaagtgcaattaagtattcccctacataatacacctgaaagtctgtatcaaggaatgcacccataagtaaatctttttctaatacccttgataagttaaggtctgcatttgaaaggtatataagtaagatttcaccctgtgcggaattgaaacgtttcttatattcttctggtgttaaaaaaatcataatttgctcctgatatatttctcaagagatgacaaatacttttcctcataatacttctgatagtctgttcctaagaatgcacccaatagtatatcattttccaatacctcggctaagtttaaatcagaagtctcttcgtatattatgaggatttcaagttgtctggcagcgatgcgttcagtatattgatatgagttttctataataatcatagtttactctttatatcttctattaaaaatcgaatccattcttcaacataatcttcctgatggtttgtgttcagtacagccaacatgcggatctctgctcttgcaacttcaatttcagttttaggaaggtctttgctgatatccaccattaagtccatgtatttcaagataagaccgtatgattgggttcgtgttatagttttcattgtttcctcttggacaatatttcattttttaaggagtccatatattgccacacccatctaccctgatagtttgttcccaatgtaatcaaaatgtataactccattcgttctacgtgtgtgtctgtattataaatctttgtgaagtttttacgtaacagtgattgatattcttctttatttaaaatacgctttttcatagtttactcgttatatcttcaattaaataccaaatccaatcgttgacatacctttcctgaaagttagttccaatgaatagtgccataattaattcacgcttataggcaataccacggtcatgggacttatacattatcatagccatgttattgataagtctttcgtggtgctgttctttagttaaaatacgcataggataaaatccataggttcatatgtgaaaaaacatcataccccatgtgaggcatgatgtcaagatgttttgttcatataaatgcattatacttcaaatgaaatattcccagtagcacgtgagtctttacaattctcaatagtagtacatcccaatttttgtatttcacgtaccaattcaataggaagtttaaaatcccatttcttcgcttcttttgcgaacgctttctcggacagtacaactaagttttttatacgactcaatgaatagatatctgcatattgattttcatcaatagaaaataccatttcgttattgttgctaacaactgatacaagggtgtcaggtgcttcagtgatatcagcaatgaatgattttatagtagatgtaggtttaaaaaacaaccattctacattaaaggaagtaccacatttattagatgatggattcatagttctgtgacctctaatgttgagttaatgtaactaacatataaaatatgaatgaaatataatatagactatatattatcagaattatataaaaagtcaagcccctatcactccttttttcaaagtcgctaaggttacccgccctttagccccctacgcattttgccatagtccaatcctttttatttcaaaaaagtcaagggattacctatgcatttttttaacgcataattttaaaaacgccttgacttttttctgaatcagtactagatccctttacgcattaatccttcgttacgctaacgattatctgtgtatccccgtagtcctgccatacttccacgccatcggtcgccctggttagtcgtgctgtcatctgcttaatggtcttaggctttagtggaacctgttgcagtactgtacgcatagcactatcgacgttatcatgtacgcctgcaatagtgcctagaacgctgtatactgtatagatcatgtgtatgtactcctgatatagttaaggccgctacaaggcggcctatgatgtttggtgatgtgtaacgcttacagtcctaagatagtgcgtgcttcgttacgttccgtacacagctgcatgatgtgagcaagtaagtccttgctaatgtatccggtgtccatagcttcacggatagatacatcataagcaccgaaccccgtgcgaacgatacgcacatcattcaggttagtattatagataccgccgagatcaacggcttcgaatactacatcaacagaatattcattgttgccatcgtggaagttttccagtgcaatagtattggataccgcccaacgtttgcagtttccaatgatgcggcactgttccggttggatagtaccattacttacagcgtactccagtgcatctttaccaaaagtccgagccagtactaaaacgtcagcgaaggaattgattgagaaggtcatgataaaactccttaatttaggagggagaaccatttccccctctctatgtaaaacattatacttgattctaagtactatgcaagtactttttacattttaatacctggattcagatagcggtgagaaccatattctggatcggtttcggtccagtactgtaaatcgatagtacctttcgcgttaatcttgtctaccagcttattcatcttagtgtatactacgtcagcatcgatgcgtttaaagccagtagctttagtgaagtagtagtgatttgcttcactatcattaaggatataccgagcaccgtttgcagtctgtgcgataatgattgagtattctacttcccgatccagaccgtcgatgaatacagatgaaacattggtacggatgaaagctttaacgatagcgattgaagtactcattttgaatctcctaactttgtgggccgtcgcaccattgccgccctacgagatacattatcgcagtactgatatactttgtcaatactttttttattaatagttttcaccccaccagcagatagttactcaccgttattaactatatattttagatacacctatgcaccctgtgggctagtttttgtctatgcgtatataatagcaaagggactgaccggagtcaatcccttttttattctttttatgaaatatcttcgatgtagtcggcccatttcattttttcagtactgtcaatggctaccggattatttggatcaaaccattcaccattcccgcaatacatacccacggcaacggttttatagccatcctgggccgtactccacgacattgcacgatagatatggcctttaactggttgcagtactggtaacgttttatggtcttctacgtaggccatagcttgaggatttacccgatattgtgtgaattgttccatgatgtttccccttgtagttagtaaagttattacatcagtactatcaagctatgtcaatagtactgaaataaaacttttagattagattattgaggccgtcaatggtagactctctttcttctttctcccattgtcggtagtacttccatgcttcatgataggtggcgattagttcatctttttgatcctggttacatgccagtactgaatcacggtaagaggtgttatagatagaatcgaatgattttttctcttctgccaggttagctacttcccgcatcagttcatcaaagttagccattttattactccttttagtgggggaggacatctccccctatgcaaaacattatactttgttttagttattatgcaagtacttttttcatataaacattaaattctacaccgccgtaaccttccacgatgatatgttttgcgttatcacgtttgcacatagtgaaaccatcgtttacgtgttttgcattttccagggcgacatcaccgatagcggcacatacggcactaataacagtattccgcaaagtactggtatcgttagcggtcatagtagtttgcagtactacgttgtcgtatacgtgtgcattgatagtgatttcgatagtgttcatggtgtatctcctggactggcgggagaactattcccccgctctatgtaaaacattatacgttaatctaactacaatgcaagtactttttaaattttatttccgatatagtccggtctattcttttcggtcatacgctttgctaatgtttgcatatggcttattgcgtttaatgtgtcttcctccagggatgaatcaacataatcaggatcattcttcaccttgcaatgattatgatagcgtagtactgccagtacttttttaacttcttcaactgtcataataagtattccacttcgttagctttcaggttagtatcaatcatcagtggatttttgtagttcacaaaacgattagttttctcgatagcgaatcccatataatccagcttgcttacagtgcattcattcttaaaaacttctttcgctgcatcgatggctgattgcatggataaccgaccatctaaattaatgtttccaaatgatccaccagcggaagtaggattaccgttcatatctttaatgatcatagtagcggagtagctggacataattttgtttccttttagtatcggggagaactattctccccttgatgtaaactattatacagtactgatatactttgtcaatacttaattacgtttaaaatgatatgtgcctttatcatcctgtacgccccacactgatttaccatcaacaccagtgaaaccggattgtaattcaatatggaaaccattattatcaactacaaaaacttttttattttcatcccgataacattgatattctgaatcaacattaaaggccgcatcattcagaagattggaagcgtaaatgcaagtcattgtagtcatgattttattccttattaccagggagaaccatttccccctctctatgtaaaacattatacttgattctaagtacaatgcaagtacttttttaaaaatagttttcagtactgaatacttatataatagatacacttccgcaccctatgggtcagtgagttatctctcaatgaatatataatagcaaagggactgaccggagtcaatcccttttttaatcttttttatcgtgttaccttacttgcttctacatcacgctttttatagtactgattccagatattgcgggttaaaccgtaatcaagtactttaataaggccattacgatcctggccgatattctgttttctgatatctcttatcgttagtgttgataatgtatcatcaacgtgttgtagtgcatcagcaaagcggtgctggcgttcaatggcattacgtttaatattgtactttaattcattgcacgcgtttacgtgctttacactgcctttacttgcagtactcaaccgatccataacgataaacatattatcaggatcgcataaatgcatatgcacctttgcaaagtactgtttcaattgagggcggtcataatctaaaaaattccataccttacattcagtttcattttgttctacacccgcatcacaattcgcgaccttaatcactaaccgatcatttaaagcgaatacaatacgggaagaacccgcaccgatgatctccagaccagctaaccgacaagctgaaaggatctctttgttggtttccatttctgacagggtacggatgaatttagtataattacgcattgcatgttctccttgagttaatgaaactatcttacagtactttactatcaatggcaactacttttttaacacttacagcgtgaatcacttccttagtgtttttagtactgaatactttcgccgctccttgttcgaccgtgatacgatagcgaccattaacatcaaccatattaataaagtccggtgtactaaaccgagtagtacggcatttcagtactgttaacagttccaccagcgatgtagtttctttgatacgtttttctaaagtaatcattttgtttttccccgtgttggtatgtacatatagtactaaaacatttgagtactgtcaattagataatattatatttcttaaaataaaatgcgtcttgtgttggttgatactcaataccattgccgttattgacttcaactaataaacctttgtcaatgagttttttaatagtacgatacccttgttgaaaattggtaaaatgtgaatcattacgaaaggtataaccgtgcttaactgcttcatcaatagttttcttttcgattttagataatttcattttgtttctcccgtgttggtatatgtacatagtactaaaacaattgagtactgtcaacgtgatattagttttattttcttattatattgttggtgttcatataggtttatctttcctgtgttctcaattactattctgttgttagtgtctacatcgattacacgcagttttccgttgcttaacttccttggtaataggttaccattaataaactcattagcaagctgtacggcctttgtgatgattctctgaggggctttatagtgtacccgcaagatattatctttatatagttgaaccttaatcattttgtttgtcctataaaaaaggcgggaactgatcccgccgtgttgttagtactgcaagttattagataacctggcggcgtttactgtatactgttacacgattacccttacggtcgtgtcggatctctttctggttgcgtaccagttcacttggacgcttcaggtttgccaggtgatccgcgtgagtccaagcggtatggtttgtctgtactttgatatcagaatcagcgataaactcatcttgtgcatcaagtattgacgccagtaaatccgctcgttttagttctgctgctgttagtactggctcaggtgaattcacaatatcagagatctctttgaactgtacggcccagcgttggcctttcggtgcatctttgcccatgtctttaaatgctgctccttcctcgcgtgcaacaatacgggcagcttcacgggtagcgtagaatttagtaatcatggtatacatcctattagttgagttagtactacaagttagagtctattataaagtactatctgggcaatgtcaaatagtactttaaatggattctattacatatctttcttacgttttacatcgtagtatcgaactgttatttctttgttgatctcttcctcgatgcggtgaataactgtttctttcgggttgaaacctataacggtttctttaatgatctccaagcccgtgtattcgccttgtgtaccgtaaccgtaagtaaaggtttcatgtcccaggtcttcccagcggtcgccaattaatgcggacacgtagcaagagtggtaagtgttaccgttccgatcagtccagcgattaactttaatgtcaaaggaggttacgattttcagttctactttctgggtaaggatcatagtcatttttatttctctctctttgttaggaggggaaccattcccctcgcttgatgtaaactattatacagtactaagatactttgtcaatacttattttttggaaagtttacgcattaattctacgctttcttgtgaacgttttgctacctggcaagctgcatggacagtaaacatttttgtatagtctgacggtttgccaccgaaccgagcggcacgttcacgggcacttggaactaatacgatttctttcttacagatagtgcatttagccatttttatttctctctctttgttaggaggggaaccattcccctcgcttgatgtaaactattatacagtactaagatactttgtcaatacttaattattgtaaatgtcgtgaatagtgataaagtttttacgaccgtaaacctgcaaatcaatatcaatgtagtgcttatctagtacatcctcgacgcttaacgcggtgtcgtggatatcttcgtagaattgaggatctacaatcttgcttaagtcatccggcgttaactcatcgttaagccgttgaaccgcctggatatctgcttcacgtttccagtcttccaggttagtagtcagtacttgttcgatttcgttagctgtcagtagaatccgcattttatgtttccttatcagtggttgatgtaagtattatactcttttactttctattgtcaaactattttatcaggggaggttttcttatgtcttactcctggactacttaacggggttacttgtttcgttccccgtcctgatgtaaaacattatacttgattctaagtacaatgcaagtactttttaaaaatagttttcagtactagccaccagcaaacaatagatacatttatgcaccctgtgggctgatttgtttctatgcgtatataatagcaaagggactgaccggagtcaatccctttttcaaatatttttaaacttctttcgggttgcgataggtgatagcgttcgggtacatttgtttaatgttattccatgcctggttaacattataaccacttgagcgaatcagttggttactaccgacaccttgaaacactacttcgaataagaattctttcatgctttcacctcgctatctgctttacctttacgccaggacattactaattgttcgcgttgccataagtcgagtgatacaaaaagttttgcggtatcacttttaggatactctccagtagtacctaaccgataaaacagatctttcagtactgataattctacttgaatcattttattactcctgattgcgttaatacttctactattgcatgaatgatcataagtacagctaaaacaataatcatcggattcatttgcataagctgtactccttatattaatctttcagccaatgatcttgaatgaatttttcaccgtatccctgtttcatggattctaacaggcgttcgcggtgagcggcggcatattgctcagtactatgcgttacgccaggctgataacgtgataccccatccggtccgatgtattgtacatcccacggtttagcgttagtatcagaccatttacgaacgattagttgaccttgcatttttctttcctctcagtggggagaatcatttctccccttcatgtaacttattatacagtactagattatcttgtcaatagtttttattcaccttgtttgaatttagttttctccattgattccatgattgcaaccaatacaccgtggatctcgcttaacgcggaatcactaaaagcattaatgaatagtcgatcattctcgcgaatatttttaatgtacttttcagcagtagttgcgaattcattcaacggtagatcaaatgctttatcccatgatggatggcgtaattgtaacagtactggattatcacgatcaccaggggaaaacgtaccagtgatgaaacatacgcccggaatactttcgaactggcaacggacttcctttgtgatagtagtatgaatgtacatttattgttatcctctattaaattaatattacagtttatgaatcaattctttatctaagcgatagcgtacattattaatagtaacggcattgtttttaatgctacgctgtacaggtccaccagcaataacaaatgttgctttattaccccgaacaatgatagcacttccaggattaccgaaatcatcttgtactaaaatacttgataagttttccattttcatttcctcttagtaggggaagatgtttccccttgatgtaagtactataacactactgaaaactaaatgcaagtactatgataaaatcatgataggatattcactatcgatcagtacctcgaatccgaaaccttcgtaccattctttaagattaaaggcgttatcttctcccgtatcgcattctaaaatgatacaatctgaatcatcggcggcatcaataaaggcattcattaattcgttaccttcaccattgccccgactatcaggatcaacataaagagaatcaataaacgctacacggtcataatcaagatccggtgcaatgattccacgtttaacaaaccagtactgcaattgtgctactttgccctgtacttgataaccagtgatctcgccattgtcagtagtacgcgtgatatgttgtattcccatgatttctatcctcagttaagatataaaacattatacactatctttcagtactgtcaatactttttatctcatagatctatgccaacaattacgcgggggacgtttaaaagtactatcatgatcctcctggcaagttatgcagtacttacatcccttaacggcctggcgtcgtttctcagggattatatcgccgcagtcgaggcaatgtatcagtgattctatttgtgcgttaatttgctttctagcgtggttaacggcggcctgaatcactgcgttaatctcgtcttgctcggccccatctttcgcgaatccaacagccattattttaacctcattataaaaatactatagtactgtaatgcgacaataatattacttgttcttactttttccaatccacatgataccacatattcatccccatatgtgcgaaacgatacaccatgaaaatttttatacacttgcactactaatcataacctttcgtctaaccaactgcatagaattatactactttacgcaaattgatcaagtattgatcagatcattttttgatcaatattatacagttacatttgtgcaccctatgggttagtgacgttctcgtcttgatgtaagtattatgccagtacttgatgatattgtcaatagtttattttaatttttttctgtcattgattaatgctttcagtactatactaatgatttgcaatgattcatcaatgacgataaaattattctctttcattagatgatagttaccattgattgtatattctaacgagtactgtttacgtttaatttttgataatgtttctatttgtttttgtactgatttcatgctaatcattgttaaatgtcctgtaacgcattctaacgagataaacggtttagtactgacattgtatagggtaatgaattaaagcccaccagcgttaaccagtgggctataatcttacatcttgcggataatcttaacagtatctttcaccgatttaccgtcttgctggcattgctcgatcattgcgtattgttctgcggtcagatcctcgccagtttttgccagtactgcgtcgatgaatgaatccagtgcgatcattttatttctctcttaggttaagttaactactgttgataaaacttattatacagtactatcaaactatgtcaataactttaatagtactggtaatatattttagcggtagtcgtcgtatgctttattcacctggcgaatgtaactttcaaaggcttcgtctaccgtttcatactcccgaacataatcaccataggaaaccacatacatacctttttgatcttcaaacgtcatgatgatagaatccaggccgatgatttcagtttttgcgatgatagccattttttaattccttagtagtgtagttgataaaacttattatgtcagtactatcaaactatgtcaatagtactgtgataatatttttagttaatgatagtcagtgtaaaattgtaatcccctgcctggtatagtactttgtcgccgaacgttccaacacgtttcatattgcaatagatacccataacactttttacatctttgatattccgaacgccagtaatatccttgttgaaagtatcatgatcagaaaataaaacttgttttgcatttttcagtacagtgcggatattagccattttgttttttctctgttagtggggagaactattctccccttgatgtaaactattatacagtactataatctattgtcaaactattttttatattattcgaaatcttccggtactgactgataatcatcttcaccataagcactttctaaccgctcaccagtgtaatcatcagttagtgagtcatcctcatagttcacgtctacgccagtgatgtaaaactggctatcgtctggatcattgaaattaattttttggatgtttacaataactgtattgatgcccaggacaccgccatcagccgttacaaagtactgatagttttcacaaccgcctgaattgaaaccgtaattaatttcggcccgaccatcatttaaacgcagtacctgggcgatgatttcattttcaaagttagattgagcaattgagatagtcatgattcgtttccttattaccaggggaaaccgtttccccttgcgatgtaaaacattatacgccaattgagatagttttcaagtacttttttaaaaatagttttcagtactcaaacattatacaatagatacactcctgcaccctgtgggctagtgagctatctctcaatgaatatataatagcaaaatggctgaccgaagtcaaccacttttttcatttattttttagctttaagtactgcggcctttcgtgtcattccttgtttgatgtactcctttactttcgcttttttagcgtttaccttgtctgctttcgttttaggagtactgtaaattataccgttaggattcatttaaatcaccataaagaatagataggttactaacaatgccgcgatcaatgcaccgaccagggccgaactgtaataagctaatgatttcattttttagcctgaaaatagtgtttaatttgagcggcggtcagtgcacaattacgcaggaagttttctgtataactgcgtcgagtactgaaagaaaattgacctttgccgttaccgatagtaacatcaaaccgagcattatattgtttcattttgtttctcctgatagtggggagaatcatttctccccttgatgtaaaacattatacagtactgaaaactaattgcaagtattattttttagatttacgcaaactttctaccatctcaggagtaaggcccggcgggtaggaaactacttcatcaacgaaacgtaaagggaataccccagcgaaaggtgaacgtgctttcttagtattactcttttttgatgctttcatttcatattccttaattagtggggagaatcatttctccccttcatgtaaaacattatacgcgtttaaaaactaattgcaagtactatttgaaagtaaatgctcatacgctgcattaactacgttttcaataaccgactgtacagaaagatcccccacgtcctggctatagtagaaatcgcttacagtggtgtcatcgtatgcaaatactttaccaggtactgcatcaatcacatacatattaacctttaagatgtcgatcttatcctgtacagtaagcatattaattaaccttttaagtactggcttaagtagtctttttgatcttcggtgattgcagccatcttccctagtactggattaatgatataatcccctgtaacgtcctgtaacgcattctcaggcggtttaacggctggggtagccatagccatcgcctggacttgttcgacgctgtaacgctcataaaggcggcattcttccggtgttaacatagcatcagtacgcttcatcggtttaatgatgctttcgatctcattcagtacttgattaacgttcatggtataatccccaatataagcggcctgaatcgaccgctaacgatgttttgattaataggtgtatggttgacgctcaaacaatgattgcacgttgtacgccccgcttatgggcttcgctggcaaatcaattttatattgttcacgcttaaagataataaaacggcaattgtttttaacatcaaaattgattgaacgttccaggagtttaccatcgtgcacaaatacaagataaccgcttgctacttgttttgtagtactggttgcaaccatagaccgacgaacatgtgtacctgcatcgattaaagtactgatatttttcattttactttcctcttaagttgatttaatttctttcccctatgcagacactatatcaaagtatctgcataaagtaaagctaattaaagatcttttttacgttttacatcctgtacagtacaatgcaacgggatattaagatcattgcacaaacgatagagggaggtttcaacagtatcaagcccgtctactgattcctttaagagtgataccgccgtttgttgatatgcatcctcatagccataagtaaatgattcaaccgccagatcattcaagccgttatccagttcaacgcttacatgacaagaatgataagtattgccatatgaatcagtccaacgtttaccgtcaacattgattgcatggattgcagccagggaaacggtgttgatgatagttttagccattttagtattccttaaattaatatgtgtcgtcttgataaaatctattatgccagtactatcaaactatgtcaatagtactgtgataatatttttacttactttctttcgctgctttatatgttgccactgccataaccacatcagcacgaacaaagtttttaaccgtgtcactgtaataattgatcgcatcatctatatctgcgaacgtccgatacataccgcaccaagatactttataaccttctttcacttctgccagtttaacgatagtcttgttaactttgattttagtaatgatagccattttagtttccttgtagtggggagaatcatttctccccttgatgtaatgtattatactttattcgatttactttgcaagtacttttttaatttaattcatccaggcaaaggatacgttccacaccaagatccgttaaactaatggtcggcacttgataggtttcaatgtatgctacacttgcccactgaccgaactcattaacggcccaggtattcattgcattttgcaattccgcacctgccttgttcgtaatgactgcaactacttgttcgttgccagtagtaccagatacgcgagtaatgataatagccattgttttgattcctttgatttggaaggagaaccgtttccccctctcgatgtaaaacattatacgctaatctcttaatcgtgcaagtactttttattactttttgcaaaatactttaaacgccctcaatcgcattctaacgaccttaacgccaccagctagggcgatgtatcagataatcagtttaatgcgttagaatcgattctaggcggtgctggtggactggaatactacagacacaaaaaagcccactgtttaaggtgggctagtgattcagtactttaattgttatgcttcaactttgcgatgagcttcgatccattcctcgcgagtcataccgctttctttgatagcgtccagtactaccgcaatgcagttaccgcgtacaggaatcatatgttcttccccgttatcaagtactacagtaacacgttcttgaatccattttttaggtttagattctggcttatcttcaccatacttaaccgccagggctttatgtgccatttctacaactacttccagatccaatccagccaccgccgcctggatactttcgattgttgcttgcagttcggcttcacgggcttttttctgttcttccagttctgctacctttttggcttgcagttctttagcttcactgtacgcaatgttaaaattgttgcgtactgctttcatggtatcgttatccaggtcagccaacaattcagcagcaataacagtatcgtttgaaatcagtgctttcaggaatgattttacattagccattttataaatcctcaattaaagtttagtttacgtttattagtgtatcaaagttttatcgacgtgtccagtttttcgttcgacttactggcggtctacttagtgctccccgtcttgatgtaatacattctacgcttttctgcggtaatgtcaactactttttttaaaactattttcaaagtatgcagtactacaaaaacaaaaaagcccactgtttaaggtgggctagtgattcagtactagattataaacagttaattactccggtgtgcgttactttctcagtatccattacagtgaccgaaccgcgtttagtacttacatcgtaataaattgtcgtgctacctttttcgtcttcttcatggaacgggccgcttttaaatgcttctggctggatctctaaatcctttaaaacaatctcgccagtactttcatctgtcatcgcaacagtacactgaatgaatttttcactaggtacatctaacgacgcgttaacagcgaaagaggaaacagataaagccagggcgatgattgcaattttcatttgattatccttagttaccagggggaaccgctcccccttgcgatgtaaaatattatacagtactaaaaactattatcaagtactttatgattttttataaaacatttcagcagtgatatttttacccgttggctgtactttatccagaattttttgatgtcctggccgtccaaatgaatatgatccgtaaacagtaaaccagtagttaccctcagtgtttacatgtacagcacaatagggaacgccccgcgattcatcactagtaaagtgtgctaccgttccagttacattcgaagacgttgatttgatttgttcgaccattttcttattccttagttaccaggggaaccgctccccctatgcaaaacattatacgcgtttaaaaactaattgcaagtattttaataaaaagtatttgaaaaatagttgttgacaagtgcatccagtactggcataattactacatcaagacgaaacagtcactaacccaccgggtgccgagatccgtctattaaatgattcagtactgaaaaagtaacggggagttattatctccccgcgttgttatttggtaaggtataaacagaagtcacctttatttgctacaccgccagtgtaacgcgatgaatagttagaaatatcttgtacttctgctattaccagtgtatcatcattcatttcgtcgcagaagcaaacggctggatcttttacgccgatattgtcggcatgttcccgcatagatttaaccagtgcttccagttgagaaagagtagtgatattagccattgtattttcctcattaccagggagaaccatttctcccctctatgtaaacaattatacagtactaaaaactaattgcaagtactttttcaatattgtttgtcgtcgtcttcctcgatgaattgaccgacgaaatgatctactttcgctttgaggcttttataatcttcttctacttccgttaaacgttcctggtagtattccaatgcttcaagatacgccgcctcagcagtttttgcacgcatagctaaattcattccacgcgtttcatcaaatagccaataaccatcggtgcactggctaatagataatgacttgcttagtgctgtatagctaattactttactcattagatattcctcagtaaaggcgggaactattacccgccattatctcagtactgaatattacattccaaccattgcagcacggatcgcagtagtgctatacttaaagccgtccggcgttgtagtagtaccgttggcttttaatctgcggtacatacattccgctgcaatatctttagttctactttgtgcgatgcaactttgagcaagccgatacaatgactcaccgttattaatccaaaggcttacattccaatgagttttgtttttgtgtccgttgtaagttttagtactagccatttttaaatcctcgtttgagcggggaaccattccccgcctcgatataaagtattatacgcttttaaacttagtttgcaagtactttttgaattaatattcgattgattctactacgccatcaataacattgaattgatattcgttaccctcaatcagtgccgtaatgttttcagtagtgaattgatcctcatatgcattctctaaatcacggtacaacttgcgggataattcacgaatagtttcagtgagtagttcctcaagctcattaactaacgtttcttgttttgcggttaaatcagtgtaagccgattcaatgtacccgcttacagtattctcatgcgagtagtgggagtgagaacgctttacactcatcgccaaatcatcttcattcagcaagtgacggattgagcgatacttagttaatgctcttaccttgcgtaaaaacttcactgcgtcaacgtggtcagtactgattgatgcaccgtcaccctgggaccaaaaaccactgaattgtatttcagcgtcattaatgccatattccggtagtactgtttctttatagtattcaatttcactttcagaaaaataattgtcgtttgagtttttttcacgttcccgaaccagttcgatagccgccgcttgttgttctgcgttcagttcagaaaaagccataacgaaagtagtagtagtgatagttttcattttgtaaccctcattcagtagtttatgtaagtattat

SEQ ID NO: 7 - DNA, 346671 bp, Unknown
  Myoviridae
ataaggatcgcaccttaccagatttgctaagggagtttattaagtgattttaataaacagcctgaagtttgattgtatagactttcaggtgagtgtcaggatgattaagactgacgaccgttgcacatgactgcgatagagagaaacagagcaacccgctttcgttcttaatatatttttaagaaattcgcaatacaataaatgctgaaaccatcagcgtcaagaaatagagacttcattgtctcttttttattgtcttcattcccctgcggggggatgaaaatgtcctcaacaaatcccgtcaagtattaaatcttttaaagttctttataattaatttaattaaatgaatatgagttacgtagtaacgaatattcttcagctaacgaatgaaatgagttagatgaatccaataatattaaaattaatcctttcataattcaattcaaataattctgtagtttaaaaccaaaaaaaaccagcaacaatgtgctggctatatgaaaattagtgcttctcgttttgttttttaatttttttattaaaagacttaactaataagtctctatctattaatggcatattaaggagtgttccatagtcaatgttatccatatatacagaacattccattagtgcatttttgatttctgacttattcagttctatctccttcagtacttcttgtatttcttcaggagatgactggagaagcattactcgaaaaaatgactaggatcatattttagtccatcaatttcccattgatgattacatccatcacattctacttccatactatgagatacaccaatttcaagtacttcatccattttttcacgaattagtttaagtactcccttcgattgttgtccaagccattcattaataaattctttttcaactacttcatcaccatctggtgttataatttttgcaataactccaccaatcatatcgaagttaagttgagccatgttttcaaatacttcagaaaatatttttactttttcatctttatcaatatcagcagtttcaagaaacttagtcttctgctgctcactgaacatgcgttcagcaaacgatgaatattctttccatgtcagtggtctaaattctaaacgtagtccattatctaaatcaattgatgggatttcttcaaatgcttgtgcagtttcaagaagatatgatagattacgttcaaatcgaccttctttttcacattcaggacatacaacgttaatatcatatgtttcttctttagaagcaactttaatagcaataagaagcatttcaacgtcatttacatacaactcatcagcgtcaattacattaggaacacagttttcaataacacgggatactgcatctccgtttagtaacatatcgggggtattaagtgtcatttcatcacgtgcactacgtgcacaaactccacatttgacaccttttggacctagaactccttctttataaggaataacgccgtttgtaactaacttagtactgatctcttcaattttagtgtacttagcaagtggattcatagccattttattaaatctccatgtaataaatgtgttttagtatttataagactaaaaaagattaaattaaactaatttttatattctctatagtttcataaatatttctataatacatctattaaaagggaatgttatggctggaaatacaagtgattacctactccagcagttggttaatcaaactaaagataacaacgatagtttgagtgctattcgtgagttattggctgaaaatataaaaaatgatagaaagaaatccggttctaaaagtggaaaacgtaatggaagtaattcatcaagtactggaaaccgtggctctcgaacaaataacaaagctgatgatggtaaagaatttggaaaaatattcaaatcattatcatctgaagtatcgaatgtcggcaaaactatgatgagtacgtctgcaaacgttagcaatgttgtaaactcactaggaatgagtgcatcttcatttgctggttcattagcaatgatcccaggtccagttggtgcagcagcatctgcattcaaattggtcgctgacgctggtttagcagtttataatgtgttaaatgcacagcttgaagtttataatagaataaacagtgctggtgtcgctctatctgaaggttacggctccatattaaaaggtgctggtgcatcaatgatgagtattgatgcatttggtgaagcattacaaactcatagtgccgttgttgcacaattagatggtgcatatggtgatggtgtttctacatttggtaaattattgggtactgtgcaacaagcacaaaatcaattaggtttatatggtgtttctcaaaaaacattaactgatttaactgcacgtaatattaaattccaaaagcaatttggtggaagagaaatgttacgtagtatggatcaagcaaaaagtactgaacagtttatcatgagtatgactaagttcagtaaaagtatgggtgagtcagttgatgcactattaaataaaacacaaaacttagataaatcattagacacacgttcaatgcaaatcgcattacaaaactattctggattatctagtaaagcagcagttgcaacatcaaaagcatttaacgaagctgctgctagtatgggtgatgctggtgcagattttctacgtttaatttcacatcgtttaactattggtggagtaccagatgatttattgactccagtactgaaccaatttgctgatttaggtgagaacttggtacgtagtggtgttactgattcacaagaaattcgccgtcaacaattggaatttgttaaaaagaacaaagaactaataaagcaagatttattaaatcagatacaattaggaaacactacggcagcaaccttcaaccaacaactacttgatatggaagctgcgattaatgatcctaagagtcaaccagcagataaactaacacaattcactgatagattcaatagatggattagtaaagaatttactgaaccatttaataaaatgtatgcagatacacaaaattctattgcggattaccttactgatattgcagaccgtactgatggtgcatgggaatttatcggagagttagcacttgatggttttggtttggttcctattgcgaaagatgcagttgcgtatttggataggattggtggtgagtttgagcagtggttagaagggttaggtactgaaatttttggtagtggatataataaagtttcagaagcatttgatagctttatgaataacctaatggatcttcctggtaaactttgggattctgttaaaggttggtttggtggatcagacgacaaagtaaaagtagaaaacaattctgttaccgatggtgcagaaaaagttaataattattttgaagaaaaaatgaattcatttggtgattatatttctagttcatttgatggttttttaaaatggaattcaagtagaaactttaaacaaccaaaaccccttgatgaatcagttgctgaaaaacttattagtagtggtcttgaaaataagccaagagcaactgcgagaatcgaaaaatctgaacatgttgcaccatatgttaccataactccaaaaacttttgataaatcagcatggggtccaaatgaaccaccaattcaagctgaaccggacgattatgaggccatgaaagcgatgataaatagtggtagtagtatggcaaatgctaataataatgccacaatatcagaagacatgaaagagttacttaaaaaacttgctgatgttaatgagcaatctctatctgccgtgcaacagacaaataactatctaagaactatctctgaaaacactcaaggtgagagaaacagttaaggacgaaaataatgagttggaaacgacatatgacagtgggaaggtctaaactatcgaccatcccgaatcagtccagtaatagcaataaatcaacaggaacgaaaacaaatttcgcttcctatcttcctgttgtatataatggattggcaaaccgtactgagcgttatagtcagtatgagcaaatggaccaagatcctgaaattagaactgcattgaatataattgctgacttttgtacccaaagtactgaagattttggtttaccatataaaatcaaatataaagatgatattggtgatactgaagtaactactattgaagatcgtttagatgcatggactgaacaaaatgattttaaaacacgaatgtatgaaattgtgcgtggtcttctgaaatatggtgatcaatttttcattcgagatccagaaacattcgattggtattgggtaagtcccaaaaatgttgagcaagtatttgttaacgaagccactggtaaaacaccagtaatttattatatacgtgacgtatcattaaatttgaaagataaagtttttagtaaccttcaagtaggatttgataaaaccgcttatccaggagctattccgacaacaatgggtggtggtggttcagtagctgcgggtggtgcatctggttttacaagtcaaggaaatactgctgatccattcagtactaacggtcaattagacgttattcctgttggtgcagaacacgtaattcatctaacgctaaatacaggacaagatggggtatggccttttggtactagtatacttgaggacgtatttaaagtctataagcaaaaagaacttctggaagatagtatcataatttatcgtgtacaacgtgcacctgagcgtcgtgtatttaaaattgatgttggtgatatgcaagcacaccaagcgatggcttatgttgaaagatttaaaaatgaaatccaccagcgtagaataccttcaaacaaaggtggaagtacttcactaatggatgcagcgtataatccattaagcattttagaagactactttttcccacaaacttctgaaggtcgtggttcagatgttcaaacattaccaggcggtgataacttaggacaaattgatgacttacgttatttcaataataaattgattcgtggtcttcaaataccagcttcatatctaccacaaggtccagatgatggtggtgtttcattatttggtgatggtgctacacaagctatggcaagtgaattgcgattcaataatcaatgtatgcgttatcaacgtttagttgcaaaacattttgatgctgaattcaaaagatttatggttaaaaatggatataacattagtacttcatcttttgaagttattatgaatccacctattaacttagcttcttatcgtaaagctgaactagatgctaaactaattaatacatatcttcctcttaatgacttgccttatatggcgaaacaaacaattcttgaaaaaatgggcttttctaaagctgatattgttaagaatgaacaaatgtggttacaagagaatccacaagatggttcccaaccttctggtggtgaagaagattccgcaggattgcagtctgttggtattgatgctccaaatgatcctggaatggatcttggtattgatggagaaggtaatttggaaagtgctgatgccgaataccaagagcaacagagtggaagtggtggtttcgaccctaataatttaggcaattctttttaaacataaataacagtgtataagaatgagggtttatttttaccctcatttataatgcatatttcaaggagatcaaatgttaaaggacatctttgaatctagcagtgattcaatgtacgaccctgaagatgatcagaacgtatataaaattactgattccagaaaaccgaaactaacattacaagtattaaacaacttaagaaagtaccgtgaatttaaagcacatgaagaacaacgccgcaaaaatgtggttgcagttgtttatgccgctgcaccaactggtgacggttctgggttaatgtaaatcgaaaatcgcactttttaaagcttttaaaaaaggcgattttattcagtactaaataatatcatactttatacgaatgtaatatatctatggaggatataatggcgaatttaaaactactacaagaagcaattgcggcgtttgcaaatggcgaacaagatattgctgataaaaaaatgcgtaagtatttcgttgagcaagctcaagaaattaacaaacaactagaagaaagcatggaagatgaagacgacgatgaagattgtgaagtcgaagttaaagtcaaagatgaagaaaagcttgacgaagattttgatgtacaaccagacgaaggtctaaatgctgaaatcgaatacacccttggtgaagaagatgaaagtgcagaagaagaagttgaattctctgctgatgcagatggtgacggtgaagacgatgttgacgttgaagtgaaagctgatgctgatgttccttccgaagaccaatgggaatcaatccaagatgctttccgtggcctacaacaaatgtttgatgaaatcggtgacggtgaagttgatctagattctgaagaagaagtagaagatagcgaagaagaagttggtgttgacggtgacgacgaatttgctgatgttgaattcggcgatgaaaaattcggtgaatccttcaaactagaaaaagttgctccagttgataagaaagaaaaagctggcactcattccaaatctccagtagcaccagaagctaaatctccagtagcaggagcagagccagttaaattcgctaagaaaactgaccaagcaccactactagacctagatgataaatctgttctaccaaaagatagtctagatcttggtaaaaatgctcgcggtgaaatgaaagatgttaaagcaccaaaaactactgcatctaattctaaatcaccactaagcaaagcacaacctaaactaaaataaatatctgaaaggagatcattatgagtagtatgattcgtgaatggtcttcattcaatgattctaaagttgttttggaacatcgtgataatggatttggtgggcgtgactgctatcttcgtggtattgctattcaagccgaccaacgaaatttgaacgagagaatttaccctttatctgaaattacaagggcagtaaataacatgaaccagcgtttagctaaaggtgaaagcattcttgttgaatgtgaccatccagaaacactaactattaacctagaccgagtagcagcaatgattactaaggtttggatggaaggtgctaatggtatggcagaaatcaaactacttgatactgcacatggtcaaaatatccgtaaaatgctagaggctggtgtaaaacttggtgtaagttctcgcggttccggtaacgttgattataatggaatagtttctgattttgaaattatcactattgatattgttgctcaacctagtgctccagaagcatacccaacagcggtatttgaatctctgatgagtaagtacggatcaccttgtaatagttctaaaaaaatcactgaatctaaaaaagtaaataatttagattctgaaatatacgattttttcaagaaattaaaaggttaacattttaaaaatataaatatctgtatgttgaagtacagatatttcagtacttaaaggagagaacgaatgtctaaattagaaaagcttctaaaagaatcatctctttctgatgaggcaaaacagctaattcaggaagcatggaatgaagaaaagaatacactagccgcagagatgcgtgaagaaatgaaaggccgttatcagcaagatttggctgaactaaccgaaggtttgaacactatggttactcaagtcattgctgaagaaatgggtgctgtatatgaagagaaaaaacgtctcgttgaagatcgtgtaactctacgtaaaacactaagcaatttctctgcgttttcaaactctgttttggctgaagaagttaaacaaatgcgtaaagaacgtaagcatcttcatgaatgcatgggtaaattcgttaatttttctaacggtatcctagcagaagagctaaaagaattccacactgaaaaacgccaactagtagaaactcgcgttaaactacttgctgaaggttcacgtcaaattgctgaagctcgtaataacttcatcaaacgtacatctgaaagtgctgctaaatatattgcagaaaccactcagaagaatctatatgcgttgaaacaagatctagtggaagcaaaacaaaatatgtttggtcgtaaaatctttgaagcatttgctcaagagtttaatgtcaaacaatttaatgaaaattcattgctacgttccctaactgaatcaattaaatctaaagaagatgaaattgctcaagttaagcaagaactacatgaaactgctaatgccgttaaagctgctaaaaccaaactacgtattatggaagatgcacaagcacgtaatgcgattatgtctgaactagtaaaaccactaactgcacagcaaaaacaaattatggaatcccttctagctacttcacctactgaaaagcttaaagaagatttcagcaagtaccataagtcagtacttaacggtactaaagtaaatgaatctgctaccactcgtcaagcagttcagtcttccgctaagaaaactcttgcagaaggtaaagtaatcactggcaaccgtcaggctattgttgaaagcgaagaaatgaccgctgacgatatggcattcctaaaagaactcgatgttctttcaggtatcaataaaaaataaacattttaaagcattttaataatcaaatttttcagttctataaataatatcatactgaaaaacgaatataacatctttaaggagatatataatgtcacaactactaaatgaatccaaatgggtagcagtaaaagagaaactagttgaaggtctacagggtactcgtaagtctgtaatggaaactgttcttgataaccatcgtaaagttatgctaactgaatccgcgacttctggtgcaactaccgctggtaacatcgctactctaaacaaagtgattctaccaattatgcgtcgtgtaatgccaaccgttattgctaacgaaatcatcggtgttcaaccaatgactggtccagttggtcagatccacaccctacgtgtgcaatatgctgataacgcacctggtgttatcgctggtgaagaaatgctttctccatacaaaatcgctaaatcctactctggtgatctaaatgcggataatagcaacccacaagctgctcctactagccaactagaaggtactatgggtcgtcgcgttaacatccgtattctacgtgaaactgttgaagcgaaatctcgtcgtctatctgcacgttggactgttgaatctgcacaagatgctcaatcccaacatggtgttgacgttgaagcagaactaatggctgcaatcgctcaagaagttaccgtagaaatcgaccaagagctactaagccgtctacgtgcactacctggtgctgctgctgtaacttatgaccaatctaaagttactggtgttgcaaccttcgttggtgatgagcacgctgctctagcaactctaattaaccgtcaagcaaacgaagttgctcgtcgtactaagcgtggtgctgcaaactgggctgttgtttccccaactgcactaaccattctacaatctgctactacttctagctttgcacgtaccactgaaggtactttcgaagcaccaactaacgttaagtttgtaggtactctaaacagcactatgcgtatttttgttgatacgtatgcttcagatgccgaggacattttgattggttataaaggtaatgctgaaactgatgctggtgtgttctattgcccatacatcccactaatggcttctggtactgtaatggaccctaacactggggaactcgtaacaacttttctaacccgttatggctatgtacaattgactgatagtacttcatctcttggtaacgctgctgactactacagcaaaatcgctatcaaaaacgttactttcatgtaattgtaatcgatttcaaagatttaatcaagaaattaaaaacaatagggactcttcggagtcccttttcttttgtaaatacacttgtgaaattcatcatttcgtgttattattatttttattataacaaaggattttaattatggcttctaaattcgatgaacaatattacgtagacaagattcttaccatcataaaaactaacaacttaaacattgtatttcataaaataattaattttaaaaatgccaaaagtaatttttcatacacatgctgggattgtaaatcttctatattgtcgtgtagtatcgataacttctcatcaagaaaaaaatgtcaacattgtggtataatgaaacagcagaacgggactagtgttcctaaaactgaaagtcaatataaacatgcatgtttgtcacgaatacaaaatgagaacaaaccgtgggaatatatttctacctgctattatgttgataagaaaaattcaaaagtaaagttcgtatgttataagcatgatttggaatttgaaatttcatatgatggatttgttggtaaaaacgctggatgtttagaatgcggcaaagaacgaatgatttcttctaaacgaaaagatacaaatattatgaaaaaagagttgatgaaaattcatggtgacaagtacacatatgatgattttcaatatgatgaaacgtttgattatcatcttaccgagtgtgtatttgggtgctcacttcacaaagatataaaaatttataaatcattagcaaacttcagaaaaactaaccgagaacattgccccgtatgtaacgaaagtgaaggtactatgcgtgaaccatcaactttatatgtacaaaaaataactcacccaacaaaaggtgtattttataaattgggtgtaactaatgatatcaatcgtagaattagtcaacaaaaacattatgctcatactgaacatgatgttttgttaattgaaaactttgaaacacgaagagaagcacaagacctcgaacaaaaaataaaaggtactataactaataaagttgttgaaaaagaagatttccctgatggatacactgaaactttcaatgaagaagatttggtattagtactatccatgataaaagaatggaaaactaagtaaacaatctaaaggagttgacacggatgttaactgtatacaaatttaacaaagaagagtacttaaagagtcagtactcaaatatagaaataaatgttccttatggtacgttagttggatatgatgaagccactgaaacattgtattataatgatgatagattggattatagtttagattcttttatagaagatatacttaatacacatactgaagatatgttgtatgaagaatacatagatcattatagagaacgtatgtcggtgctgcattctgatgctcctgtactaaacatagcacaagaaccatcggaatttcagccacataatccttttcaacgtttaattgatattggtttaaaattcactattagttgatagataaatatctccatattaatgatggagattgaatctatgtcacagatatgttatgttataataaactctgcatggcctgactatgttaagattggtttcacttctaaatctgaaatgacagagcgtttgagaacgtatcagacagctaccccgtttcgtgattttgaagtttatcatgaagttcactttgaagacgcacgtttagctgaaaaagagatacataaaaggcttaaacaaatgaatgcaactagacaaccaaacacagagtggtttaaaatgtctaaaaagatagcagcaaacatcattgattctgtgtgggatgatatggataacgacttgctataggaataaatatagtatatattaatcataaagggatttatacatgagcataagttttaataacccattggatacaatgaccagtactggtgctaatggatctttagaactaatagtgcttggtggtacaccaactaacccaagacctattcgttttaattcgtcatcagttattataccagtacaaacgttacctactggtgaacaaggtgcaatggtttttgatcgaagcgaattagttttgaagtatcataacggtacaagttggattgcagtatatgatactgatactattttggaaccaattagaatttcattagatgaagtaaacagaaaattaaatttaaaagtagaaagtgtaacatacagtagcagtactgttcctagtgcaagtattagtggaacaaacttaaacattgtattccctactgcttctagtggtggttctggtccaactggtctttacacttcacttaaacctggtgctattacacaatattcattgacttctggtcaatctgttgctagtatacgtgaacaaatgtcagggcaatcgaatggacaaagtggacgaaacggttcacaaggtgctccgtggaaaacgtctgacggttggtgttttgctgatggtatgtggtggcaatgggagggggaaaatggtacaattaccaaacaagtaccaaaccttaaccaaaacgcatacttaaaaggtatatctacatctggtgtaactaaaactgatagtgttattggtagtagtggtaacattagtggaactgtattgagtgttgcccagttaccatcacactcatttagttttagtgggaccactggtgctgctggtcgtcatggtcatagtcaagcactaaaaggtatggaccgtagtggtctaaatgcgttaacttcaagtaatgataacggtataccaactgtaatcaataacattaacgaagcaccagaccacattcactcatttagtggaaacactaacacacttggtggaaaccaaccacactatcatggtattagcaacattgatgtggaacactttaacgttgcatacctatataacattgctgaatctaacgtcgcattgagtgaaaaagttgcaaacactcgttatgtactaaaaactggtgatacaatgactggttcattgactattgcaaacagtgcgtcaattaagtcaaatgatacatcattagttctatatttccgtaacgcaagcggtggtgagcgtgcggcagtgtatcataactcttcaaataatacattgagattacgttccggtggagcagaagttactgtaaactcttctggtactttagctgctccatcattaactgtttctaacaactcagctactgttggtggtaaaaatattgttcgttcaattaacggtactgctgctgatgctagtggcaacgttactttgcaaattagtactaataacgtacaaagtattcgtttgagtgcacgtattgaaacaagtaaaatacctgattcttcatggacatatacaccagaaggtgcatttatggatggcgtatggatttctgttaatggtagttcaggcactcacttagaacgaattagttatcgctatgttcaaatgcaaataaatggtaactgggaaacagtacgtcaacaataaggaatgtgtaatgcaactaacaaattttaagatgtatgaaaaagaaggtggtaatcctaattctttgtatatgatgtccgatgaaggtatggattggtatgaatctcgtgaattgtttgacattaataaagcaaaatttatgtatgatattaacggtttaattgtttcagcatcatataacatttatgatctagtacctttaggttttagtgtttctgaaattgaatatgatggtgatattaacaaactttatggtatggtttacgatggaaatactattcatgactatattgaaactaaagaagaaaaaattgaacgcctaaaaaatgaattatctaatttgaaatacattgcaattcaagaacttggacacttaaaaactgctatggatcttgagttagcaactgatgaagaagctgtattgtttgtgaaattgaaagattatgtaacgcaattgaattcaatcaaaccagcagacatgatcaagaaaacattttcatttccagttaaaccggaaaaaaaatgagacaacacgtaaagacgtgatacaattaagtcatctcaccgattgtggtgaggtgacatttttttgaaaacacacatggagaaatacaaaatggctaaatctaaaaaagaagttaaagttgaaattcgtgatctaaacgatgaacaacgtaaacgtctcggtgacgcacttaacaacattgttgtacaactaactttcattgatgataccaaagcatccttatctgattttgtttctagtgtttctgatgaacttggtatcgatgcatctgatatcaaacaagctgcacaacgtatgtacaaaggtgattactttgacaaacaaaataaactcgataatatcgaaactattcttagtgttactaataatcttccacaagcagatgattactaattagtactaaaatatattaaatagcctccaatgacggaggctttctttttaacttaataaacgtaagggaatacaaacgatgtatatcgatgcttatatggaacgtaaacgtactggtgatattcttcatgtagttgaacgtaagaatggtaaacgtattctacgcgaattagatccagtatatgaatattatgttgaatccccacaaggaacacataaaactgtttatggtacaatggctaaacattttgagtttcaaactcaagctcaaatgaataaaagtgtagagcaacacaaaagtgaaggtctacgtatttttgaaagtgattgtaacattacatttaaaacattagctaaagaatatatgggaaaaggttcacccgatttgaacatcgtgttcttcgatatcgagactgatttccataagaaatttggttatgctccaccatcagacccgtttaaccgagtaaccgctatttctctatatcaatcatggactggaaaggattatgtacttactttaccacctgctgatatggaaatttatgaagcacaagatattgttcgccaactaaatgaagaaacaaacgatcctaacagtactgtaattttatatacagacgaaaaggaaatgtttatggaattctttagtttaattgatgattctgatgttatttcaggatggaatagtgaattctttgatattccatatatgatcaatcgaactaaaaaaatcttcaatgaagcaacaactgctcgttggtgtttatggaataaaaaaccaaattcacgtgaagcagacaactttggtaaaactgttcaaacatatgatctggtaggtcgcgtccatcttgattatttggctttgtataagaaacatgctggtcaagttgaacaatcttataaactagattatattgctgaaaaagtaactaaagaaaataaagtatcctatgaaggttcattggataaactttacagagaggattacattactttcttgcgttattctaaacaggatagtattcttcttaaaaagattgatgctaaatgtgactatatcaacctacacaatcgacttgcacacaaagaatgtgtacttatcagtacaacaatgggttcagtagcactaatcgacactgctattatcaacttagcacatactcgtggtgaagttgttttcaacaaagcaccgaaagatgatcttgagtttgatccagaaatggaatattatggtgaagatggtgaagaagaagatgagaaaattagtgcaaaagcagcaggtgcatgggtacaagatccagtactaggacttgtaagtgaccttgggtgtactgactttaactctctttaccctactgttctacgtactttgggtatgagtactgaatgtattcttggtcaattacgtcaagattacaccgatgcgtatcttgcagctaaaatccaagaacagaagaacaaatctaaatctaaatcatttgaaccagattggactgcggcatggcatggtttatttgctgctgttgaatttacaatggttcatgaaaagtcagaagaaacattgattgttgatttagaagatgggagttcttttaaagcaacgggcaaagagctatatgatattatttttgcagaagatagtactattgtacttagtgcaaacggaacactttttgataagtctaagtctggtgtaattcctgacattctaactcaatggtattctgaacgtaaagcacagcaaaaaatggtcattgactacaaacatatgtatactgatggttgggagtttaatggctatgaaaaagtcgaaccactactatcaaactatacccctggtacaatgtttagaactaatattcatgataatgatcctgtatacttacttcgtaaagaaattggtaaaggacagtgggatgaagttgctaagttgattgtagaaaacggattagtactaaaagatggtcgtattttctgtcctaaagaagaaaaagattacttcaaacaacgtagtgctttctggaaacagaaccaacagattcgtaagattcttctaaacagtctatatggtgcactattgaacaaaggttctcgtttttttgacaaacgtttaggtcaatccgtaacattaactggacgttctatgaccaaacatatggcaagtcgtatcaatgaaattactactggtgtatataaccaccaaggtggttcagtaatttatggtgatactgactcagtttactttagtgtaactcattatctgaaagaacaaggtattccatataatctatctaaagaagagattgttgatatgtatattaaaattggtgaagaagttggtgaatctttcccatcatttatgcatgagatgttcaacactggtattgaaaaaggtaagattgttggtgcagaccttgagatggttggttcgcgtggcctattcttgaagaaaaaacgttatgcaattctgaagtactgggaagatgggttccgtaaagatattgatggtaaaccaggtgaaatcaaagcgatgggtcttgaaattaaacgctcagacacgccaaaatacatccagaacttcctagaagagactctaatcgcattactggtaggtgagagtgaacaacagctaaaacagcgtgtacgtgagtttaaggacgtatttaaggatatgcctgtacatgaaaaaggttcaccaaaaactgtaaaaaactacactaatttagaggctgaatatcagctaactggtaagtgtaaagttggtcacgttcttgctggtatccaatggaaccgtctacgtgaagtttatgatgataaatctgttccagaagtaacagatggaacaaaagtaattgtctgtaacttaaaagataatcctatgggaattaaagcagttggttatccaattgactgtgttgagtatcttccagaatggttcttggaactaccatttgatactgaaaaaatggaagagattgttctaactaaaaaattagagaatatttttggtattttggatatggatattggtattcatgaaaaaagtactgcgtcagtaaacaatggattcttcacttggtaaggagtaataatatggttattgtaaatgaaattgaactaaactatgacgaagtaaacgatactttcactaatgagatgttgaatcttactgaagaaagtgtaaatgaggcatgggaaaaatatgtagaatggacttcattacaaggtaaaaatgatgagtaatatatataagcgtattggtgaagtattagaaggtaatggtatcattaattctgtactagcatatgataatgatgaagaagtagttctaattggtgcgggttttactcgcactggttcagtggaagttgacggagagattgctgatgtttacactcttgtgaaaaagcgtaaagttgtttttgtcgatgatgtacatacattaaaagacttgaaaaaattacgagataaaattggcatgagttctacaattgataagccttatcttcaacgttggaatacaaaatactgataaaaaattgagacaagcatcatttttgagatataatggtgcttgtagtaatcttacataaaaacattttttgattaacaaataaaacggagaattatataatggatctacgcaacgtactacgtgacctcgtaaacacaaccagtggtattgacttctcttgtattgcagtaagcagtgaagaccgtggtgaaggacaacgtgtatatctagaagcgtacacagatgaccgaactcttgtaatgcgagcatatactaaagaagatgttcctgaagttcagggtcgttttggcttaggtaatctaggtcttcttcagggtctaatgtctctaaaaacatacagtaccgaaggaaccacaatcacatcaaatgttaaagatggttcagttaaaagtctggcatttaaatctgaagatgcaagcactacatttatggtacaagctgaaaaacttattccagttcaaccacgttttcatgaacaaccatatgacgtacaggttattcctagtgcagcaaaagttcaggaactaaagagtttttctggtgtatttaaatcttttagttctcttgtaactccgtatactgaaggcgacaccctatactttcacgttggtgagaaaaacaaaagtaaccacgttggttctctagctttttctaaaactgaaggtgaattaggtcttggttttggttataatattgatcgcgtacttcaagcattatctcgcgtatctaatgccgaatcagtatcacttggtattactaaaactggtatgctaaatgtaacactagatactggaattgcagtatacaaattttacgtaacaggctgctaatataaataacggggaacactatgttccccaaattagtttgatttaaaaagtaaaggaatacaaaatgccattatatacatatcgttgtgaaaaagaagaatgcaaacatagcatggaaaaaattgttaaaattgcaaatcgtgatgaacctcatgattgtcctaaatgtaatggtgaaaaaactatgaagttggaagtgttcactccaggtgataagggtgctaatctttatttccgtggaaaatggtttgcaaatactggaggttactgatatgaaaattaaaatgattaatgattacgttcttgttcgacaaattgaagcacagaataaaagtactggtggtattattctaggtaatgttgaaccaccatgtattgggatggtaatttccgttggtccaggtaaaattcttccgaacggacaacttgcagaacataatattaaagaaggtgatatggttgtgtttggtcgttcatctttgaacacaccactgactgaagatcttggtggcggtgaagatacatattatgtaatgaaaatcgaagagatttttggtaagaaaaatggctaaaaagaaatttattccattttggatggtccctgctcactggggactttctggaaaggcaaaagagatagctaaagcatactactacaatgatgattatgaagctgatatgaaagttgctgaattgacatatctaactccatatgaagttgaagtggcccaattggatattaaaaagaaatatagcgtaattggagatttggaatatctaattgctgcacttgatgttgaactaaaatattctaaaattactcgtgaacagtatgatgttaaagttcttgatgcaaaactaagtattggagttattacagaaaaagaatatgatatggaaatcattgagttaatgccagaaggtgatgaaaaaaggcttaaggctattgaatttgcatatcgttacgatgaaatcacacaaagtgaatattctaaggaaatatacacacttcgtaaagaaccttggattgatttggatgttgttcttgatcctgaaactaatgaagttgagtttgtatttgactataatgaatatttctggaaaaagttgaaagctgaaggtcatccaggaaatgatgaagaagaaattatcgataactttgtgagagacttggggcgtaaacttgctacggatgatttcagtgatgattacgacacaaagctggtgagtgcgaacgaaggattagacaagctacctggtttgcctgaaggatttcgttcatatagataacatataaaaaaaggagagcaaatgctctccttttcttttgaaaaatattaaaccaatgctgggatgtattggaaaagtttaacaccgaaatcacctgctgcatcagcagattgggaacgtaggtaaacttcggtaacaccatctttagcaagtagtggaacaccagttagatcatcaattagtagacggccttcttcggattcagtacttggtacaccttgtggtgatttaagatctttgttaaagacacccgcacgttcaactaggaaggtaacaacagaagcatcagcaatactaactgaacctgcactcaatacaccatcaggtgcgttggtgaaaccagtaactggaaatacttcaagaccattacctgcgatgttagaggtagcgatgataaccgcacgttgttgaacaacatcgacaatacgtttaacgttagtttgtgctgcataagatgcattgtaatcagcttctagtgtgccaagaacaaatgcagttccatcaatacgtttgatacctttatcatttagatatgctagaatttcttctggaatatcagtgtttagaaaacgttgtagaccagcataagaagaaactgcaccagtaactagaacgtttacgtctcctagcttactgatagcaatagatgctagggcgttagtgccacaaaagtaacctagaatacgttcaaaggaataaccattgatacgttcaaaagaagtattagtatatgacataatctatcctcctattatagttgaacaggaagagcagcacgtactttaattgctacagcagtagatgcacctgcatcaccaacaccatcagtaccttgacttacgaaagttttggtacggaaaactttagcttgagcgatagacttagctaggtcaacagttggatcaactggagcaggacatgctgaaccaggacgaacttcttgcttgttaaatacgtcttgacgttcacagatgaaagtcaatgcaacagaattagcaccacctgctacatcagcaccactagtgccgaacgcaactacgtttggattagcatttttgaaatcagcaggaataacaacttctgaatcaagagctagtagagaggtagtaactagaactgcacgttgttgtagtagttgggtaaccatgaataggttatattgagcattacttagagcagtttgatacgcttcagcttgaacatcagaaccgtcagaagtaactttggtagtacctagttcaacatcagttggtagatcgattacgatggtaacgaaaccgttattaccaccccaccattcgcgagcaacgctagacataccatagttacggttaaaagaattaagactcatgaaaatctccttgtcaaattttgtgcaggtatatcctgcttaaagttatttatcaaaaaatatcactagcatttaaatttactgagatatttaatgaatttctatgatattatttatcaaatctgggaaagtgattcaagatgtgctataattatcaatgaaaatcattgaaaattgagttttcatgtgccaaatcaacactattaaaaggatttacaatgaaaaaattatatctactcgtcgatactcaaaactgtttccatcgtagtatcaacgtatcatctcaaagtattgacatatggacaaaggtggggttagcactacatattactttgagcggtttaagaaaactacaagacatgtttaatcctaatcacgttgttttctgtgcagagggtaaatcatggcgtaaaaagtttgacgaagattataaaagaaatcgtgcagtaaaagcagccagcaaaactaaagatgaaaaagaagaaatggaagtgatgtttgaaatgattaatgatttcatcgacttcgtagataatcagactaacagtactttactacgtgcaccagaagcagaggctgacgactttattgctcgctggattcaaacacatcctgaagatgaccatatcattgtcagtactgataccgacttccgtcaattacttgcatttaatgttcgtcaatataacccagtacaagaaatgatgtatacaacaactggtgtttttgataaaaataatgaaccagcacatgataaaaaaggaaaaccgattgaaactcctaaccctgagtttttattgttccaaaaatgtattaagggtgatacatcagataatgtattcagtgcatatcctggtgcaagaatgaaaagtactaaaaaagcagtaggtattgaagaagcatttaatgatcgtcactctcgcggttatgcatggaattcatttatgaatcataaatggactagaccagatggagttgaagtctgtgttaaagatgcatatgcacataatcaagtactggttgatttgactaaacaaccacctgaaattattgaaatgatggatgatgttatttttaaccgtgaacctaaaaataacccattaatcggtgttcatttcttaagatttgccgctaagtatgatttagtacacgttcaacgttcccctgaatcatatattaaactattcacaaagaaggatgagtaatatggcaattctaaaaaaattaactgattattcttatatcgcggaaactgatagttcagaaaagattggtattctaatagatcatgatagaagcccaactgaatataaaggtgttgaattttttacgtcagatggggtattaaagtttgattctttaaatgagttggaagaactattaggaacaccatttaaatatgaagaagtacaagttaaggatacaaatactaagttcataggagattatccagttaacgaaaccgataatgtttatgatgtacaagaaacagacagcggattgtgtacttttaagaaaagtcaaaaatccaaaaaacgtttttatcctggctggtggcttgttaaaaccgaagctgggacatataacccacgttgtacaatcagtactgatacatttgatgaacataaagacgatatatatggtccatataaaacatttatggaactaacttatcaacaaaaaaacttataaggagattagggaagtacattgaaaagtacttccctttatttgttatggataatttaataacttataatacattaacgaattatgatagttcaactatctttgatagaatgttagaaaaatctgataatacgtatgttgctgtagttcctccaagaattggtactaccgaatctataggtgcttatgcactttacaagattttgaaatcaaaagaacgtcaaagtatggttatatcagcaccaacttcgtttaaagctaatatacaatcaatgaagtttcattttgaaaaaatgatatcaaatattaataataactttgatttggaactatcagttatgcatactggttcatcaagtattattagatgtaaaagtactgttataggagaaatattatatagatctttatcagatgatagtttacgcggatttggtaggagtgaaattatcattgatatgtcaacgcatatgagggatgaacacttcaatgccatgatagatacaattagatattgtaaaaatataaaagtaataattaattctcgttcattatcttttttctctatattagataaatttccagaagtagagtatctcccttttttcttacataatagtattgatttgttttcataccaacaaacaatgctaaatatattaggcattcataaatttgaagaatattgcctaatgaaagggaaatatgatggaaaatatagacaattatgaagatgagttggaatatactcgaataaaaaaacctggtctaaagatgaactataccgtctttgaacaggaagaattagcaaagtgtgctgctgacccaatttactttatggaaaattacttttacattgttagtaaaggtggtgaaatactttttaagccatatgattaccaaaaggaaatggtaagaaactttcaaggttatgaaaacaacattatgttaacggctcgtcagatgggcaaaactactgttgcagcagcatttattttgtggtatgctatgtttaactctacaaaaacaattttattgttggggaacattctagcaactgctaaagaaattatggaacgtatccagtttgcatatgagatgtgtcctgactttatacgtgatggtgttgaaaagtataacgtaactgaagttcgctttgaaaataaatcaagaattattgcccgtgcaactacaccatctgctgcccgtggtctttctgtaaacttactttatcttgatgaatttgcattcgtacctgaaggtttccaagcggaattctggtcagcagtatcaccaacacttgtatcatccaaaggtcgttgtataataactagtacaccaaacactgagtatgatcagtttgcttctatatggaacgaatcccagcgttttgttgatgaaggtggcaatgaatacgatcctaatggaactggtataaatgattttaaaggtataatggtacgttgggattctcaccctgaccgtacacaagaatgggcaactaaagaagaatataagatcggttcatcgcgttttaaacgagaatacaattgtgagtttgtaacttaccaagaaactttaattgacggtattaaactaagtgaaattaaaaaacgtagtgtaagagaacctattaaagtaactgatgacattcagtggttcaaaccaattgaatatggaatgacttatgttgtggggcttgacccaagtggcggtactggcggtgatgacgcagcaatccaagtatatgaattaccaaccttacgccaagttgcagaatggaaaaacaacaaatatttgattacagatcaagtaaaacttttaagacgaatactcttgcagattgcttatgaaatgcaagaaatgggagccagaaacatagaagatagtttattctggacattggaaaataacagtataggtgaagcagcaattcttgctgtacagaatttaggtattgagaatttccctggaacattaatcaatgaaccaagaagaacacgcactggtcgtattcgtaagggaatgactacaactaaaagtactaaaaaaactgcatgtattcatatgcaaaaattgatggaaacattccgaatggatgttgccagtaaaaacttacatcgccagcttaacgattttatacgtgcaggttcagaagacggtgtttttaaggcaaaattaggttgtaaagatgacttagtaagtgcaacactacttattgtgcgtatgattgatattatttctaaatttgaagaaaatactgctgatgttattggagaaacactagaagatttcgatgagtcatattttatgccacttgggtacatgatgacttataaccgataaataatattataaaaaatgaaggagacaccactatgatgaaaggggttctttgttcagacatttataagattttggcagcaccacaatatgaatatagtattactatgttcaatgacgaaggtgaaggaactatcagtccacaggaagctaagtggttttatattagacctgtgaattttatgatccaagcaccaagtggtgatgacgcagtacgcccagaagtttatctatggaaaagtactgatataaaagatgaacaaacattacaagttttaaaacgtcttaaaaacgttgctaatcaatatggatatggtttcactgtatacgactttggttctggtaatttacctaaaaagttctctcacattgccatgcgtaatatggaagaaactaaacaaaatgatttaaatgaaagccttgatggaagtgctatgcgttcttattacaaactaccaagagccaagatggtagtggttcataagagtcgtgtagaagaaggcattaagggttcacgaactagaaacataaaagagatttttgtggaatctaatggtgaacgtagacgaatgagtactacaaatttacatgcagcaagagcaatgacccatcatttaaatgagggtggcgagtatggtgataaatttgggtcttatatagaaggttcagcacgcgaccttgaaaatttaaaagcgttgctatcagaactagaaattggtggtcgaagccattatgcttccaaaactatgcaatacattaataatttgaaaaataacttaaagctcgctggaacaccacgtggatatcagactcaactgagtacacacaaggaactaccgagaattggtaatacatacatagataattttgctaataagttaggaacacttggctccgatcacgaccataatagaagttttgcgaagtattttctactcgatgagtgtaaaatgttatctgaatatttaaatacaatacaacaaaatatcagtactgacatctcagatcccaaagaaataacacgaagtgcaaaacgtgtatgtttaggttgtgtaccagttgatggtgaatttgaatttggtgaaataccagatgatgaaaataaagtccttatgtttggtaataaaatcgttgatttgattcaagatggtattattaaggacgcagtaatgggtatatgtgagaaaccttacatggaaccatctgacgcaaaatttatcattgcagtaggaaattctcttttaggaaataaaccgaaaaagcagatcttactagagcctgaacttgaatcgctcaaggaatgggcaaatggtaaaaaatagcgggacaaacaaatagtgagtgatataatgatgtttgtcgaggtgatgagccttgacaaacagagttaaaaaaatatgggacagtataaaaacctgtgctataatgtaaaacgttgaaggaacaatgaagtttctgaaacattgaagccaattaacaaataacaaagaaacccaaaatcaaggaagatatatatgaaatctctagctgaaattcgtgcacacctaaaagcagaacaagaaaaagcagaagctcaaaagaatggtacatttactggcgagcgtaaagctgattcgttcttagctttctggaacgtaccttataacgaaccactaaacctacgttttctaccagatgcagatgagtctaacccattcttctggcgtgaacgtgacatgattaacctaactttcaatggtgtagtcggtatgcacactgataaagttaccgttcaagtaccttgtaacgaaatgtgggttcctaaatcctgtccggttctgaaagaagtacgtcaatggttccaaagtgcgaatgaaacagggaacgaagaactaaaagcaatggctggtcgttactggaagaagaaaacctatctaatgcaatgttttattgctcctgatagcgttgcagtaaaagacgacattgcaccagaaaatccaattcgtcgtattctggctaacaaagatatctttgataaagttaaatccatcctgctaaatccaggcatcaaagagtctccaactcactacgttcaaggtcgtgattttggtattgttaaaactaagaatggtggtggttataatagctacgacatgtctcaattctccatgtctgagcgtccactaaacgaagaagaactagcagcaattgaaaaatatggcctatacaatctaaatgattttatgccaaaacaaccaactccagaagagttgaaagcaattgaagaaatgttcgaagcatcagtaaatggtgaagcatatgatccagcacgttgggcatttgcatatcgtccagcaggtgtaccaaaacctaactctggaactgttactgaatcaaaaccaactcctgctccagtacaacaagagtcagcacctgcaccagtagcacctactgctccagttacaccagccccacaagctgctccagtaactccagtcgctaccccagcagcaaccactcctgaagcaccaaaagaacaactatctgcatctgcactagttgctcgtttgaaacaacaaggtaagtaatagtttttgaaaagttaaggggcaacggagtttgccccgttttatttcataaaattcaaggagcgaattatgaaaatgacaagtggttttgcgaacattcttaaaaacagtactggtagtgttaaaaagaatactggtgttagtgttggttttcatgatccagatacatgggttagtactggtaactatgcactaaattatcgcatcagtggctattttgaccgtggtatcccactaggcaaagtaacgatgtttgctggtgaatcaggtagtggtaaatcttttatcgtatctggtaatattgcacgtgaagctcaaaaacaaggcatctttgttgttatgattgactcagagaacgcattggattcagattggcttcaagcacttggtgttgacacttctgaagaaaaacttttgaaagtcaatatgggtatgattggtgacgttgcaaaattcacctatgagttcattgaaggatatcgtaaagaatacgaaaatacacctaaagatgaacgtcaaaaagtattgtttattattgattcaattggtatgctaaacactgaagtagccaatgatcaaatgaaagcgggtaaccttaaaggtgacatgggtcataaacccaaacagcttaaagcatatatcacaaactgtgtaaactctattggttcattgaacattggtatggtttgcgttaaccacagttatgaatctcaggacatgtttaacccagatcctaaagtttcaggtggtagtggcttgatttatgcttcatctatggttatcgcaatgggtaaattaaaacttaaagaagatgaagacggaaataaaacttccgaagtaaatggtattcgtgctaaatgtaaagtcatgaagactcgttacaacaagccgttcgaagatgtagaaattaaaattccttgggataaaggtatggacccacgtagtggtctactagatatgtttgaaaaatacggtctaatcactaaatcaggtaaccgtctattgtatgttgatattgtaactggcgaacagattctaaaatatcgcaaagagtggatgcgtaatgaagattcatgtcttgatttggtaatgcatcaatttaaaaatcatcctttgattgaagaagttaaagaagaagaaaaaggtgatgaaacttttggtactgatgtggatattagtgaggaataatgaaaccttggcattggattatcaaagatgataaatctaaaattattgaaatgattgagttctttaacaaagaagttgaagaagctcgtcgtgaagtaaagaagattggcatcattgaaaaaattgctcaagagattcctggctggcatgagacgcgtctaagccagcttcaagaacttgaagcagtattggaaatgttagaaattgaaatgcgtcaggtacaagccgagaagttcaaatactttctcgaaggataccgccgtgcactatcttcatctgactgtaaaaagtatgttgaaggtgataaagatgtttgtgagttagcagaacttataaacgaggtatcttatataagaaatacatattcaagtattgttaaatccttagagatgaaagcttttcagttaaacaatattgtgagactacgtgccgctggtattgaggatgcacgtttagaataattatcattaaggacgcatatcgcgtcctttttctatgcgagaataaaatgacaaaattaaatgagtttttatcaaatgtagcagttctagatactgaaactactggggttgagagtgaagatgatattattgaatttagtatctcgtatccacatacttcacatgaaaacattgatactattgataactatacattgagatacaaacccttgaaagatattccaccagaggcatctgctgtgcactttatcagtactgaggatgtagctaattgtgttgggtataaagatgatttagataacattgatgcacttatgggctgccgtaagtattttgttggtcataatgtacaatttgaccgtagaatgatggtagataacgaatataaatatcgtaactcaatttcacagtacttacttgatgaaaataaatggatttgtacccttcgtcttgctaagaaaatgttcgcagaagatattgaatttaaaaacttaactctaagttatttgtggtataagtttggatgttatcgtgatgttcatcgacctgttaatgcacacgcagcaaaagacgatgtgtttatgtgttatcaggttctaatcaaattagttgaaattgcaatcgaacgtggatatatcgaacctaatggtgatattggtgagcaaattgtaactttctgcaacacaccaatgcgttatcaattcatgccatttggtaaacacaaaggtgagccaatgagtacagttccattgaattacattgaatggatgattactaatagtgacattttagatgcaagtaaccctaactgtgataaagatttagtatatacatttgagtacgaatataatactcgaactaattaataaaggtaatcatggatgaaaacttgtaagttaaccttattggatgaggtgaattgtaaatttgagggacttgatccctcaattagacaaaagatgattcgtgcaactgaatatgtgttaccatatgcaaagttcacaccagcaggacgtattggacgttgggatggtaaagttcagtttatgaatttaggcgggacaacttattatcatatgttagataagttattgcctattcttgatgaagctaagattgacattgaattagtagatcatagggtagattatggatttaaatttgaccccattgatgaagatatttttagtgatgttgtattcggtgcaggacaccacatggaaggtaaatccataaaactacgtgaacatcaagttaatgcggttaatgcatgtttggctaatccacacggactactattggcagctactggtgcaggtaaaactctcattactgctgcattgtcaaagaaagtgcaagagtatggacgttctgttataatagtaccaagtactgacttagtacaacaaacatatgatgactacattatgtgtgggttggatactggcatgttctatggttcacaaaaagattttggtcaccaacatactattacgacttggcaatcatttaactctctatggaagaaaaccaagaaaggtgaaattgaattaactgaacaagacgtgaatgattttatcgatggagtagtttgtgttatcgttgatgagtgtcaaggtgcaggcggtgacgcattagttcaagtactttctaaagttatgaataacgtaccattacgttggggtcttactggaacaattcctaaagatccggtagttgccgcgaaaatcaaatgtaatgttggtgatgttatatttaaaataactgcaaaggaattacaagataaacaaatactaagtacatgtaatgtgaattgcatcaaactaaaaagtagtatgaagtttgcatcatatgctgaagagttgaaatacttagtaactgacagagataggatggcatatgtagcgtcattgatatctgcgttatctgaatcaggaaacactttagttttagtagatagacttgaagcaggtgagttgctatgtgaatttttaggcattcccaaatcagaattcgttcgtggagaaactaaaaagaaagatcgagaatcatcttatggtgaaattcgttgggctgataataaaatacttattgcgacatacggcgttgccagtactggtattagtatttcaaggttatataatgtagtattgattgagccaggaaaaagttttgtaagaactatacagtcaattggacgtggattacgccgagcagaagataaagaccacgtagaaatatatgatattagtggttctaataagtatagtgccaagcatttacgagaacgtttagcttactataaggaagcacaatatcctcatagtataatagatgttaaagattgggaaaacacagcgggataaacccgctgtttgtgatataatgtgtcatatgacaacaacaaggatgtaaaataaaatggaattgagatctagtattgcttttatttgtgaccaagaaactttagaagttatggatgtattgttgaacgatgatggtattatggatgacatggtatcttctcttgactatatacctgagctagaaacggatgatactaacgtatggagatgtaatattgatagtgattcttggattaatatctatgaattacagacacgaattgattctaaagtagaatcattgaaatatgatatcatctatgcaagtactgacacgaaaacttttattgatgtagtaagtctaagtggtaattttgattcatatctggatactgatgtagataaaattcaagagatgtgtgaaacttatggacttgaattttatggggtagaagaccaagatgatgaagaatattatgatgacgaagaagattcgcagtactaaggagatgacatgaacgtattaacacctgaaaataattcttttgacatggatttagtaacagaacatatccctgaagaaatgtattgtgttttggatctaagcccaaatggtgaatctgatttttattttagacatattctaaacaccgtatcatttaatagtattagtgctgatcttcaaattggtgaaaagattattcaagtgcctctaggatggcaaattatgttaggtgatgaagaaactggtatggttgagatgtgtacaattgaaaacattcttaacatgaaagaaccaaaagcttttgtttacaatcctatccgttcaatgtatcctaagtttgaaccagtcaaagtactacgtgtatttgcattaactacaaagtggcagataccaatgttacctaaaaagaatttactatgcgtcccactacatagtggtgaaaatccaccatgtgtgtactttgcagatgaaaacgaaaaaattcaagatttgtatctaggagtataaaatagtgtttgatttcagtgatattaaaaataagtcggtcgatgatgatgaaaaaccaacacagcattctttttctattgctgaatttctaaaacacattgaccgtgctgattataagtactataatgacatgaccgaaaaagaacgaaaagagtttactccatatactgttttgcgatgggtaagctctttagatgattcgttacaagtaacctaccctagtagtaaagttgaaagtgtatttggaaaatggaaatctggtggtaaagaagcactgactgaactagttactgaattaaagtcttcagggacaaatgtttcatcagtaactaagtactgtcatagtgattatgattggcgtattaaatttgcagtccaatcaaaagatgacgcacaaaaattaatatcctcaatggtcgaatttggcgtatcaggttccgaaattgtttcattagtagatactgaagttgtcaaataccaacttattatgctaaatgatatggttaatgatggattttgggatatgaaagaacatccagaattagtatatcagcttatgtgttcagtccatgatatgattggtggacaagaaatgccacgtaactggttaaacttttctaagaatttcaaaaaggcaaataacgaattatttgagttaattaaaagctcacaacctgatactatatctactcaaatgaatgaagatgagtacaaaattgttctattgcagtatgataaaaaaacatttgagacatttcttgacaataatggttttcaagataatgaaaagaaatctatgatgaaattgtttaaagaagaatgtaaaaaatatggcaaagaaatcaagtaatcaagtatatacctgtagattttgtgatcgtgaatttaaacgtgaagaaactgtaaacacacataaatgtataaaacgtgaccgatacgaagaccgccaaagccgccagatgatggaggcttttcgtatatatatgcaatttatggaattgaataagttcccatttaaaaaaggcgtagagccttttattgcttttataaagtcaaagtactttaatgatttttatagttttgccgaatactatttgaataatagagatattattaatgtggacgagtttgtaaagtacttgattatcaataacaaaccaatcactgaatggagtacatataaagcaaaagatgaatggatattaaaaacaattcgtgccgagcacccaaaagaagcaattgcaagaagtgttatctcactggttgaatgggctgaaaatttgaatgtacaatggaatactttctttgaaaatgtaagttctgcccgtgcaattgcatggattgagagtggtaaaatttcaccttggattatctggcttgctcctaaaaaaagtactaataagttttttaaaaaactatcaaactcagaaattgaatatatacttaaatacatcgatccaagttattttgaaatcaaaactataaaatacaaaaaggattgtgatgaaattaagattatgctatgtgaggcaggattatgaatggaaaaagtatatataataaaataccagaagggtatgtacctgtacctaaagaacaaaaatcaaaacaaatatctctacttagacaaggatctattactgaaataactttagatggtaaaacatttcaagttcatgatcctgctcgtattgaaaaaattatttctttggtagaaagacacgaagaacgctttttcagtttaagtcaagaattggcaaagacaaaacaaaattgtagattattagagaatcaaatatcaactttgactaatacagttaaacagttacaggagcaaataaaaaatgcaggattcgaccgattctaaacattatagaaaagcccgaactgatattgacattgacttcaaggatagtaaaagcgtaatcgctaaacttccatgtgtgcgaagtactgaaaaaattacggaggatggtttaatcccccataatagtggtgttcattttgataatatacctattgacccaatcactggattggcaagtatacaatataaagaagctgaaaggttagggtatcaaaaagttgatattctttcacagtcagcttacatgtatgttcgtgatagagagcatttaaaagaactaatgaatcaggaaccaaattgggatctattgttagaacccgaaattgtagaacatctatcgcaaattaaaaaacatgtaactttattaaatgtatggaagcctaaatctatagacgaactagcaatgtttattgcaatgattcgcccaggaaaaaggcagtgccaaagtatgaacacatgggacgaagttaaagccaccatatgggattatagtactatcggcactgaccaagcaggaaataaattacgatatttcaaaaagccacatgcttacgcatatagcttaatgattgttgtacaactaaatgctttagttgaacatcttacttcttcttaagagccacattacgacgcttgatgcgtttctgtggtaaattgcttaaagaaactactggaccacatacgaaattcaccgacggtgtatcgaatctctgtgtgtacggttcaaatttctccatctcttcttgaaagaatagacaaactggaatggttctattactttgccaccaccaatcgtgtgctatacctaacaattcgtcttgcattgaatcatccatatcatcgaaacagtaaagagttgtatactgtttgcttttgattttgatgataccaacaaacgttttaccatcatactggattacagtaatgaatggtggaatagtgttatattgattcatattagttccataaatattagtataaatttatacctattatttatggaaggaaaaactatggctcatcacggcgtgtttatgtacccttataatcaggaagtatcattgggcaattttaatatgccatatagcaatgaaaaactaactatatatagaggggcaaataataatttatcttttactgttcacaacgctgatggaaaatatactttattgaaagataatgaatatcttacatttatgatttttgatgcacgaaataatactaaactatttgatgttgtattagaaaaacaagaacccagttggttatcagaaagtggacaagcaagacaaacattaggaaataaaaagaaagtatattatggatgtattgttccagcaggagttattcaagataccagtcctggttcaaaatatagatggagcattactaaagtaacaatggatggttcacttatagaaccaacacaatatctatacacagggatgaactttgaggcatcagcagagctaataatttcagaccaagcagcacctgtatttgtccccagtactgaaatatcagttaataaaaatccagcatggacaactataaagcgtttatatcatgaaccaattggaaatggtatgattggtgaatatgatattctcgcatcaactccactaccagcacaaatgcagtttggattagtagatggattaagtagtattgcaatctattttgataaatttattggtagaatacagctacaagggtgcttgtgtaacaacgtgcctaatgataatgaaaactataaatggtttattattaaattagatggaaaggattatattgaaaatggaattgattcagaaggttttccaaaagaacttgacggaatacaagcatttaattttaaaggaaattatatgtggttacgtttggtggttgctattcatcccaaaattgttccagtaccatatgactatgctgctgtccgaaaagtgtatgaccctttcctaacagtacctaaaattttgatacgtagatgagacaaaactagaaggtgtgctataatcatttgtaagaaaagacaaggattaacttatgaacgctgtacaaaacataatggcacaaattatgaatgatccagtacctgcgattggtacatggtcacaacacaactgtccagcttgtgtgttcagaggacattcaaggccggatacaaagcaccgtggtaatcatatgttcaatgcagatggttccgtttcatataactgctttaactgtagtttaaaaactggttggcaaccaggaaaatatatgagcaaagatatggagtctttgctcatttcttttggtgcacaagataaagaaatagaattagttaagttttatattaaagaaatggttgacagcggtgattttgctgcacaagaaactgttgcatcaaaattgtatgaccgagtaacagtacgtgatttgccatcaaatgcaaaaacattttgggaatgggcttctttacctgaagataaaattccacaagaatttataagtgttttgcataatgtcaatgaaagaaacccatatctgttagacttagaattatattggtcacctaataaagaacataaaatgtatgacagatttattattccatatttcatgaatggtaaaattattggttatactgcacgacataaattaaaagatcctggaagtacatacaggttcataaatcaagtaagtactaatatactatataactatgatttattaaaagatgaacgaataaaaacaattttagtatgtgagggtccgttagacgcagcattaatgggtggtgtatctgctaataactttaaattatcaaacgtacagattgatgtattaaaagatgcacagcaaaaaggtaaaaaaatagttattgttccagatagagataaagatggattaataactatagaccaagcacttgaaaatggattcagtgtttccttcccagactttggtgctgtaagagaaggtagtacaatacgtcatatcaaagactttgaagaagcttgtgcacgatttggtaggttattttgtttacaattaatacatgatagtatagtagatgagccattttatattaaagctcaaacggataaatggatgtaatacatataatgagggaacatagatgattcaaagcacagtggatgtgaaacaatatgggattaatgcacaacaatacttattatctcagattttcagtaatcctgatttatatgtacgttgtaaaaatatccttaaaccagaatattttgataaaacatttcatgaaagtattcaatacgtacatgattatgctgcaaaatatagttcatcacctactttgaaagatattgaagttaaaggtggttatcaatacgatcaatatgaagttcaagaattacataaacaatcagtacttgatacctgtggtgaattttgtcgtcataaagcattagcgttagccgttgaaaaaggaatggaacttgtccatcagaaaaaatatggtggaatcgaagaactaatccgagaagcaatgttggtaacggtacagaatgagttaggtttggacatttttgaaaaccctgaagatacaatccgctcactcagtacaatgcaagggtcatttaagagtggttgggaaactcttgattacaaactgttcggtggatttgggcgtagagagttagagatctttgctgctgcatcaggtggtggtaaatcagtagtactgcaaaatttagcagttaactttgcgaaagctggtatgaatggtgcatacatttcacttgaactagctgaagagttggttgctgttcgtatctatggtatgatgactgaatcaaaactcagtaacgtaaaaaatgaagctgaaaagattggatttgctgttaaagttgaaggtaaaaacagtggtatgttgcgtattaaacgcttacctgaatctgtaacaaccactgacgatattgaaagttatctacgtgaattacaaattaagatggaaatcaaacttgattatgtatgtgtggactatttggatctattaacttctaatcgtcttggaccaaatgataaatccaatacatttactaaagataagtttgtatcagaagaattacgtgcacttgcaaccaaaatggatttaactgttttcactgcatctcagtttaaccgtagtggtatggacgaagataagaaaagtcaaagtcagattgctggcggtatttcaaaaatttatactgctgataacgtaatttatattgaggcacgaaaagaaactggcgaactatggtttgatttccaaaaaacacgtaacagtagtgcagtaggttcccgtttgcgtatgtcttatgatattgattcattgagagttcttgaccacgcaactacagtacaacaaatggaaaccgaaggtaatggattccgtcacagcggtgtttctaagattggtggagggaacatggcgttaccacccagcactatgcaaacattacgtcattcgctttctggtgcagctaaatcaccatctgtgcaacctgacaatacagtaacactaaatactgatagtgctcctaactctacgacacaaaacgaaatacagaatccacagacacatgctggtactgatcgtgttcatgcaatgaagcaatggttaaatcaaaggaaatgataaatgtctagtaaatccaataaaaagaatctacttgatagtatagttgactatacaccagagaaagatacattacagagttttagtaatcgtgccgaccacgcaataaactctgtgattcatttattggagagcattgaagatgagtttaaccaaactgatgctgaagatttaaaaaaacgcttatttctaagtataaaaaaccgagattataaaaagtttcaaaaagggttagagaatatagcacttgatgaaaaacgtaataaaggaaattaatatgaagaaaaagaatatcaaagaaaatgcatcttctggagctacttcagcaggtgctattgcatcagtcagtactggtttacattatccattacatcgtagattgcctcctactaacttctttggatacaaagtcgtagagaaaaaagataaggacaaagaatgaaaccatatacattctacacaattcacactgtagtagatattggtgatggtaaaaccccaacaatcatagattctaagttcactggtgctatgaacttgtctaggttgttggaagctattatggtatatgactatccaatgatggtaagcgttgttaaaaatgaagtcgatttatataaagataataattcatctttttataacatgccaatttcttggggaaaatgtaccataagcacattcaaattcgcattaccaatggatgtcgaacttcgtttgaatggtataccattggttctaccaaccgaattaaatggaaaacgaataacaaaatttatcacatctggtgatgatattaacattagcatcagcaaacagaccttttcttaattgtgataaatatcataaagcaagacagaggtctttttattttatatggagaaattatggatataaaccaaacagcaactgaacttcaaaagttcgcagatgcacataatttgaatgttgatgtttctgttattcttgataatatggatgcaggtgattttatcactttaaattctgcgattgataattctgacaatcgtgaaatattccaaattttacaaaaatacaaagcacagatgagtgaatgttataattattttagtactaaaaatgttaacaaacatattaatgaaagtactgaacttcatagtattgttgattcaatgtcactaaagcaattagcagaagagtatcataaaaattatacatattcagatataacaaaactaaccacacaagaattaaaagcaattgtatttgaagatttacaaaatcaagccacacaaatgcaagcaaaacaaattgctaaaatgaatgtttctcagggtcaacaacaagtcaatccacaaactcaagctaaaatgaaacaagctgagttgcaaagaaatgctaataatatgaaagttagtgttcctggtacacaaagcgggacagattcggttgaacctgtagttggtgttgacccaggacaaacaccggagcaatcattagttattactaaaagtgggactaagccaaatgagttgaacgtttttcctttgagtgatgttaatcctattgataatcaaaataatccaattcgtgaagaaaaatctccacaagaaattaacagtgaacttatggctaattccagtttagagcctgatagtaatcctgatacaccatcaccattgtcacatcacgcacctggtatgggcgaaatgatacatgcaatttctgatattgaaaaagaagatgatatctatggtgatgaaagtgttatggcaaacacatcacaatctgataatgatgacatggtagaccaaattatcgatttctgtcatcgtatgcgaggtcgttaatgagaacagtactaaatgtgcatggtcacaatacaatggtttctaatgaagaatataaactattacaaaagataaaagcacgcggtactgttccagttgaaaaggtaaatgaatattatcaggaattagctgataagatggtatcacgtggtgttctaaataaaatagaaaatgatgacggtactgaatcttaccaaacagttaggagtagtaaatgaattacgaatatgatcaacaatcagttaatcagatggctgatttgttaagtggattgaatgacattgaagctggtgaaacacataacgcatcgggggttccatataaaactggtggtgatatcggtgctatggcttctattttaacttcattaaatgaagcaggtatggattatggtgaaccacaacatccacatatggttcaatacaattctccgtataatgaacatttatcagggaattcaccagtaccttcgccacgaccatcacaagcacctcttaaaccaaaaactaattggagtttagtggaagaaaaagtacaaggtactaaatctactaaagtttatagcattaagtgtaatcatagttcacaaattatcatgaataatattatgatgtatgaagcagcacttacattagttaatcttctcaatgaaggaagaatgttgacagatgcaaaagtacttggtataatcagttcgggtcttcaatacacgaatgtgattagtgaagcattgaaagcagcccagaaacgtcaacgcgtacttaatgaatcgaagtatgatgaagcaaaagatttagatataattattgcagaaaagaaagctgaagcgtataaattaaaagagcgtgtattaaactttctaaaaggcgaaggttatataaagtaaataaatgagtgatattttataaggaaatacaaatgtcaaaatataaaaaactaatggaagcagcttctcgtgcagaagctatgaagtttattcaactaaatgaatctaatattgaaaaagcagaaattgttctttcagtaaaaggtgagattgtggataaactccaacgtcaatctgaggttattaacaacatgggtgttgacgtactaggcccactacttgaccgtattaaagccgagcaaggtctagatgctgcacaaaattttagtgataatgttcgccatctactacaacatgcagttactaccttaatggatgtaaaagacaaaatcagtactgaaacacttaaactaactggtgatatcactgacggtccagatgtttctgatattggaagtgaagatgttgatattgatattgcagcagataccccaacttttgatatggatgcagacgcagactttgaagaagacattatctctgagccagtaccaactgaacgtgaaatgaaagaatctgttaaaccaagtaaagttggtgtaaaaatggaaagtattcgcggaactgtgggtactaaatactttagttcaaaagaagaaatgaaaacatggctttctgagaatgaaaagaaagttaaacgtgttctaggatacgttaaaaaataattaaggacaattctacatgagatttcgtgatcttactgaagaggctcctggtaaagatatacgcaatatgattactactattgcgttgtctttagtgtccacgggtcgagaagaagtaaatgttcaatctttgatttctgaaattaaaaagagaaccaacatcgatgttccatacaatgtaatgatggacattttgaattcccttccttttgtacaggatgctaattctgatgttgtaacttttgcaggaaattcagcagaaggttcagaagaagtcgagcaagattctgaagagcaagttgaagattgggccacaaaagctgctgtgacagcaaataaacaaaaaaactgagacaaattaaaatataatgctataattaggagtacacggatgtacacaccaccaattgttagcagatatacatatgttggttacaatagaattgaaggcggcccagaaggtcgcctttattcaactccaacaggtaatctgccgtcagtaacaacaattctaagtgcgacctcgaatgacgaaggtttaaagaaatggagagaatttgttggtgaagaaaaggctaatgagattacattagaagcatgtacagttggtacttttatgcatgagaacttggaatttagattggaaggaaagccagaccatgaaggcggtatgccaattcgagttcttgcacgtagaatggctgacaaaattcagcaagaagcatggcctagaattaatgaagtatggggacaggaagtcccattgtactatgaaggtttatgggccggaacaactgatttagtaggtgttcatgatggaatcccaaccattatggattataaaaattcccgtaaagttaagaagtggggacaaatcgaaaattatcgtatgcaaattgcagcatatgcattagcccataatcaaatgtttggtactaatatagaacgtggtgtgattttcatctgtgtaagaaaagatcctaacaatctacaatatcaagagtttgtcatagaaggtcaagacttcaaagatgcagtcaatatgtggattgaacgtgtagaacaatactatattttacgtggagaaattgaatcaaatggagcagcataaaaaaatgaaacaagatctatatacaattcgtgcactagtaagtaaaggttatgatttagaagaagtaattaaacttagtgaagaagagattgataaacttgatttatcaaataagctaattctaaatatcaaagattataaacaacgtggtgctaaacctgttgaagaaattaaagaacaaattgcacaagatattagtgttgatgaagtatcacgcaatgtaccaccagaagttatccaagagtatgttgttgatagtgaagaacaagttaaagtttctgaagaagttgaaattattgcagaagaacttgctcctgaattggaagaagatgaagtcgttattgagcgtgttgtttcatctaaagaagatttggacattatcaaagaagcattacagactaaagaatttaaaagtgtttccaactatgttaaacatttaaaatctttagtaccagaacaaattttatcttctgtagatagctcagttgtatctcaactaattaatgagcgtattgcggaagttaaagaaaaagctaaataatcctataatactataggagatagtttttatggcacaacaacaaattgctttacaacaagtaagaactggtaaacagagagacttacctgatgcattagaaaaaggtcagataggattcagtactgatgtgggtcgtgtttttattggccttccatcatcatctgaccccgccagcttagttgcaggtagaacttggactactgatccaaattcaggtaaagaaaacgtagaaataattacagaattttcaccgtggagaacggtatcaaaaataattaacagaccgtttaaagttgatcttccacaaaatcaagaaagtatagaagttattcttgaaagtgaaagtagagtattcatcgattatattgcatatgatgataccgaaacggttttggaatcaggaactattcaaattgtagctgctggtacaaacacgatgattgcacagtcaaataatacaaatagaactgacgcaattatttctatctcatttgaagatcctgcatatgattctacaactggaaatatgcaatttaacatagttaactcggattatttaaattcaggatatcatatagaatttgtatatcgtgggtgggacaaaccttaaaaggcgtcccgcctttttcttccactaaaaaaagaaatttacatcaaaaaacaaggatgacacatgattaacgtaaccaagcgtaatggaatgaaagagccgttatcattggataagatccatcaaattttatttttcgctgctgaaggtttaagtggtatttcagtttctgaaattgaaatccgagcacagcttcagttttatgaaggtattgaaactagtactattcatgatattcttattaaagcagcagcagaacttatttcagaagatacacctaattaccaatatgttgctggaagactattaaactatagtattcgtaagcaagtatatgggcagtatgacccaattaaatatactgctcatcttcaagaaatggttgataccaaaatatatgatcctgaaattcttgagaaatatactcttcaagaaatagaagagcttggacgttatatcaaacataaacgtgacgataaatttacttatgttgcaatgcgtcaatgggaaggaaaatacctttacaaaaatcgcgttactaagaaaatttatgaaactccacaaatggcatatatgactattgcagcaatcatctttatggagtatgatcgttctgttcgtatgtcatatgttaaaaagttttatgatgcagtaagtaactttgacattagtcttcctacgcctattatggctggtctacgtacaaatacacgtcagtttagctcttgtgtagtactaaacgttggtgacagcttggatagtattggttcctctaaccacgctattctacgttatatttcacgtaaagctggtcttggtattaatatgggccgcattcgtgctctggactccgagattcgttcaggtgatgcagtacacactgggctgattccgttcattgcagctactgctaagactgttaaaagctgttcacaaggtggtgttcgtggtggtgcagcaactgttcacttcccattgtggcatttggaatttgataacttggtagtccttaaaaataacaaaggtactgagtttaaccgtgtgcgtcaactggactattgtttccaagtaaacaaaactttgtatcaacgtttggttgatggaaagaatattacattctttagtcctaatgaagtccctgggctatatgaagcattctgctctgatcaaaaagaatttgaaaagttatataaaaaatacgaagctgaccaaagcatccgtaaaaaatccgtacctgctgttgaagtattcagtactttaatgactgagcgtgctgaaactgggcgtatctatattcaaaatattgaccatgcaaacactcattcaacatttattgaatctattgcacctattgaacaatccaacttgtgtcaagaaatcgcactaccatctctgccatttgatgacattaatactggggaaggtttgattagtttatgtacattgagtgcaatcaactggggtaactttgaccgtccagaagatatggaaacggcatgtgatctttctgttcgtgctcttgattctctattagactatcaagactacccagtagttcatgctgaccgtgctacaaaaatgtatcgtccactaggtgttggtattattaactttgcatacttccttgctaaacgtggtttacgttataatgaagcagcactagaaacagttaacgagtgggccgaggcatggtcttactatctaattaaatcttctgtacagcttgctaaagagaaaggtaagtgtgaaggatttgataatctaaaatatgccaaaggtatccttccaatcgatacttataaatcggacattgatgaattagtaactaaagaactaaaacaagattgggaatccttacgtgccgatatcaaagaatatggtattcgtaacgcaacaacaatggcattaatgccagcagaaacaagtgcacaaatcagtaacagtactaacggtattgaaaagccacgttctcttgtaacgaagaaactatctaaggatggtattcttaaacaagtagttccagaaatcaataagttgaaaaacaaatatgatttactatgggatcagaaagataacattggttatctacaaatctgtggtgttctacaaaaatacattgaccaaagtatcagtgttaatactagttataacccaatacacttccctgatggtaagttgccaatgtcaactcttctaactgaacttatgtatgcatataaagttggtttgaaaaatctttattatcataatacaaatgatggttcagatgaagtagacgttgaaaaagtactgaaagaagctgccaaaccagaatctggacaatttgtattaccatcacttcctgatttggatgaaggtgattgtgatagttgtaaaatctaatttaagatcccgcttcggcgggattattatttcaaaatatataaaggaatatatatgtcagttttcaaaattaacgagaagtctcacctagaaaaaaatatgttttttgatgaaagtgttgatatccaacgctttgaaagtaacaaatactctacacttgaaaaactaacagagcaacagaaaagtttcttctggactcctggtgaagttgacgtatctaaagataaaattgattttgccaaccttaatgattccgagaagcacatttttacctctaacttgaaacgtcaaattcttcttgattccgtacaaggtcgtggtccaaacctaatgttacttccatatgcatctctacctgaactagagaactttatagagacatgggcattctttgaaggtgcgattcatagcaaatcatacactcacattattcgtaacatttatcctaatccatctgaagtatttgatactatgttggacattccagaaatcacagattgtgcggctgatgtttccaaatactacgatgaacttgatgtattaggaactttataccgtgcattgggcgttggaacacatacaatcaatggtgaaacagttgaaattagtttgtacgaactaaagaaaaaactttggttgtgtctgaatagtattaacattcttgaaggtgttcgtttttatgcaagctttgcgtgttcttgggcgtttgctgaaaacaatctaatggaaggtaatgctaagattatccgtctaatctgtcgtgatgaaaacctacacctagcagcaacccaaatgattctacgtcttctgaaaaaagaagatccagatatggtaaaaatagcagaagagtgttatgatgaagtactggaaatgtttatgtctgctatccgtcaagaagaagcttgggcagacttcctctttaaagatggttcaatcattggactgaatgcagaaatcctaaaacaatatgttcgttggattggttctaagcgtatgactgcactaggaattaaatgtccatataccgtatctaagagtaacccactaccttggactgagcattgggttagtggtggttcagtacaagttgcaccacaagaaactgaaataagttcttatatcattggtggtattgtgaatgatatccaagtagatacattcacaccattcaaactataaattgtaactaaaagggattcatagaatcccttttcttatgggtataatatatgaaagatatttttacaatagatgctaacgttatatatgatttttatcttactggtggtgtaaaggtaacgggtactgtgattgatgtttgtgataatggtataatcttaagtgatggcactagagttgtccaaacacacatcattatgtttgtcccacatgtataaatttttggaacaaaacagaaaagtgtgctataatgatttttgttaaacaactggagaagaagatgaacattaataacctaaatgaaatggtagaaaaaaatattgatgctgctgaagaagtaactgggtatgagttaacaccagaagatttagaactatctaaaaaaattattgaacagttatctggatattatgttcgtaaagaccagaaaattaaagaacataaaaaagcaaaagctaaaaatcgcactcgtaataaactagctaaaaaatccaagaaagctaatagaaaataaggtgaataatatgcagtatatcttttcaaaagtaaatgaaaactttcctaaacaaaaagtatatagaagtcaacgtactcttaaaaaaatgcatttggatgggtatgctgtatctttggcttctattgttattccagtaaagcttttttcattagaccaaaaacaaactgacaaatgtttagatgtaatttatgaacatgatgttgggtgctttgtttgtagttcagacaatggatttacaattcttcatgaatttgaatcattgtatgatgataacagtactgaagaatatattaaaacatttacaaataaattaatgtgcgaattatccaatattgaaatggaatttgcaacagttgaaacaatcaacatcacttatggtgatgcatattatggagaatggtaatgtcaacaacattagatcaatataaacaagttgtagagttcatggaagtatgtaaccagccagttaacaccactcgaactttccaaacttctaaaattgcaaatcttcgaattgagcttattaaagaagaaatttttgggacaggtgagttggttgattctatcaataaggattctaaggttggtattctagatgcattgtgtgatattctgtatgttacatacggtgcaatcgcaacttatggctgcattgatgcattgggtgaatacgaaattacaatcgaccctgaaaatcgtaaaagccaactactatataaacatactgctttgaattatgttaaagaattaactgactattttgagcaatttaaacgtggtgttgaaattggtgatagtcgcactatcagtgatggactagttcgtattgtatcttcatgtgtatcattcgctcgtgcaagtggatttgacctagcaggggcatatgatgaagttcaccgtagtaatatgagtaaattttgtaaaacagagaaagaagcccttgaaagtattgagtttcgtcttgcagaagcagatacattatcaagtccaccaaaacgcattgaacaaaaagataattatactggtgcttatgttgagcagagtgggaatgttttcgttattaaacgtggaaaagatggtaaaggtttaaaaggaaaagacttctttgagccagacctaactaaatatgcttaataaaaaaaaggagcaacaagttgttgctccttttaatcatttaatatcttgtattgaattatcaaagttacgaatgtacggtctgatgttgttaatcagattctgcacttcatgttgattcaatgttttatttgttgtaatcataacataaccagcaacttcatacttttccttatctaaaataggaatagttataattgtgttataagtataacgaatatgtttaacatcatcgcatgaataatctttggaattatcatagtataaactgcattccattttagatccaatgattgtttcataatgaactttattaagaaatatttcttgatatgctctatcgcttctgtctaaagtgtacatatcagtacgcattctcctaactccagagcgatctcttagaactagtccgaacttggcctttatacattttagtgtcttcgtctggtacaaatttgtatagaaccaccgtactaatatctgaatgttttgaaattattttagcaaaagattcatttacattatccagttccaacgaacttttaaaaaaatattgttcaatactgggtattaccgatttggtaattctattttctatttgtgacctattaagaaagagaaaaatactcaaagtgatacaagaacatacaattaacactcttagaatagaatagtaaattcttttctgtgttgacatgtgtttcctcttttatttaaaatgagatataatatcctacttcattaacaactttttgtgcaagtctctgaaacttctcagcttcttccacattttgtggtacacgtttgaaataaacactaacatatccttcaattgaagtgtacttaatcggtactgaaacaagataaacaccaccatcttgaactattgctggaaagttaataggtgatagatactcatttcgtgcttcattatcaggatttaaatattctgtgtaaattttagaaatttcaacgcaaaatattttcccccttagtaatgtatttgtctcagcactaaaagcacttatgggtaaccaatccaaattgtaagatttaatatttaatcccatagatgcatttgtttcgtctgtaacaagtactctaccttgatagaatgtattattatcaggaacaaacttgtaaaccaaaaccatagcaatatcatcagtgtttgcagaaacatatttatataggcttttatcaatactctccaacttttctggtgaaattgtatatttatgaggtttaaacgattcaaattgttcggggtgattaagtttattgtttatataagtttcccatgaactggaagttatataaactacaaaccccaatacaagacataacgtcactactattgttctaataacaggcattccgggagataacatcaaggattttgttaattatactactatctaagtcgatattcatatacctgttaatctccaatcttattgttatttttataaagtatttacccatttttacgttttacatagtttatatggagaaagaagtaatatgttaattttacaaataatgtggattgatataattttgacattcatttgttctggatatattggatttgctagtattttgtactgtatctctcttgtagttttgggccttatggtacatttacataaaacacttattcattgtataaaaataaaagaaaaagaaataataaatgatttaccgttgataactagtctgtttcctattggaaaaaatacttatattaatatttttatgtctacaattatacatagtattatttctgtaagccttctcgaaatgcctttacttggattgggaattgtgatattatctatgtatcgtataaaaaatgaaaaagatctagaggaacttgtatgtcaaaaatgattctatgcactgatgaaaattatgggattggttgtaataattcgataccttggtacagtaaagctgactttgagcactttaaaaatgaaacatcaggacgaatgattattatggggtataatacgtggaaatcacttccaaaaaaaccacttcaaaaacgtttgaacgtagtcttaatttctcgtgagtgtgatgatattgaaaaatatgctgatgatagtaatgttattttcttaccagaaaggagtttacctgaattgattcagttaaaccccgaatgtgttgttattggtggtgctaagatttataaagctgctcttccttacgttaatgagattattcacagtactgtcaagggtacatatacatgtgatacctttgttcgatttaaggatgataagcgtgtaaaattatcaaggtttgagtctaaaacattatctgacggtacgattgttgattattacgagattgttcatgtttacgatgattgggtggatgcataccaatgaaaatagacttatatactgatggttcttgtctaggaaatccaggcccaggcggtgttggtattgttgtagttattgataatcaaatccaggacaaactgtcatttggtgatataatgactacaaataacaaaatggagttacaagcaactattgctggtattcaatatgttaaggatacatatgaaaaccctgaaatatttgtttacactgattccaactatgtagttcgtggaattaatgaatggatagctggttggaaaaaacgtaactggaataatgtaaagaatgattctttatggaaaattctggatgaaatcagttcaggttgtaaatttgaatgggttaaagctcatgcagataatgtttataataaccttgctgaccaacttgcacgtactgctgccgaggaaatgaaaggcagttaacttgaaatgtaaaaatcagtcgagggaatgatgagtaaaattaagcttacggataagcaacaagaaatctttgatgattttatagatcgtgtttacaactatgcaggtaagaccatttcggttttgtctgccccagcaggaactggaaaaacattcactactgctgagattgtaaaagcactatgtaaaaactataatattgcagtaacttcacctacacataaagccaatgctgttattcgtaatatgctaatcaataatgctggtcttactaaggaagatgcacaagttagtacaatacactcttttttaggactaaaattagtatatgaaaagaatcgtcaagtactgaaacatgatccccaaagtaaagttagtaatactaacgttgacattcttattgttgatgagtgtagtatgatttcagaagaattattccaacatattcaggatcaattgtggcgtgtccgtcgagcagttttattcattggtgatcgttgtcaattgcccccagttgagtccgaaggtacaatgggagagactaaattgtctcctacgtttgatgtacctgttcaatatgagttaactgaggttttacgtcaagcattggataatccgattttggcagttgcaactgctattcgagagtgtattgggactagtaaaaatccatttgatattatgcatcagacatatggtttaagcactattacacctattgatgatgaagatttatttttagatgtttatcgtgaatttattatggaaaacaagggttcatctaaaaaaatatttgatttcgtaaatgaaaataaaatcttagcatatactaactatcgagttaatttggctaatatttacattagaagtcaactatttgaagtaccagatgaatttactaaaggtgaaccaattgtttttgaaagcataactgagaatagtccatatgtagtacaacaaattatacaatgtcctgaagtgaaacgtgaaagttttatggggattgattgttggcaattccgtttacctaatggtagttatattttaggcgtaggaccagaaacaagaattgcaatggacgaaaaactagataaacttgttaaggatattgagaaaaaagaaataaatccattgacaaagaaaccatatatgtggcaggattactatgtaataaagaataaattgcatattatcaattatccttacgcaacaactgttcataaatcgcaaggaagtacttttgataacatttggtttgatactgattttattgaacgtattggtacaaatgatactaagtgtagaattttatacactgccatgacacgtccacgttatagtgttatgttgagacaaaatgcacgattctaaaagactaaatgttatacgtaaatatttttgatttttaataataaataatcaaaagtgttttgtattatggagaagaatatacaatgaacaatttactacaagtatttaaaattgaagttgcagggacgaacctagataatatcccatattatatgtatggtgattatgattcatcttccccaacaaccgcaccgactgaccagcaaactattgataagtcaattgcacttttgcgttacctacaactttctcgtttgctttcaacttattcagtaccagtttatagcaatgttgaatttgctacaccaggaactgcaaaaacgatcccaactggtgcaacaatcactgttggatatattagttatcaaccttttcttagtactttgagtgttgcagagcaagcagcactaactagtgaagatatgaaaacagcaaaagctgctgagattatccaaacactaatcaatgattcattgaaaggtaatggcactaatgcactagaaaatgaagaaattactgtacaaaaaaccatacaacgtatcaagaatgctcttactacgagtactgttgatttcattgagtatgagaacgtgtatcttaatgttccttctgtttctgatgcatctgtagtatcttacgttaaattataattttataacatggagttcttgacatgactgacaaaacattttatgatcgtattattgaagacaagggagtttttgataaggtagtttatgacctagaacttatgatcaaagacgcaccaaacccacgtgtgcgaacccaagcagaatttgcaaaaacttatcttgttcaagttcaagcaatctgtgaagcaattaaaaaacacaatgatagtgcttgacagaactaatgttctatcctataattactatcgaacaaaacattaaaatcatattggagcttttattacatgaaatctattattgccaataacgaaatcaccgcaaaaactgtacgtcttgttacggaaggtgcaagtgaggtcatggcaatctctaaagcacttactttagcagaaaatcaaggattggatttggtggttattggtgcaggtgatgaacctgctgtcaaaattacagatcttaacaaatacaaatatgagttgaagcaagctgaaaaggcttctcttaaaaaacaacgacaaaatgccgtgagtattaaagagattcaattcaactttggtacacaagagcacgatttgcagattaaagcaaaaagtgctgaaaaattccttgatgaaggaaaacatgtacatattgtaatgaaaacttcaggacgtggaactaatgcatcagtaattcaagcaaatattaatgcaatggaatcattcgttaatcgtttgggtaacgtttcatatgttcaaaaagtcgagttccaaggtaaaaaggtaacctgtactgtcaaagtaaaataataaggacgattctatgaaacatactatcgaacaacaagtgttttcacttcaacagttcagcgttgtgaaagccacatataaagattcagtttattacttagcagggagtaatgacattactccttatgtaacaaaactacaatctgaacatagtaaagttgataataaagtacttaaagctggactagaattatttttaaaagaacatccagagaaaaatcagttggatgttcctaagtttcactttattttgttagatgatcctaccacacatgcagagtatgttgagtgtgtttgtagtgaagtattccacatggaccaagaccaagcatgggaggttattgaagcactaaactcttcagtacattcatatcatgttggtacatttactgatgaaatgtgtattacattcgctgcaatgattgacaatggtaacgaacaactgcgtcaaaatttaaaatatgataaagttccatgccaagcaaatggtaaagactatgattcagcactagaagttctagaaacactgattcgtaaagattacccagatgatatttaaaatatagacttaaaaactccaagattagatatatgataaatatctaaaacaaatcttggagtttttttattatgagttatgaagaattatacaaagcaataatggaagcaattgctccaacagatgtagagtcatcacatcttaaaacaattgaacataatggtaaagacttgtatattacttttaaaaatggaagtacatacgagtatgatgatgtacccgaatcattagtaagacatatgttaactgttgattctaaaggtagatttttatggagatatatccgtgataagtttccatatagaaaaaccagttctatctccaaaaagacgtatacatcaaatccaaatgctattaaacaacgtttgcgttatgatgtagaaactggtgagtgggaagatgcattaacacctgatgttattaaaacggttgaaataccagtagggtatcaatttagagcacctaataatcaagattatgtgtttcaagggaaacaatggagaagtaagcaaactggtaaaattgcaccaaagcaaatcggtgctaagataacagatatagctaaacgtttgattaagttaaaaggaaatgaccaggaaggaaccgatgaaatataatcaattacaagaatctattattaaagttcctagctccactatgtcacagataaacaaatatgtagctagtatcttgtactttaagataaagcaatttattcaacaatatgacatacaaatggatgctgatactcgtaatcaccccgccgcagataaaataaaagctaatgttattgctgaatgtaaaaaaacacttaatgtattaagttccaaatatggtgctaaaaatattagttcacaatcatttaataacattattaaccaatcggtaaaaataccttttgacgctgaacagtatataaaagaattaaattttaaaaagttagcaccagaagtcgttgacgaaatcaaaaaaacgaaattgtctttagttataactactgattcaactgcaaaagaacgtggttctatgactgaagttgcggacaatgcatatattataagagtaaacattaaattacttcctaaagaagtatattcatcttctatgcaattaatgagtactgcatatcatgaagcacaacattttgtgcagagttcagtaataaagaaaattaatagtaaatcaaatcaattacaagtaaagaaaaattatggtaaagaccatgatgaatacttaagttctggtatagaatatacaccacaattgggaaatgtaattgatgcgatggaaaatgaagcacaattattaattgatgacgataatctaccagaagatccaaaagaagcattcaacaaagtacttcaacaagtattatcacgtgatgataagtataatgcacgtggattcattattagtatctataaaacttcacagaaaaagtatagaacagtgatgagtactttatacaagaagttcatggatgcgtttgaaactattaataaaataagtactgaccatgaagaaggaccagttgaagatttaggagtttctattaatgaaatgaaaaccctaagcgatattgcagaaagatctcgttatttggaaactagattgtatggtcattcaagagatgaaattactaaaatacattctcaaagtaaagaacatggttgggaaatgattattactaagccatcagaaaatagggattctattattattcagatacgaagtgaatctgagaatgaaagaaatataatgaattataaacaagcccaaaactttgtaggttcattagcaagtatggatttctcaaccgatgaagttgttgaatttatggatgaaatattgcatatggatgccgatgatgcgaaggcagtaaatggtgttgttagtaaagttcaacagtggtcggatatggttggattaaactttgagaaaaccgatgaaggtttcaagcttaacaacactgaatttgttgttgaaccttataatggtcgtatggtaatatcatctccacacttgagaaatatgtatcttgttggatctgataaaataataactgatattatgaaatatatacttcgtttcatgaaggagcaaccagaaaaattacttaaaacattggacagggatgtttcaattgtgcaaatgagaagagacttagggagtttataatgccaagtaagagtaaaagtcaggctaaattcttcgcagccgccgcacacaatccagaatttgcaaagaaagctggaatttcacaaagtgctgctaaagaatggaatgccgctgatgaaaaggaaggaaatcttaaaaaaagttctaaacttcctaataaagtaaaagaagcaagtatgcgtagtttagtcgatattgtacaagatgcagaattagctgatacagacgacagaacttgtgatataatggattcatgtgaagacgacaaagataagttggatgaaatgccacaacgtttcgatagttttcaaggtcaagaccgagacgagtttgtcgataaaactgccgaaatgacaggtaagcacaacatggttaagttcgcagaacataaagactatgatgtatatatgaacaaaaacggtactggatttatcgcttacgataagtctggtaaacagcttgctatagttagtgggcatttatccaatgatgcagtacttggtgttcaaaacgtttttgaaattgccgcaactgcttctaaaactggaactaaaggtataatttataatatctttatggatatgatatcacatggtattaaagttctgagtgatagtctgcatactgatgatgcaattaaattctggacccgtttaattggttcccatcaagtttatattgttggtggtggtgaagtacttgcaaaggcgagtccagataaggttcataagtactggagtgatgatgaatcaagtccaagtgccgaacttcaacttatgttagtaaaataataatatatcgggacaaatcgttccgatattttttttgagacaaacaaaacattggtgatacaatgttttatgacaaagagacatgataaggaattcaaatggctaagaaagaaagtgctgttctacaggaacatgatgttcaacgactaaatgattatcaacatgctcgtttgcgtaccgagatgtatcttggttctcgttcagtgcatgaaagtcaagtactgatttttggcgaatcaggttatgaggttaagaacgtagaatgggttcctgcaattcttactgctacacgtgaaattattgataacagcttagatgaatttaaaaaagctggaaccaaagaacctgttttgaaagttgatttcaatgaagaagaactatcatttgaaattagtgacaatggacgtggtattccaattgattatgttccagagtatcagaaaaacttgtgtactatggtaatgactgaaacaaaaacaggccgtaactttgacgattcaaaacgtgatgaaacgattggtcagaatggtttaggtggttctgttgcaatgattgtcagttctaaggcagagttagaaattcatcgccaaggtcgtccgtataaaacacaaagtagtaatgatggttatgatgggttttataagttcaatcagaagtttgaggaaggaactattatgttccctgagcttcatgtacacgaacctactattagaaaggtacaaaccgataaaactggaacaacaattcgttttactttgagtaaagaagtttttccaaacagaaaactaccaaccgaattactttatagtattcttaaagaaatggcagcagctaacccaacttataaaatctttctgaacgggaaacgtattgctattaaaggaaacactgaaaaagcactcttcaatgcatctaaattaatgcagttgaatgttaaagatgattcattcaattttaacagtactttttatattgttcctaatgcagtagctggcatgaacacgaatttccatatgcatgggttggttaacaatgctcctgcatttgatggtggtacacatcttgatacattcaagaaattcttctcactcggtgtaggaactgcactagagaaagaatctaagaaacgtaggatgaaacctaatcgttctgatattgaagaaggtttgttgatttataatgtcacaactatgaaagcaccttcattcaactcacagattaaatctaaactaactaatgaaaacgtaatccgtccaattcaacaagctatgagtaccgaatggtttgatgaattagttaagaagaacaaagaatgggttgatgaaatcttcgaacgttgtgctgcccgtacaaataagaaagatgcagaagaagatcgtcgcctagcaaagaaacttctaaaaggtaaagttgcaaaactattggatagtactggaacagaccgttcacagtgtattctattgattgcagaaggtgactctgcaatttccaacatggctagtgctcgtataccaagtattcatggtattctaccattgcgtgggaaaattatgaacgtcagtggtactgagaaaaccaaagaattaatggattcaatggctttacatgatataatggctagtatcaacttagttccaggtgttaaagcagaacgttctgaactaaactatggtaagctttacatctgtgctgatgaagatgaagatgggaagaacattggtgctctagtgtgtaacttcttatttaaattctggcctgaattgtttcaagacccagaaaatccatttgtgtatgtattcaaaacaccatttatcattcttgagaaaggtaaagaatcaaaatactactatggtcataatgtgcatgaatataacccagatgattggaaaggctggaaagcaacgcgtgcaaaaggtttaggaactttagaaaaagcaaacttccgtgatgcattcactaatagtgttgcagtagcgatcaccgatgatggacgtcttggagaaactcttgatttgattttcaacaagaaacgtgcagatgatcgtaagaactggatggaataatatagactaatggggaacatggtgttccccttttaccaagagacaatggaatggctaaaagtaaaaaaacagaaaatcataatatcgataaccaaacactaactctactagattataacagttctgattatgtgaatacaacatcactagaatattcgatgtatacactagaccgtgctattcctggaattgatggtctaaagagttcacaacgtaaagcaatcttcacattatctaaaattagtggggaaattaaaacagtatcatgtgctggaaaaatgattagtgatggtatctatcttcatggggacacgtcagcatcaggaacacttcaaaatctagcatctccagtagctaacaactatcctcttattggaaaacgtggtggttttggtacacaagtaaacagtacaccagcatctgctcgttacacttatgttaaaaagaataagagtactgagatgcttgttttgcgtgatgctgatattataccaatgaaagagaactatgacgggacaacatatgaacctgttcatttcttgcctattattccattatcattgtttggtaatgatagtatgtcagttggttataagagtacaattctaccacataaaattgaagatattattgataattgcattcgtgctattgataaaaaaccactaaaagaaatgaccccatattatgtttcatgtggtgcaagtgatgttgtgactaagcttgatgaaaataagtatgaattctatggtaaagctgaggttattgatgcaagcactgttaaagtaacaggcttaccacctaattacagtattgagaaattcatcgaaaaactaatcaaaatgagtgatgatggtgagattcgtgattatgacaatgatagtactgatgtaattgatattaccattaaacttccacgtggaacgtcagctaaatggacagagatggatgttattgagtattttggcattaacaaaaaaatgactcaacatttaactgttctaggtgaaaatggcaaagtgaaagtttacgatactacgatggatttgattaaagacttcgttgatttccgtttcaaatattacatcaagcgttatgaaaagaaacttgatgattgtgctgctgaagttcgttataaaattctaattaaagaatgtttcgataatgatatgattgctaaggtaaaaggatttgcaaaccgtgctgaaatggttgaattcgttaaatcgttaaataccgaaattgaagcaacggaagagaatattcaaagcattgtaaacttcccttcatatcgctggacgcaagataattatcaatcagtactacaagatattcaagataatcttgatttgatggataagtacaatgaactgttatctaatcatgacttaatttgggacatttataaatctgaactaaaagaactaagaaagattgactttactcctaaatcagacaattgatatatttaatggaagaccttatgggtcttccttgtcctttatataaataatctatagataatggcagcttggctatggagaattataatgacaacttttaccccacgatgggatataaaagccgatgctcgatatatacaagaaggacaagacattcttgtgcgtttgagtatcaataaagaaagcacaacggatgatagctatgtattaaatgaagatgaatacttagaaatgattcttaacatacaatgcttggatagttcaggtgctgtatttgatccagaaccacattatactttttatgttggtaatgacgaaaatacttttgttcctatttcagatggtacaactggtaataaattagtaaatggtaagcataagtgtaaaatcagcaaaaatgaatttaacttatctgcaagtactaatagtgaagatgtttattttataaaaattcattgtaaaaatgatggaacctataataatacagaaattataaatttttatttacaagcagtaaatgttatgtattttggaaatatttcaccaagtggtgttctaggattaactgatacatcaataacatatgatagtcaagaagtttgggttacacctggagttgagattggtgatgacaaaaagctttattgtattggtgatgttgagtatggctccaacagtacattgttcgttcaaggatttggaagaagacgacctttcattttgggtactgacatgactactgatattacacctcgtgtcttttttccagcatatcgtttgattgacatggatatttctgaagttccagataaacatattacgaatgatttcgcagtattcaagccagcacaatcaacatggcctatttctggtataaacaaagaagtaaaagttaatattcaaaatagaaatggtaatttaattgacactggaatggtgttcaacccaaatgggcaattattgcaaacatttttatatgactcagatgcttgtgatgcatattttaaagttgagattgttgatatattaagtacatacaccgaagaaagtgaaaggtttgctatcaatcaacgatataaagcatatcaaatgtgggtttgtcctgaagacatagatactatatattctatttcagaaaaaccactacccaatcatttatatcaattaaaagataatgttgtgtatccatacgtaattagtggtgaatacgataatggaacaattaagcccgtttatgatagtagtgattggattgatttaggatattatgactctactcttggtgataatatcattggtatgcaaaaaatgttcagggttttgataaacgcagaagaaggtaataatataaactttattactgatagtgatttaggaaccatacatgttggtgaatattttggagacagtatatatcctaaaattgaaactgatagctctaatcaagtttcgtatgttttagatggtggtgatgacattagaaagtatgggatagatttgacaccagatggatatcttgtaggaactgcatatgccaaaagtattgattttagtgaaaatgatgatattaaattatcgttttatgttaaagcatttagtactgaaggtggtgaagcaagaaaaatatttaaccttaagattgtaagaggattcggacagaattatttgagtgcacatgtattaccttcggttgcatttgagagagaatggtttaaatgtatcagtacttcatcattcactaatcaactatttttccgacaatctgacaatagatatggtcttcagaaaataccgaagatgttattgaaagaaaacttcctaagtcaaacgtatccatatactaacctttctgatatcaagaaagtattgagaaatagtataattaacccaaatggaactactattccaaatggaaaatttaaaatggtaatgggtaattataaaataatatcagcacttgacaatcaaggtaacttacaatatgatctattatatagagaggttttacctgaaggatctttagtatctgtatccaaaaatccacgtcaatatactcaaatcgacaacggtcagcttggtgaattatttggtttacgacaaaatatttttcaggctattggtgaagacacaaccaacttagtaaaagacccaaccgatttacaaaatcgtggtctatacgttgatgcgataccaagtatcagtgatgaaatgcttgatacggttccaagatttatgaatcacccatacattgaagatggtatacagaaaaaattcatgcctatcattccagttgcatattgtcaaccagggaaaggtgaagcatttttcaacactttacttcagaacaatgaacatggtacaatggtaggtgtagagttcgaaatcacatcggttgaattcggatacttttcgcatgaatcagtgaattatgtttcagatacatttttgattacattgcaaaacaataacataggaggttaatatgtttaatccgttttttgacccgtctggaatgacggaaaaagaactacagttaaaaattaatgaacagtctatgcgtttaacttctgctcgtgctgctggcctaagcgacatgattattggtaatatgcaaactgtcttaaatcaatgttatgctgaactagaacttcgccaaggacaaaaagaaaaaactgtttatgacgaagaagacccatgtatcttcgatatggattcatatctaactgacaacgaagaggcccagaagaagaaaaatgaaagtacaaggaaacagatttataagtcccaatggtgatgtgaaatgtaatcttaacgcagttgtttatgcaatcaattgcggtgcagatatccagtacttacaattgcaggaaattgatgaacctgaaaggttgaaattcaatgataactgtaaaaaatttggcttagaacaacgtatgctggattatacaattgagcatgataaaaatcatgaactgtggcgatatgatccagtatacgacaatataaatctgcgtgactttttcttacaaaaatgcacatccgatgaagcacgaaaacgtgttgagtatgaacttgatttatatgaatattataatatgacaaagctactaagatgtatgatatggcttgttgattatatggaagaaaatgagatcttttggggtctaggtcgtggaagctctgttgcatcatactgtttgtttttgattggactacatatggtagattcattgaagtacgaacttgatgttaacgaatttttgaaatggtagaaaaacatgtgatataatgtttattgtaggcttatatcacacatacaataaaaggattttgatatgtctaaacatacaacttatcgtggtacaacaattgacatggatatgctcaagtaccaaaatcaacatcaggtagcattgggtaatgctaatctaaacgcacgtggtgataaaatcggttccggtggaacaattattaaaactcgtgaagagttgattcaagaaaaagaacgagaaatgcaaattcctgattatatccctgaacatcaacttcatagtactgaacatggtacggatgaagtatgggatgatgagagttttgaagttaagcccgaagaacaagaagctgaggtttctgaagagaagaaagcaccacgtcgagctagaaccaaagatcaggagtaatatattaaatgactaataaagtaatgactgcatgtaaaggtaaagtactggtaactgaactggaacatggtgaacgcaaaacagcaggtggtatcgttttaacaaacgatgacggtaaaattagaggtattcgttctcgctgggcaaaagtttattctgtaggcgaagacattactgatattaaagaaggtcaatggattttaattgatcatggtcgatggtcaagaactattgaagttgatggtattgaattaaacttggttgattatccagccgcagttagtttagtttcagatgaagatccacgaactaaaatgctaacctttggtcgttaataaaatataattaaagctcggatgaatatctgggctttttatttggacagattttgatgataactgatgatggaaaatttagtttcaaggatgtaacattagtatctaaaaacggaagattcatgtttgaagatagaaaaaataccaaatatgtatatgaagtttcacatgatatgtttaaagttttattagttgcatcagcccaagctgaaagtactgggattaaaaataaggcaaattcttttaattttttattaaatcaattggaaatgacagaagaacttttcacggctttattatataattcagccgattggattctataacacgtacacataaggaaatacaaatgaccacactatggactgaaaaatatcgcccacaatcaatggaagattatgtatcaaaaaacgatgcactacgccagaaaatggaagaatggattaagactggtgacattccacatattgggttttttggcccagcaggaactggtaaaacatctgcgatcaaagtactaattaatggactagttcaaaatggacaccttgatccaagtgatgtgaccacgcttaacatgtccgatgaaggcattgatgctgttcgtgacaaaatcgatgccgcagcaaagctatcatgttttggtagatatcgtatttttgttcttgaagaaatggagcagatgaaccacaaagcacaaggtagtttgaaacgtgtaatggaagactatcatgaaaatgctcgctttattttaacaagtaacgaaccacataaaattcaaaaacctatcatttctcgtgttcaagttattacaatcgaaaagcatgatatggaacaattcatgactcgaatttataatattcttctagcagaaggtgttgatttgagtagtgatgatagtgttgaacaagttcaaaagtacatcaatgcttcctatcctgatttccgtaaaacactaaacgtattgcaaagttcagttgttgatggtaagctagtaaaacttgaagatagtattgaaaattcagcagggtatcgtactgcaattgttgaagcattaaaggcaggcaacattcgccaaatgcgtgaacaaattgtacaaaatatccctgatgatgagatggatgcatttttctcttacttgtacagaaatgctgaaatgttcagtactgatgaaatcacactgatgaagattaaagttaaaattcgtgatgcagttgttaagcaagcaacagtatcagaccgtgaaatgaatcttagtgctttactgtgtgagattgacctaatttgttcggggaacatgtaatgaaaccacgttgtatagtttttgattgtgatgaagttctattggaccatatgggtatgctttctgagtttgtaaaacaaacttataatatcacaccatcaacaccatacccattagaatatgatttatcagactggttgggtgttcctcaacctgaagttaaaaagattcttgaacagttcaaccaacaatcatatttgtttgggttgttaaagccagtcgaaccaaatacagttgatattgtacaagagctacgtgatcgttttcataaagaaaaattcgtagtactcacaaaatgtggtaaaaaaggctatggtgaagttttacgaaatgtaaatctaatgcgtgaatttggtgaaaactgctttgatgagattattatcatagaaatgaatgaatcaaagaaagaagcattagaggatttacaaacacgatatgatgtaaaactaatgattgatgattatatcaataatattgaaactgctatgggtcttggtattccatcagttatgatgggatgttctcataatactatgtataagaatcatagtggttttgaatatatcgaaaactggacagaacttagactgaaaatttattcagtactaggtaaatattacaaataaaacttttaaattggggtttgattcaaaccccttttgttgtattttaaaagtagtaaatagtattatatgtgctagtttttaaggataatataaaatatggacgatttagattatacagataatgctattcagcagttgtatgataacagtggtatgttagatatacttcttgctgtagagaaatatttcgatgataatgatttatatgcgtataaaggaattattgagggtgagttggtagaggggccaattgtaagtaagtattggtgtactgttacatttaaatactatcgtgaaaattttcccgatcctaccgcattctctattttagagaaacatggaactaaagtatatgttaaagctgattatgaaataactcctattaaagaaccaaatcgtcaagctgacatgaaaagtgtagcgacacaatctggctctgtacgtataccaaaaaatgaaagaatcccagtactattggttagagtgcagattccacgaaacttgattaatccagaaagttttgatgaatataaactaatggcagcagaattcaatagtaatccaatgaattctcctgagaatattgaagaacctgtaactggtgatgatgtggatttagatgaagaagtaacggatgagacacaagaaggtggaatgtaatgaaaaagaaattaaatgaacaaggcttacgtccgcaagttctcaaagatttgattcatcctatcattagtgttgatgaatatactcctaaaattgaagatagtaatattgttattatgtttcaggtacttaacaattttgatgcagcatatgatttatcttcttttattgaaaaatcacctattgatgtagctgatacagaagcagcagaaacaccaaatttagatggtcgatatcaagtttatgttgaaatggaacgaaatgctgaattccctgaaaaacttttacgtttaattaaaactattgaaaatatttgtccagacccaggttggaaaatacaactatatggtgttaatgacccaatcgatgttgattttgaagaaatacagcagagaattgatttgggtattcctagttcaattagtgagttccttgattatgctggtgtttcagtaatcaaagaaggaaacatgttgacattaaaaacagcatatggtaaattacattacagtactggaagcggttttgtttcagaaacatatgtgaaaaagttattaaagaatgatacacaattagacacttcgcgtcttagttccatactaggggaaagctatacagtactacgaagtggtgatcaatatgtaattggaagaaacgggaaatatttggtgttgcgatgagaattttaaatatgcttaaatctcttcacgaaacaaccaaattacatcaggatgaaaagtatcgtcgcagccttactaaagatttagcatgtcgtatgtatatgcgtagatttgaaatttcaagaattggtaaaggctgggatgatgtaaatcgtgaagacattgatccagatgcaatttttaaagcatacatggctagaaaagttttcataaatgaaaaaactttttatattgatagtgatagagaattagaaaataaatttacaaaaggtttatggaagatatggtgtgttgaagtattcggtgaagtattacctgagccacctgttccagaaacttataaagatttaaaaagtatttttgataatgaacatatacattcaaatttctcattatatgatactgtgtcagaagctgtattttatggtgagttacatggtcataacaaatactttgatagtatggttagttttgatttgttttgtcacttgcctggtgtatcaagttggacatgtgaccaacacagagcaagtaagattgataagcgaaaattctcggcccaaagatttatgcaagttgctatgagtatgtataaacttgattatcttggttgtccagaaccatataaacatttttggaaagaaagagcacaaaaatgtttaaactattgtataatccgtttaatggacacatacattcttaagtttagaaatgcaactgtatacgacatgcctgaaccaccaaagaatgaaaaatatccacctgtcaagacatttgtatggtacaaggataaaagtaacaaaaggatgcactaaggtgcgtccttttttcttttcaggtgttgacatgtgtagtcgaagtatgtacaatatcaccatagcgtaaattttaattgattatgaggttttataatgaaaggtaaatattttttcattgaaaatggcaaagaagttgagattcaagaatttaactataattatgtactgaactctttattgaaacaatatgaccgttcatcaaacaaaaaatacatttacaatgtaattgtacgtcgcacctatgactcgctgggtaatccgttatttgatgtaaaaactctgtcattagatgaaatctattttgataataaacgtctgaaagttcttgatttaatgaaggataaaattcattttagtaatattagaattgatcctaacatgccagtaccgccattagagcgtgaatatcgtgaatggaaagaaggtcgtgccaaaccacgtttagacttggtacaaacatcaccagatgtacctgcacctattgttcttaagaaaaaacctatcaacccagacgatagcagaattgatgacattgaaagatgggttgaattccctagtactattgaaaagaattcagtaaaagtactagactggtttgtaaacttaccagtttgtgcacaagaaattggaactaagattcaacaaatttcagaacgtcaattggatcttaactcagcattacaacagcatagtgattatattagaatgcttatgaataaccttactgttgcgttggagacgttgttcccattgaagccgacctttacacagaaattgtttggtaaaactgatatcaaagtgcaaccatcagatttgccaaaagtgatgaaagcactaaatgaagcagttaagtatgacactaataagtttagtggtcttagtacgatgttttcagaacttagaaacgaagttaatgaaatcaaaaatgaacttgaatatggtaagttgggttgtgaatacgcactacgttgtgtggatgatgcgtttgaatatgaattaacattagaacgtattatgaaaatgggaatcaccacctccatgactgaaacgagcattattgcaacaagtaagcaatatcaagttgatatgaatcgtatggtagatattcaaactattactattcctttgattatcaatcgtttacaatcacagacaggtaaagctgtggatgagagtactgtagaaattattcgtaatctggcatatggtaacaaagagtaaaaaaatacttgactatcatacgtgctgcccgtataatgtttatcacagagcagcacatcatattaaattaaacgaggaatactaaatgtccgagaaagaaatcaatcctaaaaaagcatccaccgcagctaaatcagcaaaacgcactactaaaactgcgtctaaaggtcatacaattgatgcaagtgatatttttaaccaaactacaaaatcactaccagtactgaaagatgttaagggaaatactatgtctctaacagttcaaaacatcaatactgttggtacaactgctggtgctgctgttgggcgtttggctgatgaaattatgtctaaagttaatgtaacggatgacaataccgagtttggtaaatcaatcaccacaattcttacgttgactcgtgcagttgatattgacagtcttcaagaagataaatcaattgttggtcgtattaagaaattctttgttaatgctcaacagaaagtaggtgatcagtacaaaaacagtaaagagcaaattgacgaaattatgaaaactcttcaaactggtattaatcgccagcacggagaatgtgaatggcttgataaagcatataatgaaaacaaagaatatttgtttgaattacgtgatacattagttggtttagaagaagtaactaaaacacaagatgcattattattagaaatgcaagcagacaaaaatgtagactcttttgctattcaagagcaaaagatgatttgtgaagcactttctaaacaagaagataagattcgtcgtcttatcatgatgtgcgagctaagtggtccacgtttgatgagtatgaaaaaggtaaacttgaacactgtttctaagtttgaagatttaaaatctgttgttattccagcatggaagtctcaattggctgaacagttaatttccgagcgtcaacgtaaggataatgaactaggcaatctaattgataatgagacaaaccgtcttttggaaactaactctaaaatggttgcagcaaatatgttggacgcagcaaaggcaaacaaccgtggtattgtggatattaaaaccttgcgtaatgtacataaaacgatgattgacagtattgaagcagttattgaagaagagaaaaaaggcaaattggaacgtgaacgtgctaaacaggaaattgcacaactttcctatgaactggaagacactcttcgtgaaattgccgaaaaagctaacaagtaatagttgacatatgagtgcgtttttaatataatcttattgaaaacgcactctttttaatgtacagataaggaactaacttatgaaacgtcgtcatattagtgttgatattgaagctcttggaacacctgaactttccggttatgatattattatcccaaattacgcagcagtagtagttccaagtaaacctgaaaatgacattcgtcagttcttatatattaaattaccataccaggatcaagttgctactggtttaaaatcagacgcaggtgcaatggatttttggatgaatacatgtcagaaagaataccctaatgcatatgctgaagttgccagtactatgaaactcaaagcacctgaactgtatggaccgaatggtcaatcacgacgattttttgcatacagtagtattgttgatttctggaaagaattacgttacaatgattatggtgaagaagttcctcattcagtctggggtaacggatgtaacttcgattgtagcattttacaagcaaaccatttaaaactaatgaacgctggtgagttgtggaagtatgatgcacctgaaaatgcacgcacattgaaacgtttattgaatgaagaagctcgtattgaaatggatgaaatcgtttcggtacagttggataaatttatcacatatgcaaatacgtgtgggattaatgggttggagttacatcacccactgtttgatgcagcacgtgaagcaatccagatttcattctgtctaaacaagcttaaaatggattaatacatgaatttcattattctgttaatacctgctcttatcgttgtattcgttatgaaatacatgtacgataagcatatcagtactaaagaactattgattcatattggttgttgtctggttggtgcggctcttgttcttggtatttcatacgcaatcaactatagccagctttatgatgttgagattctgaatggtcaagtaacttcaaaatacagccacaaagaatattgcacacaatctagttcatgtaagcactatacatggcatgagaagtgccatacgcgatatgatagtaaaggtaaatcacatcgtgagtgtgaatcatataaggtttttgattactcatatgaagttgattggtatgtgaaaagtacagtaggtgagtttgagattgaacgtgtgaaccgtcaaggtacaatgacaccaccacgttggcagcaagttatgattggtgactatgccgccgcagagagttcatatatcaactatctatttgctgataagaactcattgtttagtcctgaagaactacacaacatgtatgatgaaaagtatcttagtactattccagaatacccaagtgtagttgattattacaaaacacatcacgtaattaacactacaaattacaacgttgatggttacgatgaataccttcgtaatgagctaaaaacgatgggtgcacgaaagcaggtaaacatccaagtactagtttatgattacaaagatgtggattttgttgatgctacccttgcatcgtggcgtggtggtaagaagaatgatgttattatgttctttggtattgacaatgatggtaacgttgtcaaattttacagtacatcatttgcacaaggaatgaagaatgaagagttacatgcaaagatgcgtattgatgcattaaatgaaaaattaactcttgacttactagttaaagaagtacataatattgacacacagtttgagagactctctaataaagagtttgagtacttgtcagtaaaaatggaacctagaaaagatgttcttatcggtgcttccattgttttgttgattctgtctattttcattggcctttatatgagggataacgatttatgaatggtaaactccttgcgttaattggtattttggtagttattgtactaatggtgtttggttctattagtatgtatgttggtgcacatgatcgtgcagttgagtttgaaggaaacattaaaaagtactatgatgcatctgaaagtcaacttagcaattatactcttactattcaagataaggttcaagtagcagataagtacaaaaatgcgttgaaagaaacgattgagtcatactttaaagggcgtgaaggtgttgaccagaagtttgtaatgtcacagattcaacaacaggttccaaatcttgatcctaaaatttatcaggaattgatggtgacaattgaagcaggacgtacaaagttcaacaatcttcagaaaatgaaaattgaccagtgtactgattatgctaagttccgcaaaggcttctggaattccaaaattcttgattcgaatacgtttccaagtgaaaatattgaacacctttgtacagtagtatctgatacacgtaccaagaaagcaatggatactggtattcaagaatcaattaaactataattaaatgttgggagtactttgtactccccttttctatggggtgtactatgtttttaaaaaatacttatgaattaattaaaatgcttcaaaatatgaattccggtggcttgtttccctattactctgaggatgatactcatcgtttagtccttaaattggatgaaactggacgtattatatcactaagaacaacagtccccagtgtagaaccagtaattaccaaatcaactcaaaattcaggaactgctgttaaaacaccacaaacatacaactctaattaccaacaaccacaaatgtacacgattagcactccacctattaaacgagttgcttgtattgtgaatataaaagtatctaaggactaccgcgacttaatatcagttgaatggtcagaactaacatcatcattagcaacaaatggatttgtagtaacaaatacaggtctagcacaaaatgtgaaagaaggacaacagatcatgagtgcattgtatcttagtaatggttgtgttatcatcaatggtaagttgtatagcgatgccgaccccactgcattcactgaagatttgattggtgataaagaatacagcattctagaaattatgaatttgaaaaaggtatatgaaaaccatgactagatttcatcaggatgatttgccatttatccaagaactagaagaactggtgataagtattatggatgaaattagtacttgggatataacagtttttcgaaatgtatatgataaagttgtgaattttaaaaatgttaatattgaagtaaaacataataatttttacttaacaaaacaattcattctaactcgaccaggatcaaagccagttaaacgtaatttatcattcggacacctgattggtgcagaaaatgtacatgatgaatgggttgattcaatctattcgtatacaaaagaacttattcctgatattgagaaaaaatattatcttagtatcacattagatgaacaaggaaaactaaatgcgtattccataaattcatcagcacacgttccattacattcaacgtcaattggtgataaacaattactaatcgattcatcaacatggcacaatagggaaagtttctccgctgaaacttttcagtactcggtatctgaaccaaagtctccatttgattttgtgtttgttaataacatccttttacgttttggtgtaggagtctaattatgctaatttatttgagtgttcttgttatttcattactggtatcattagcagtactgaaagctgttgccatcggtcgtagtaaaattgacagtactgaaacgagttccgttctagatttgattatggatcatcctaaagtctgtggtattattgtattgtttgttattctgattaatacgtatattgtcagggatcatttatataatatgtatgattgtagtgttagatctatatcacaaggtgttgaaactgactatagctggtactatgagaaatgtagatttaaaaatcagcatggtatttgggttgattttgacaaactacgtggaactccttcaggagaagaagaataattatgtttgagttcccagaagagtcatttgactttattgaccctactgatgatggataccgacacattaacatttatagtaaagctagaactaagttaggtagagatctatctaacttttcttcgcatagcttcacacttgaaccatatggttggttcccttcagttgaaacattttacttttggtttttaactgggcaaaaacatgatgaccttagaaaagtatctggtgcagcagcaaaagcagccgctaacaaatatatgcatgatcgaattgaaatgacggatgattgtatttctattattcaagatgctatttgtgctaagataattcaaaatccagagttagccgaaagattaagaaaaagcaagttacctttttaccattactatgtatatggtggtaaagttgtagatgtatccgacgaacatgattggtttgttaaaacattcgaatatataagaacggtgttaaaggaaaactataatgggtaaatgttgggtatgcttcaaggtgtttgatgaagaatatgaaataatattagatgtattgccacagcagtacatggtgtgtaatgaaaaatacaaattggacacctacccgacccccaagtacatgggaatatgtcctttgtgtgatgcaaatggcgtgtccaatagtgagatttcattcactaaccaagccacaactaactgtgtatctgggtatataagagagaatcgagaatattttattaggagattatatgaacgacaaaatctttgatacatatgacatcgatactttactaacaccatctgataacagtactgttaaaatggacatgtactggattgtcgttgataaaaaagtatttagacataaaattactaaagtttggcaatgtaataaaaacaaatctattgttgaaggattggcacaatgcattcctaatgcagaggttttatttttaccatatgcatatacaaaggaataaaatgaaaaaaacttggaaaatattcacaatacctgctataatgttgttattggcacttttcacaccgcagagtcatgtattgtctcttaacattgtggaaataattcttcttgtaattcactgtgtcgtgtgttataattatgtaaaaggtgataaagaatgaagttctttaaaattcgaattggtgtaagttctggtttatctcattgggtattttatgatttacctgatagttatactattgatgatgtaattgatttatataccgaagatcaacaatgggtgttagataccgaaacacatagaattgattgtcaagagattagtgaagaagattacaaacacggaaagcaagccatgaagtattttgaaacaaatatcaaaatgctgactgaaaacgtatttccagtaaaagaatgggcaattttacttgctaatcctaaaaaacctgttagaattggttatccaaattttcatatggtgtatcgtatgaatgataagcgagagcttaactatcaatacgattacgattcatctaagtttggagttcttaaacaatttttaaaggcttatccagtatgagtgaagatagtaaagagtatattttacgttgttcttgtggcgataaaatggagcattgcgttcacattgcacaatttgacttgacagaggaatatggagatgataaacttggtcaatgtctgataagtatgcgtttaaatccttttttaaaatggtataaccgtgtatgggttgcagtaaagtatgtttttggtgtaaacgactatcaatatgtagaagcaacaattgatgttgacattctaaaagaagttgtgttacaattagaagatactagaactgatgaggttaaaaaagaacaaagagaaaaacgtactgatgtgaaggttttatgagtactgaactttatgaaaaaaagtactgtacaaattgctcaactgagtatacaatacaaggtatgttgatttgtacaatatgtcagtcaaagaaatcagcaactttcatcgttgatgatagatttggtgatttgaaacagtttaaagcaaaccgcaatcttcgtatttttagcaatctaaataaggaataatatatgaatatcgaacaaactatccgtgaacattctttcttcgctccagaaactggtcgtgttattgagagcgtcaaaatcgaagaactaatggtcaatgttaaatacaaagaaccaaatgatgagattagcagtactttttgtgctctacgtgcaccattccgtaatgaaaaagctaagaaaccagcatatgttcttgccattgcactgggttgtgttgtaaaacttgcagttgatgaaaatcttctgaatattaaagttgcaccaagcaatgacgatgaaaacattgatttgaactttgatggttctcttgatgaagatgtatttttccaacagtcacttgtttacgacttccgtacagtgacacattctcacatcaagttcattaatgaaatggttgagattgttgctgaatacgaagaatctctctaagtaaatacaaaagcctccattatggaggcttttatcacataaggaaatgaaatatgatagaccaaattaaaatccttacaaagcaaatcactgattttctttctgataaagatggatttaatacagaagtaaaaatgcacggtgttagtgttgatgtaattgcaccaaatggtaatgtaacaagttacgacatgtatgaattacttctttatactctagcagtacgtaaactaggtagtgatattgaactcaatatcaatactgatgaaagtgggaataaaatttttgcaatcaacaccagtgctaaattcgatatcagtactgaaattaaaaaaataaatgaaagttttattggctttaagcatgaatcaattcaaagtgtttttattggaaagcaaacttctaatagtgaatgcccatattgtgtaatgactttatataaagatggaaactggatgcgtcaagatttagtatttgctgaacttctgtatgcatttacacatgaacttaaaatcgaattggacgatagtgtttattgctttaagaaaattcgaaatataactaaagatatacaaacccaacttaaagaattaaatgataaataaatataccagaaatggttaacatatcatgttactttcctcccttacataataatgatgcgttattatattttcattttgttcttattccccttttggtacaaaatcattttagtactgccccgatcttcggggcatttttcttatctaaaattgaggatatatgaagaacaatattggaacttcaataattaaaccactttcttattaccttgaaaaatttagaagcacaaatggtaataaatttaataatatatttcagttctctcataaagaatatattacaattgatcatttttcaaagaaactaatgtatgtaaatgataatagtcatattattaaattatcattcgatattgagttagataaattaacatttactgaatacattaatcaaaaaacttcttttttatgtcaatacaataggaaagtatatagtaatatttctatgtatctaaatgatgaatatcactttcaacaatctacaatagaagaagtattgttcagtactgaagaattaaaagaactatattactggtataattatttcacatcttgacattattgtgggtttatcctacaatacatgatgatgctgcattgaggataaatttatgagtttagatttacacaatgaactaaaatattttttagatttggacatatcagaattgaaccaccacgtcaatcatatgactagtactgtatggtggtctaatgatcaagacgacccaattatccaactaagtgatgaatcgtcaattatgcgattttataagattaattataaaaagaacatcaagatcacatatgtaccatacaaaaacatactactagtcgaaacacttaatccaagttctttattaaaaatcaccgatttagatacattacaaacaagtgaatctttattccaacgttcattagttgatgatcttggtggtattacttttgaagatatattacaattgaagaatatgtatagtgaattgttggagattaaaaacactttagtaatggggaattgatatggtaagtttactagatattgataataccagtttagtgctggtgaaaaaaggtttaattccaaattctaaaaaaattgattatgctgttattgaaacaaatattggaaatatctggtacgactctgaaagggatattgtgtttagctgtgtagacagtgatcgttctgaatgttgtagagtcggtcatgacggacaatttgtttttgaatttcgttattggaaggacgcaaaatttcaccaagaactggttgctttgtcaaatgaactatatacagaagaatcgttcttcatggctagtactattaatgattttggttcagttacatttgagtactataaaaaaatatacgcactatccagagaagttatgaaaattatcagaactgctgaaggtaaagaataacatgactactatatatgatattttgggtgttctgagtagaaatatagatgatgattttgttattgttcaagatactagaaatacatttcaactaccaataggttcaccagataggttaatttttaatagatactcaaatgaactaacttacatccatgatgggattgcaattgtatcagtttctataaacgactatacaatacgatatgtatatgacttcaacgattattgtacaagaatccacagtattgatatttccgaagaggaactattccaattgtcattgattgagaaaaatgtaataggaattacagaaattggtattattaaaaaagcattaaactatacaaatataagaattaatggtgggtgcagatgaatgttgacgaaataaaaaatcattttgaaattgcaatgtcatgtgaatttgacacacaacgtgttcatgacccgaaagaacatatacgcatttgttgtgaattgtcagatgattgtaatatttttattggaaaaacctatgacatgatcgatctttcatgtatagatccattggaaagaaaaacaaaatatttatatctgtacaacacaacatcagatacgatttcaatacaactaatatcaaccacaacatcccaaagttattataacataactgaggttagtagtttaacgttaaccgaagaaggattctttcaacaatcgcttattcgtgaaattggtgttagttatgatgagttaaatgtattagtagattgtttcgaaaaattgagtacttttgtattatccctttttaatatacagtcgcaaaatccaatggtggtgaaatgctaaatccaagtaaatttctccacttactttcgataacatcaataccggatcttaccagtgaaactaatgaatatcgtgaagctggggtggtgtctatggaactcgatacatttgatcacaaatgctatgtgacatatgacccaccgcgttatggtaaagaacattcttcttttatttttgtattcgtatacactgtatatgataatacaacacttgatgatgtttgtattgacacttacgaaatttgtgataatatcataactgatgacaacaataattcatttgatatgtcactatataacacagaagaatcgttgtttcaacttagtactgttattgatgcaccatcattagaagatataaaacaatttcaagaacatcttgacgcagttcgtgagatgttctataatcattatccagaagtagagttcaattaactaaaggtaataagatgactaaagtagttcgtaaacgccacatgatgaacatggatgaatttcgcacatttgacaaatatcgtactatgtttcgtatgctttcacagggccgtccaatcgtcattgtaacagagaattacatgtcacctgagattatgtttggtaattatgaaaaggtcttcatgttgtacgtgaagcgtggattacttacaatcaagacattagctgaagcaactgatgaagatatggatggtgataatacctttaccatgtgaggaaatatatgtctgaaaagccaaaagaaccattagatcgtgatgatgatttttatgacgaacgatatggagatgatgatgagtgaacatagtgctgtgcttaaaaagattttaaaggaacttgatggtgagtttaatgtcacagaagaagaatatcagcattggaagaaaggttttgaacaactaaccgagtatgataaagtgttcaatatgattggcgtaattagccagtatttactcggtggaggacgtgcaagtgcttcaattctggcatctgcaatcatctgtacatcacgatggtgtgatgaaaaaagtttggaagatttctaaataagatgctataatatattatagtaccttaacaatataaaaaggattttatatgaaacctatccgagtactttctctttttaatggaatgagtgtgggatatatggcattgcaagatgcgggtatcccagttgaaaaatattattcatccgaaattgataagtacgcaatagctgaatctcaatctaactttcctgatattatccaattgggtgatgtaactaagtggagagaatgggatattgagtgggacaaaatagatttattaatgggtggtttcccatgccaagcctggtcagttgcaggtaaacagggtggtttaaatgatatacgtgggcagttatttttagtaatggttgaaatttttgatcatatcaaaagtctcaatcctaacttgaaatttctgtttgaaaatgttaaaatgaaggaagatttcaaagaatacattaatagtattttaggaatcacgccagtactgataaactcccagcattatacgcctcacttcaggcagagatattactggtacagtactgataagctttttataccacctgcattatccaatgcacctaaacttcaagatattattgaagatggttggtacactgacagaaccgcttcgtactgtatagatgctaactattttaaaggtggtgattgtaaccagtactttaataaatccagacgacaattggtgtttcgtgacccagtgatcagtcgtcaatatctattagagaatggcaaaagaaatattgactatagacacttaagtgtagtagaatgttgtaaattacagggtgttcctgaagatttctttaaagtgtctagtaagacacaagcatataaaatgcttgggaatggatggactatgccagttatatcacatttactaagagagatattcttttgaacataaacaaataccaaacttatataaaacgtacagaaagtttcaaacggctggctgtaaaatctgaattagaatttaatttgtattatcctaatattggtgatgaggtattttattgctctcattcaaagaatggaactttacttaaatcgggtaaaggaactattgttgatatgaccgcaaatttcagaggtaaacttaatgtaatgtacaaagtacaagattcaagtactgagtgtattcatgaagtgatgcataacatacctgcatatccaaaagattttgttcagctaatatctcgaagggagaaacctatgttttattgtggttacgacaaattaaccaaacaaattattcctaatactatgggaaaatttaaaagtgatgtgaaatctgaacttgaaaagaaatttggcacgtcatgggaaactgaaaacgagtttatcgaaattcgtttaattgaaattactatacttgaataattacaaatccacgcattgcgtggatttttcataggtgcatatatgccaattccttatgttaaaattattaataatattctcgattcatgggaagatgttattactggtaaaaagaaaccatcaccagtacatgctttatctgggaaacttcaattcagaatgtcaaaccaaactgaaacatttaataatcatgatatttgcattacattaaaaacacctgttagtattgtaattaaaaaaaataaagatgatgaattgacattatctattggtcgtgataaaatcattttaagtaatttgtctgaagaagaattctttcaaagaagtactattatcgatatgaaagatttcacatatgaatcattggttgaactcaatacacgttttaacgatattcaggaacgattgcgaccaattcttcgtatcgaagaagaagcctagattgaaagtattaggaagatgcaagaaatgttgaaagaaaatattaacaatctggataaagctacaatggaatttggtaaaacttttaaactgaacttttcaaaggatcgtaaatgaaaattgataatttgattcatgttttaggatctttacataaaatattatcacatctacatgagataaagaaactgggatttaacatctcaaattcaattgaaactacatttaaatatcaatcaattactggtgatggttattacataatcgaatatacttatgaaaccgatccagacttctatcctcttacgttgagaatttatccaacaaatccgagaggaattcacgacatatcatcaatttcacttgatccagatggtgaaacgagtattgaatacaataatgattcaaaaccagaattttacattgatgatattaaaatgatgttcaacgatgaatatgttttccaacaaagtactgtgcatgatgttggaagtactaatggacaattttggaatacatgttattatcatatgattgaaatttgtaaattattaaaaggcgatgattaatgaaatacagcattgaagtacattacactacaggggacactgaaactgaagattcagttaccaatacattggatgttcaatgggaatcaaaggatgaggcagttgtagcattacagtctttgaaagagcattgggtattctttaagaaactcgatgatgcatatagtaacgaacgtgcgacaataatcgatgaagccaaacataaagaatggtttgatccaatgtcatgtgaattctctttctttgtaaaaattggagatgaaaaaattccagtacgtacaccgtggaacggctactttgaaactcttcataatgcacgagttgtcgctgttgataatcctgaacaaatcgatttcgattcattggactggaaaaaactatgacagtactgcaccaattgaagaaggttaagcatccagttgtatatgaggactggaaacgtcagaagctgatgggtgatttttatttcccaaaatctaaagtactagcaacgtcaaaagctatatacttgaaatataaggatgaagattgtttgtgtattcaaatgggattccatcctaaagttggtttgtttacaacaaatcaaacattttataaatttagaattcaaaaagatacatttagtattcatatcgaaaagcatgatgtacaagatacaatttatcgtgtggaaagtgagcctttgaatcttgttgagattccgtacaataatttagaagaaatgtactttcagcagttgacaatacaagaagactttggtatgataggacttcaagagttagagatgattaaacaaattcgtgatatctactttaaggagtaactatgccagtacgtaacagtacttcacgctttacgcttcaacagaaagcagatcttttgaatatggcaaacaaagattctaattttcactatctagtactcggtggttcagttgaaaagattgacctacgtgagtgtatgaaataacaaaaggggctaaaatgagtttacgtgaatcatgggaacaatttaaagaagagattggttatcgtggtgttaagattgaaccaatcaatcgtactgaaagcatcaaagctagtactaatggtactacctatgatcgttatgatgaaaagtatggtttacattctaaaccaaaggatactgagtaatggtgtatactaatatttttactggtattatgcgtaaatttattaatggtactggatacgtatctaatgacaacggtagtacatgggtaaaaaataatacgtctgaatctttagtaaaaagtcttccgtattataaagcttgacacatgaaaatggagtatgtataatactcctatattaattaaacgaggatatacgaaatggctggtgttgataaaatttgtgaattcagttcagattatgaaggttacgaaatgtacaagtccaagcgtaatcacatccaagtactgtcaaagtaccgtaaagaattcagaggccacaaagcaacattgtatgtttttgagaatggatattctgaagttttcacaagtggtgggtacagtacagctaacatggcacatatcaacccaaacccaactgaagatgattggaatagtggtaacgcttttcgtatttcaattttgaataaaatgaatcgttacgaccgttattgtacattctttgaaaatatttcagaatacaagcaagcattaaagaaatataatcaacgcttactaatgaattatgattacattcttcatgtgccaactgttccaggtcaggttaatggtctgtatacgaatagtacacatgatttaactgcggtgaagcgtcgcctcaaacgtatgttgggttgtcgtaatttaacaatcaaggttgtgcgtaatgaatcaatgtataactttttagatgtactacactacacattgaaggataataatggaaacgattaagtttatgtttgaggtgtttgttgcattcatcttatgtgctgtgtctattactattgctttaatcccagtaatcgtttaccaagttaatggtgggacagatccaacaattgatattttacttcgttgtttcgggttttttatatggttggcgatgtttatgtactacatgcatcttgaggattgattatgtcattagaaaaaataatcatttctgaattccgaaagtatatcatggattgtgatagagatgtacagcgtaagttcaatgagtaccttgacaaatatccgtatttgatgtttaatccgtttgaaactgatgatgatttatatcttggtttttacataggatttactcaacgaattcttcataaagatgaaatgaaacaatctgagatttgggtagaaactgactcatccgagtctaatgttttttatctttatacatattatgccgaaattgttagagatacgacacctgatggttgtctatttgtacaatcttctgatattgaaagaatatatatcgaacctgtatctttagatatggttgcacagcttccaactatccaacagttaggtgcagacgaattaacttattctgtatttgaatatctaggtagagatgatttgactcaagaaattgataaaatggtttctaaatatacttcatcacttatttcgaatggtaaacttaaattagaactaatttttgaagatactagtattaatccagtaagaggggttacaattggaaaagttaccatacgtgttgtttacgataatgaagtactaggatatatttcaaaacgtggacatgatttatgtataattagtacattcgttatttctcgtaaaaaatggaatgatttaatgcaaaaaatcgtggacggcagtaaaattcgtgatataatatgtaatgacatggtaattatgaatcctgatgttgactgtgatgtatattttccagttcctggatttacacgagaaaactttagtaaattgaaggatacgaaatgaaaattttagaagtcttgctagaaaaagatgcatctggtactctttatgttggtaatgagttcagtccagatccaattgatatgttacagagaatccaaacactgactcaaaacatctcggttaaaaaaccgtttcagaaagaattggaaatcttttgtgataaagatattgaacagcatgataatgtgatttcagatattaaaagtctattgacaaaaaatggttatgtagagtataatcctcctatcgtaatcgttattccagacttcatgaaaggaacaatctaatgactaaagacgaaatgaaatctcacttaagcgaactgaagaaagaacgtaaactagtacgtttagactgggatatccttaacaggaaagatgagcaatcatatgctaactggagttctgataaagtacgaaatgaccgttctaaagaagatgcaaagcaattcatggcattatcgaagcgactatcatctttgaacagtgaaattactggccttcagaaagagatcatttccattcttaaagcggagattgaatcactctatgaataaacatgaagtaattcattttgatgataagatctatattccaaatattgatagtactgaaacatattacctaatcaataagattatggctgaaacaaatacgtgttgtcgtcaacagccaggaaaatatgagttcagtcagactattggttattaccgatatgatatgttagaatcatttacaattgataagtctaaagttattgacattcttgtacagaatggatataatgaacaacgtgtaaatgatacagatttaccagtttcaaaaattgttctttctaataattaaaaattggacaagaacagatattgtgatataatgtttgttatcggcagatattaaaatgcaaaccattcctcaatgatgagggtttttcataaaaaagaaataaaagggtattaaaatggctaaagaaactaacgcacaagtactagatatcaccgacttcgaccgcactgtgaactacattcaattccagattcatcaagcagaagaagctctagcagtattccacggtactggtgcaaggccaatccgttttgctcacttgattgcatggaagaaaagtcttcaagaagaactatctgaactgcgtaaagcaaatcgtaagtaatttatcttaccgcctcatcatttttgatggggcattttaatcatataaagtaagaggatttataaatgagtgttgaatattggtttttgtttgtgtgtattggtacacttgcattaatcaccattggattgattttcaataccatgattagtggaagtaagtactttaagacattccaacttttaatgtctgctatgccatatagtgctgatgccgaaaaaacaatttctctaattttagataagttcgatgcaaatcttttggtggctaaaatttcagcatgtgatacaaatatttcattctactcggtagacacggatctagatggaattgatacacaatactcaaatccagtagttgctgaaattttcattggttcaaaatattatgcctatggatatgtaagaaaatattattcagaagcaaaagctgagttgacgaagaagcgaccatcaataaaaactttaaaacgcatcattgcgttggaaaaatcacttcgtggtcaaacaagcgttaatgagccaccatcagtgattaaatccaaaaaaagtaatgttgtggagttggagtaatggaaccagaaaaatcaagaaaaattcttattgatgtccaaactaaattactagatattatggaaatcatcaatgagttaccacagggttatcagtacaaagttcgtgaaatgttatcttgtgccgaaaccgttgtttctatgtacgatgatattcaacatggtattatccctgatattctcaaagatgacgtaaatattaacactgaggtaaaagaaactaaattagaatcagaaacagtatctaataaaaaagttctagaccttagtggtataaaaattaatatctaaaaaacatccaataggagaagtaatgagtaatcaaaaaatcgacttagtagtaaaacttcaagagattcaagcactagctaaagaccttgataacacacgtgcatcagtagttgattcactatgtgcaacaatcctgactgtttttacagattacgaaaagaaatctgattaaacgttactttgtaaatacccagtacttgactgggtatttttttaaggaaataaaatgactgaatcagaactacacgaaatgatagatttcatttatgaaatggtacaagataaaaataacatcaatacaattgcatcaggcccaagacaaattggtaaccaaataacatattctttgtccttatggttacacccgtgcattaaggttgattgtttgtatttccgtcctgatattgatgcttattattttgtcaatcatgatgcattaatgaaaccacataatcgtccagttgatgatacctttgtgacacacccattttacctggctgattccgaagaagatgagtttcaaaagaacacaacgttaagcccaggtgaaatttgcatcccttacgtacttaaagataaaatgaatcacatcacagaagttatgaaaacatgctggtagatgcaatgaaactctgatataatacaaataatgataataggaggatatatgaaatttattgattttgatatttctaaggccaaagaattatttgtaagaaatgaagtttatgatatcatgttacataacggcactgtacaagaagatgttgtgttgttttcgtttgatggtgaaaatctcgaaactatatataaattcagcaacttagatggtgacttttgggaaaccagtgctgttaaaatgtatagaattaaaaaggagcattaacatgccaattcgtggtgtaccagaaccattaatggaagttattaagcatgttcgcattggagatcgagaagttaatcttcgccgtaataacatttattactttaaaacttcagaaatgagttctgtacagattgtcattggtacatctattaagattactcgtgtacttgatggtagtactgatttcgttgaatataatgtacttactaacaaagtaatacacacatataaatggagtgggtataaaactattaagtatgagtttgatgttgctagaactgaagaagaacgatttatgttaagtactatcaatccagcaaactaccctgaccttgatacatttttgctaattttaaaactgtataatgaagcaaatgggaaagcgaaggagtatgatagaattatgtatgaacgcaaaaaagaacgtgctcagaaaagttatgatctttatgataacccatatgtaaaatataataaggggagaaaatgaataacgaagttcaaattatcataactccacctatacaaagtcttgatgtatctattagtgattttttagaaaaatattatgaatggtttaataatgataataccatttataatcattcattaccagatggtttcgtggagcttatcgaattaaattcaaaatcactatacttctgtgttgaatacaatgattatatgacagatgaagcttatcgctttcgttgtacattgtatccgaattatttttcaataggttataaagattaccagtactgtaccactaactatagtgttgaggaagaatttcagtacaatttactttatcctgatttagattatacgattgcagtactgttgactaaaatcatggatttttataaagataaatataatgcagcctaagacatttgatgagtggtttaatctacactataatataaatgcagcagatatatactattttaagcttgaattgtatatatcattgcgtaacccaattgagtactataacaacattatcaattgtgatgattttggtacatattttagtatagccgttatggatattaagagatgacacatgaagaatggatggcaatgatgaaaaaacgttatgaccagtttggaaatggatttattgatggtcatttcgatattttacgagacaaatataagttcgaatcatatgtactagatgagaatggaaatcgttggttcatctatgagcttgcggttagagacaaaaaaatataataaccttttccattgtccattgcaatgctttctttacagaagaataaatgaaacacttaattgaactggatacataaaatgacacatgaagaatggatagagtcactaaaatataaacatgatcattttggatttggtatacgccaaggccattatgatgttttgaacgataaaaaaacgttcgaatcattggttttggacgaagattccaaccactggttcatctacgagcttgctattagagataaaaaatagtaagataaatataatagttattacggtgcaggtaaagtgttgatggcggcatacagtacttccgattctgggggtggggttcaaatccccatacctgctcaaaaatataataaaggtgatttaatatgaaagtcattatcaatccagcaggaaacttttttggtgaggttttcggtgcagactgtgttgtgcaaaattttccacgaattgaaattgacggaattgatgttcaacaatatggaaacctgtactatgtagttgataagactggttctattgttcatgacagtgctttctttacaaaagaagagatgcagcacttaattgtactggatacataaaatgacacacgaagaatggatgtccaaacagcataaagaacatgactgctttgggaatggcattcgtcaggtacattatgatatattaagagatgaaaatcttttcaggtcatatgttttggataccagaaaaccctggtttatatgcgaactggcatttagaaagtcaaataatcaaaactaaacaaggaatacaaaaaatggaaacaactttatttgaagttattcaatcattaaaacctgaagatgaggttcaagtactactacatggttatcgtgtaaaaggtactgtggttttagtcaatgatacaacattggttattacagaaacaaacccatatgatagtaatcaacttgccaatatccatatcgatatcactggaattattggtgtcggtgtatctaaagcacttgcataaatcattaattcattatataatgggacataacataaagatgtgatataattattagtactggtgaagtggcagagcggtttaatgcacttgtcttgaaaacaagcgagggtgaaagtcctccgtgagttcaaatctcaccttcaccgccaaatacggggtatagcacaattggatagtgcaagagaattctaatctctaggttgggggttcaagtccctctacctcggccaattttaattaaaggttaaaaaccatgacgcatgaagaatggatgaatgacattaattttagatattcgggtatcggtagttggagaaaatatcattgggaaatcatatcagacccagcagaatacgataaacttatgaatcatgaagtgtatccgtggttctttattgaaataatggtacgattatgacacatgaagaatggatgaatgacattaattttagatattcgggtatcggtagatggctaaagtatcattgggaattcatttcagagccacatctgtatgataaacttatcaacgatccagcatatgaaatgtacttaattgaactactggtacgattatgacacatgaagagtggatgaaacgccaaaaattaaagtggaatccttattatctaccattagattctagaatgtgggatgttatacgtgttaagtgtatgtacaaagcatatttaagtactgaactcgacgaagaagtactgatgcatatcgtgcaccgatgataaaaaaagcttgactaaatagttcagtactgtataatgtttgtatcttaacttatatggcaacttgatatgtttagtgaatatgaagaagcaataaaacgcaaccttgaagattacaacttccaattttatatttgggatgaactgatgagattgtgtttacagtggatggaaaatgaagaaactcctgaccaacgaactgttatattaaacattttgttacataaagatcttagttcaattaatgttgaagtttctacttatgtagaagaagattataatccctatatttcatatacttcacctgtaccaaagacagaagaagaatattttcaaatgagtactgtacaagaaccattgtttacttatgagttctataagtacttggttggtgaattcaaaaaaatgcgaattaattcttgactaaataattcagtaccaaggagattaatatgtttaaagatgaacgtccagatttgtaaaaagtacttgactaaatagttcagtactgatataatgaattccacaatcagacgtatatggtgtaagttacgtcgatgcaatccagaacaagatctctggtactctaggaagtggtgaatgttaacctagacgggtttgataattggacgataggcaattattacttgactagcaggtttaaactagaggtgatagtccttcaccaaactggaaaaccggatggacttttatttaaaagggtaaggcgtggaaatatgtttacagaagttgcttttagtagcctgtacgccccacgtcaaggtagccgaaaggcaagttaaaacgggtggttataaagctgaattaacagcggcgtttaaaagcgtcaccatccatttttttttaattaaagttggtgatatgagtgttaaagacatttcaaaatatgaagagtttcttaaatcatttctaaattccaaattaacatctaaagcttctaaaaattggagtgaggataacccagaaatctgtgtttttaatgagaacgatgaatcgtttattattaatgataacgaaattgtttttgaatcattagaagaaaataaagaaataaaaaaactaaaatatcctacgttacgagatatagtaaatagtttaagtactgaatacattactttcaagctatgtgctgatgaagcagatgaattccagaaacgaacagtatatgaaaatgtgtttccgcatgaattaaattctgtgatatttaaagtgttggagaaggttttttccgaaaatagtactggacaatagttttcagtactgatataataaacaaatacggaagggtggcagagcggttgattgcactcgcctactaagcgagcaagtgttagaaataacgcttcgtgggttcaaatcccacctctttcgcaaatttcgggcctgtagctcagtggtagagcagtcggctcataaccgattggtcgcaggatcgttccctgccaggcccaccaaatattgcactcttctcttgtaaggagaatgacaaaaaactacccgaaaggtagaaagcttgaattaacaaggtgcaactaaaatacagaggttcgttggcctattggttgggcagcaaactgttaatttgccttagactagttcaattctagtacgaaccgccaaatataattcacatgatatagggtacacatggcatatttcttgattcaaagcgatgcagatgatgaattaatcgctaaaactaaaattgatattgatgattaccgaacagtactggatgctattcattactatgatgttcgtcacaaaggtaatcgtgaagaaattaagaactggattgaatcgggtgagtacaaggttgaatctttatccatttcaggtgatgaatctgaagaagatggttttattactgaaactatgtacttaactattgaaaatcatttctaggaatttaaatgaaagccaaagacctaattaaaattttacagaataatccagaagcagatattcttattcatgcttcgccttatgatgactatgcgattggtaattgcgaaactgctcattcatatcaagcgggtgacactaatgttgaagaatctggcgaagatttttcggattcatttgatgaagatggaaaactcttagtaccagtcatcattctctcttaaaataaatgtagacggtcgtattcagtactgaatcactaggggaggttgtaattcccgaatcagtagcttaaaagcagacccgtatgtgcctacacattacaactagtgcacatttaaaacctagacgtaggatgtaagtattcagtactgaatagctgaaggacttattatggtacaatacagtgagaggtacttcgagtatgctcagttcacctttagctaaaatggtcactgtaggatattgttgcaacagtatccagtactacttttaattgacataacatcatttgggtgtataatgaagcgtaaacagaatcttagtaagaaaatacaaccgacaatgacgaaagaacagttgtcaacatttatcaacgcagcattagataaaggtaagagtaaaaatgaaagtaagtaaagagactgccaaacagcttgaagtactttgtagtgctgcacctatgccgacacttggcttaatcaagttgatgcgtcgaaataagcaaaattcaaaataataaataatacagtaagatgacctcccctccatatcatgagagtatagagaattgttggttatcttacttctcaattagccgacttagctcagtaggtagagcaatccccttgtaagggaaaggtcaccagttcgattccggtagtcggcacaaaataaaggtacactatgaaatacaacattgttaaaatggtgaactatgtattaaaaaacaacgcatggtcactgcatgatgtacaattagaagatattggtgaagttagagtattttgctatgatccagatttgaatcaaaccacagatttgagtaaatgttttaatatttttcttggttatgaattcaataatcatttttattcatttgatgtgtattttgaaaaagttatattcagaagttatgaatgtgataatgaagattatgattatgatgatgaatcaattgaattgaatgttaacgatattgatactgaagaaaaattcttccagtactgcctccttaacgacatattaggattaacatttgaggacattaaagctatacttaaagttcaaaagttgattccagaagaggtactaaatccattaaatgactagtctaatagtacgtataatgcaagatgtttgtaataacctttatacaggcaattttgacgatccgaacataaaaatattatgttatgatggttttacaatggtacatccatcctattcaaataatatctacgtagcatatacaggtgaaaatctattatatcaatttgatatatatagtacaatgacaaagataattttggatgcctctaaaccagcaatctttattgcttctcatgattaccattacactgaagaatcactatttcagtactcaatgattaatgacattggtgggttgacattggatgaggttaatgctatactagctgtctcacgtttggttaaaacccacaattaggagattcatatgttctggaatttattatgcttgtttggtcgtacattggttcttgctattattcatacacctggtattcgtaattatgtttcttatgaatttaagaaaaattatcacaacaatactgaagttcgtacaactaagatgtgcaaagacttcaaggtagatgttccaccattcaagaagtacgaggatgaataatggaattcattgttgcacctgatgaacttaaaacattcacgttcagagataataacaattatccttatacaaatcattcattgaattcattacatgttattgcaatcattgcatctgaatacagggataatccatgtattgattttaaaaccactgatggcgaatatacatgggtgttcccaaaagataaatatagttatcaaggggcagtagaaattcgtgactcgattctaaaacaaatcgaagatggaaatactcatcctaaactaaacactcagtactgaaatcgtttaacccgatagcttctagtcagtactgattcctccttatgtatagaagctatcacttttttacgtataatgatattaccctcaaattcattatattcgttaccctctaacagtatctttttattcctcttggatgctgtaatttagaagttgactttttaacttctactgtgttatacttaaggctgattcgatgaatcggccttttttcttatataggtgaatgcaatgagttatttgtttactttaattgataagtatgttgacattgtataccgtcaagtttgtagtgatacgtttgaaacaaaaaacccaattagagatggcatttttgatgttgtcgttggatcatttttgaatggatacacagagacattatacaacagtaataatatttttaagacatacatcagactatgctgttagcattgatatttgggaaaataatatagaaatagatataacggaacatactaacattcatgttgatgatacatttaatcaattaactgaagaaatgtacttgcagttgaattttgtacatgatcttacaaatatcagttatgatacattaaggaaaatatgttttcttagtggggtgatccgtagtaatatgagtaaggataggaagtgaaatgttaaaaattccacctaagtcgttaacacatcttattgaatgtggtgtaatattttccgaaggtgatacctcatcatacacattggtcgatgaaccttataatttttcataccaatcttataaaaataattctaaaatttcttgtagatatgctgaaaacatattaatagatgtttcgttacataatgttccgaaattttacattgatatctttggtgattctttgacaattcgaacatatgattattttattaataaagacctcttgagtcttccaattgaacatgatactatagattcagagatgttctttcaactatcaacagtttacgatttacagggtttaactgttgagcagttgaatggaatatttgagatttcacgaaacatacgaagcaggaataaaaatgtctaatattttaaatgaaaaaacagttgatgttgttattggtgttcttaacaccgcaacttcatttcagaagaaacacagtgttgtatactttggtgaagattgttggctgaactatactaataattcgtttataattcgtgtagaggctgatgatattggattaaccgttcaggtaggatgtgccaaaactgacaaacaaatcactgtcattgttgataaacttacgtcttctttttatgatagtatagatgattgtgaacactatagttcaacattttatgatacagaagaagaacattttatggaaagtactgttcaagagttagctattccatataagctaatgaaagccgtgagtgatttaattttaaaatataaaaaaataggagttactaatgcaatttaatggtaaagtttccaaagtaggtttggtttttgaaaactgtgaatttgttgatattgatgtaaagaatgttttatggatgcatattgctgatgagaagactctttgtagccgtttttcaaacggactgacaattagtactgttatcggtgagttcggtattgcattacgcagcaatacaccatcggatttcatggacaactctacactgttagaccgtttaaaaatgcgtgacgttacacacgtttatctatatgatactaacggtgttgaacagcgttatgtagttgaatgggctaattataaccttagtgatcaatattcagtaaaccagcgtgttcaaatcacccctggtggtaatattgtgtttgttagttcaactggtaaattaatcagtgtagatgataaaaatattgatctattcactgcatataactaacaagagcttttatgaaaacaatcaaagtgcatttcaaagacacatggacagaagtgagtactggtaatattcaggatattttatatagtactgaaactattcatgtttatgatgaagatactgctgccgagcagttaaaagttttgcatcgtagtgttggtgagcacactgaatatggcattaaacatactcgtgaattacttaatactaatcacattgaaacccgtaaagcaaacttatcaaaagaagaaatgttcgatttcatcctgaaccataaagttcatattgagcctgatgggtctatatgggagaacactgctggacaaaaagtgctgaaaaaatatcatgtttcaattgataatgtaaaaatgtcagggtatgatttggaagatgcaattaatgaatatgtatctaggcagagggcaaattgatgagcttgataacatttacaattatttgttgcattactattgtactttgtcgcctgattcatgtatactcatatcataaagcgttgcgaatcgaacaagagatttacaacgaaaaccgagaaccagaaccagtcaagaagccaccatcaccttatgggttgaaacgtgagatgcattctcaaagtaaaaagtggggttatgcaattactaaaaatggctacatctatactgcaagtaatggttattttcaaattcaccacgaattagaagtggcagttcaaattttgtgggagatggaggacattggtggttatgagcgtactaagtttgaattcatatcaaatgatccaggaacttcacgagaaacatgatataattgttgatgtggagaagaaggaagtcgttatgaaaaagcaagcatatagaattttagaagacttccatctaaaagcatttataatgaagttctgtacagatgaacatcttaccggacgagtaatacgtaaggagttgtaaatgaacttaagttcaacaattcagtacttgagcagtaacttcgagaaaattatttctcgcggtgggatgattgtacacccagaaacagaggaaatgtacatcattggatttgataaaaattcttatgatcaagtacttgtaatttccaagttagaaagttataatgaagttgttcagttttgctgtaccgaatttggtatctatattaaagacgctgaaactaatacaatttcgcattatttttaccacacactgatgggtactaaagacttcggattgaagttcgatgatttagtacaatgtcactatatgtttaaaaccttcccagctagtgggcattaaggagtatatcaatatgagcaacattttcttcaaaactatttctttcaaaaaagcatcttactcctacgcctacgttgatggtaaagtgcttaatattgtactggatggtgttgacgtaccagttgaatttaaaacacatgaagaagcagttgaaggtgctaaagaattgaattcaattcttaatggtgaagtaagtcaaaaacaacatgtaaaatctgatttagatgtacttttggaaaaaatcaaaactggtgaagtattagaaattttagacaactgtaatgaaaaacttcgtaatgtagttaataatgttcgtgaccagattcaagaaaaagcactagagcaagcattcaaacatgtatccaagaatgctgaatctcgtattgacggtatggttaaaaatcttgatgatgtactatctcatctctttactaaagaatacgaacaagaagttgaagaagaaccagtaaaagaaactaaaaaagaaaaacgtagctttggctcaggtgatgatgtgtttggttttacgaatgtccgaacaagtgcagatgaaccaaaagaaattagtgagatgctcattggtgacatgacaactaagcagcttcgtaatgaaattgacaagtttgtaactagttgtatcaaatcagaacgtgcacaaagtatgtttaaaagcattagtgagaattttggtccagaagcaactgagcaggcactaactgcatttaaagaattgatttataatgtagccattagcaatccagataaaacacttgaagaagttctacgtgacaatttcaaataattagataaaattaaagccactacaatgtagtggcttttttttattatgcgttgtaaccaactattacgactgagcagtcaagcggttctactactttaagaattacattatcatcttcatccacttgtatttcactatgaactacatgattgtctgaagaatataattgaacttgtggtagtgctttaccatgttcagttactggaactgagatagagtacatagagtcttcaccgagaacccactcacttaaagtatattctttatggaaaggagtagtatgcagtgtttttccgattatactcaaagaaacaggtaaattatcagtttgatacacagtaatattaccttctgcgtctacagaaagatctacaccaacttgatataagtcaccactgtatgcttgaagtgctaagtactgtccacgatcatgaacatcaaatggaacaaccgcagaaaatacaccttccgaaacaggttcaaattgggatagaagaactgatgtaacaaaatcaatatcctcaccactttcaagaacatcaaattccaccactttagtgttataatatggagaagtgagtgtagcagtacctttccctgattgtgtgataacatcaactggaattgtaaatgcatcattaacaaattgggtagtaaagtattctgtcccgtctggtaatacgattgttattaccataccgttagtatcaatttctgaaccagtgttgaataatttaccactaattgagtcattaccaacaaatactggtgaaatgagaatattatctatatcacgatctataataccacattcaggtgtatacatatgatacaaggtttgtgaactacctaaaattgttttatgtagcatgaatttatatacaaatccagtatcagtttcttgtggctcttcagaatatccacgaacaaagaaacaatttttattaatttcacttaatagttggtcattagttttattgtaatttaatagataacctttattatctttagttgttatttgtactttacgatatattatattagttcttggatcaactaaatcatataatctatggcttctttggcgatagattctaatattttttagtctagttccatcattgaggattgcaccatcaacaacataaccacattcaccaaacttatagcgtccagccgcagcaattgaccttgacatttatccctccattggtataattattataacgtatttattatgcatatccaaaaaatgagcttgactggtgtatgatttggtgttatcatgtagtgaatgaataatgaggtgtttttatgaatgttattgataatagattagtactgaaaaatggaaaaatgactgttaagttatataaagatgaagctgattcctttatggcaaaagcgattgaaaaatcagaaagatataaacttttggctccagcaagtaaatcgccatatggttttaatcatgcacatagtcattttgttggtatggtgtgtgagcacgcatctttagtactttttaatgaaattgaaaacaatactggtattaaacttaatatcgatccagcattccaaaatgaagcacgtgacggtgaatgtgatattaaggtaaacaaccttcgtattgaagtaaaaggtatcaagtataaatcatggactgactttggaccatgtgttagtactcgacagttaaaaaatatccagaaaaaagctgacgtaatactatgggtattgtataatgagaaaaaacaagagttcacgtttgagggattcaactatgtaaaagatattagttctatcccagttatcctcactggtgtaccagggcgaccaatgattgaaaatcacccagtactcggtattatgaaaccactacaggagttaccattgtgattactgcaactgtatatcaagatatcaatgaagaatttcattctaaaattgcgttcttatcatttcctgtactcccagcagttgggtcaacgttgaatcttaccatttgtggttttgagaaatattataaagtactagatattgagtactgtgctgatgtatattcatgtaatagtgaaattgcaattccagtatcaatcgatattattgtaaaagaggtttgattatgtttaagaattttatggttatcgtagcagtactgtttggtacatcatgtttcatttccccagtacacgcagaagaacaacgtcaaactattaaaactattgggactggtaaaactccccctaaacgtactgctgaagaatacatgcctgaaatgcgtgaacgttatcgtcagacatacagggaaaaacatgctaatgataaacccatcaagaagcataaatgggaagttgttaaatctccttcattttgtgctggatatgctaaagtaaagattgagcagcacaaaaaacagtactataaagatatgtattccttctatgactccagaatttctgacacagatatgatggcagggaaggttgataaagaagaatttctacaaggctatgatatgatggacgatgacaaaatcatggaatgcgttgaagtgtatgaaaaatacagaggcttctgatgttaacaatagtgttgttggttagtccatttgtgtattttgtgctgtataatatttttagtaatgctaatcattttaaatatgcacaaacaattgcaaagcatgaaggtttttggaattttttcccagcattactatgctcatatctataccatgaacgctatttcatttttcctgaatataaaaattatggttatgattctaaagtaaatggtataattgagtactgtataagaaattatcttaataataatgataacgtccaagtaagaataggaaatggtaatatatcaagaatagttttcatacctgatatacaagacccaatatacttatatccatatgattatagtattagtgtaggttgttcgatacatggtagtaaatctatgtacgattactttatcttaccaccaacacaaattagattaatagaaaaatacttgagggaaaagtttgacaacaaagattcttagtattataattaacacaccaagtaacccaagggggatggaaaatggatatattagctacaaatttcaaacgtaacacagaagagcgtgaaggttatttgagtattagtgaagttgtcgatgacaattttaaacaatacatttttaatagtgcaattaaattaaaatgcacaaaagattcacctgatcgtagctttactaaatggattgcgtattgggaagattcaccagttgcaattgaaatgactgtgattacaacagtacttgaaactggttacatcaaagccattatagttgataagaaagtccgtactcttgatgaaattaatccatatccagcccgaaattctaaagtttttggtgtattggttgatggtaaatttatgatagaaaaagatgcaaaggaatatgtaattaataaacttcaaactacagcagaaaaaaaagaagtagtggatcaaaactcagttgatgcaatcaaaaaagcatggggactaaagtgatatgttcacactaagtaatgcaaaatatctttttcttattggtattattggttgggttatggctccagtgctaaatgcactggggttttccgatgaacataaacttgtaaatgtttcaggtttaattcagggtatttcatggtatacattaattacattttcagtgtgcatcaatacatttgcccgtgattatcgacgtttgttatatctgaaagtatttggaactacacgatatagttttgtttacactttcattttattaccgtgcatgttatatgcatttgtatttgattactatacatatctatgggtatgtggaactatgtttgttatgttggaatacatcagaactgttcaaaactcatatgccgatgagtttcatgatctagaagttaaacgaaaattaacggagctaaacaaatgagaggctataataagatttgtatttttgtatttttagtttgtgcattcaattcgtttggttactactgtacagaaaataatatttcatatggtttaaatcctttgtggtttacaatttccaatgtagcacaaattggtattgctcttatgtctgcacttatgttctgttcaattgtcactatggatacggatcatgaaaggcttgtatttctccgtgatactggagacgaaccttacagtagattgattgtgttgtatccatttattgttattttaggtactaacatccaacttgggtcattatctaatagtgttacatcagcagctattgttatatttgcattcacattttttatggtacacaaatcagtacttaattggtatatcacaaaaatggcagaagaaggtactaaaaatacttgacataatttagtatgttatatataattattttgttaaaaacaaattagagtaaggaacttatgaacatcgataaggtcaaagaacttagtgctgcactaattaagaatgaagaagtttgtgaagaacttcgcagtactatcaaagttgagtacgcacgactccaaggtatgcttcaagaatcagaatgggtagtaactaaatctatcgaagcaatctataaggatatcgaatcccttttcaacaagaaaagtaagattgaatctgattcatataacaaacgtaaagagttatctactgcacttggtatctaaaagtatttgacataacaaataatatggagtacaatgtgctcctaatttaattatcagctagaaaggaaaacattatgaaatctattctcgttgcagttaacctagttgcttccccatctttcaacttcaaacaagtggttgctgataatctgaagaagatctgtccaaacgctgaattaactttctgtgtgtttgattcagaaaaagtaactaaagttgatctaaactatcttttgaacgaagtaaaaagcgtttctggtgaaagtaacttaaaagttcttcatgatattgctgatgattatgatgatacacttgtaatttcggagaaattctaaataaaatgtttagatttcttcagtacttaatcattaaattttttggctattatacgattgaaggcaaagctacactcgcacatagaatctttgtagcattatgtacgggtgattatgacgtattgaataagtactgtaaatctaaagcatgtattgatataatggcacttcgtatctatgagtgccgttccaatagatacaatttttaccaatacagatttgatgaaaaagaatttgatagcatcaaaatgcttaagaatttatgtaacaataaaaagaatatgcatatatcagaatttgttgctttgtatttttatttaaaaagttcattgtatatgaacacaatgcaaagattcgatactagaattaatgtattcaccgataaagaattttatatatacgataaattcttagataaggtttaatatgacaactgtttatattgataaacgattaaatttattgattaccgattctagagttacgtcaactataccacgaaacttatttggttttttcccactaagaccaaaatatcaatatggagttgttaatcaaaaaactttatatgtacatgaccgtttattcagtgctagtggggtagtaagtgaaattgataaagtactggattggttaattaataaagtaccagttatacctgacagaaagttaagttgccattgtgtgcttctttctaaagattatgttattcatatgattttaactaaaggaaagtttattaaaaaacttgaatatctacatgaagactacactttctttatgggaagtggtggagaatacatggtagatgctgctattcatgaagaacatacaactttatatgataaagtgtttagtactttcatggatgtgcataaccatgattgcttcacagatgataatattaatgtatatcgattttgatttcgtcattaggagatgtaagtgaaaaagcttgatttaaatacaattgccgaagaagttctggatgaatgttttgctaatgaagaagtcaacacactagaagccttagatttcgttgaagataaagatgaaaatgaaggtaaagtacaaagcagtttcaaatataatattacacttaagcgaccaccaaatgtttccaatgaagatctaattcgtgatattcaagctggtatcaatgtaaagaaaaacactgaactgttagttcgttacaattatggactgattattgatgtagcaagtaaatgtacttgttatatcccatttgaagataagatttcatatggtgttgaggggttcatgagagcactaaaaacctttgatcttaataagaatgttaagttcattacctatgcttcttctagtatttacatgacagtctataacgaaagttctgacgctaactatatggtacacttcccacgttatatgagtgttcataagatcaaagtaaaaagattctgccaggaatatatgcgtaaacatggtgttcgcccaacacctgaaataatctcagagggtactgggattgagattcagcatgttaataattgtttattatttcaaagcgaatacacttcactggatgcaccattagacggtgttacagatggtacattaggtgacattattcattcacctgcttctgattttaacctcaatgttgatagtatccgtgcacctttacgttatgctatcaatgaactgactaacgaattgagtactaaagaacgtgagattatccagcgtgttcatggtctaggtgaatatgaacctgaaacgcttcgtgagattgctgataatggttttgttgatgataatggaaaatatgttaaatcccgttcatcaatacaccgaaagtacagtgaagctatgcaaaagcttaagaagttagtacttgcaaaagggtacgaatacgaagatttctaaagaacaagggttggcttatgccaaccttttttttatgggatgaagtaaaagtttgtgatataattatcttgtacaattctgttggcatgatattcatgtacctgatccactcgaaaacgtagagggcagttgagcagtccgacagtgcgaacagcaaaagaaacccgttagatgtgggcatagtttgaacccctcacggcaatgcggctgtataaagaaccacgttaggatagctggtggttccttgatagacatataaggataacaccttacgaattatctaagggagagttatcgaattttgtacaggaaagttgcgtccaaaatttgagtactcacattaagtatttgattgcatagatacttaatgaagatacactatgtttaaaagtgtagaccgtcatatgaaactgaagtagagagaaacaggatgacccgctttcgcactcgttatgagtaatcttcaatgcaatagctctgataccatcagcgtcaaatttccctccttgtggggggggaagaaaaatcccttcctcaaatcccgtcaatattaaaagtccttgacagttattaatcattcgcgtagaatacgtagtattagaagcgaacagacatctcgaagagatggatgattaaccattaaggaatatcaaatgaattcagtaatctttttagtagtcgctttctctgttaattccggtgtacaaataaccccaatgaattccatgaatcaatgcatagcagtacgtgatagtacatacgaacaagtaaacaaagatatttggattacagttagtaaagaacaaatgtggtgttacaatagtaatactaacacaaagcttattgtaggacaaactcaatgagttatggcgttcgttttgagattcgttctattgtcatcaatgcagagaaacaagtatcgttggatggtgatatacgtgaaatttatctatcatgtatccgtgcgaaatctgaagcagatgccttagtacaaatgtatagttttaacttttcaaatggattctatttggtacgagttattgaagtgaaaaaagtacttattggttgtagcatagaaggattaatgtaaaatgagcactatagatgaactgattcgacggaattcaaaatattaccaaccatcagaaattgtaggtaacattaccaaatcagagtttggtccaaatactcgaaaactcattcatgtaatgtcacgtgatggctttaaatgtgattgttgcggtgaatctaatgtagtattcactttacacaagcacagtactaaagatcgttataaattcagaccttatgtacttaaagggaaacgccttgtacgcatgacgttagaccataatgtactggactgtcttcagggcggtaatgataaagagaacatgactgcactgtgtgaagattgtaacgcattacgccagcataagtttgctgaatacagtgagtttaaacactggtatcataacgcggatcgttcaatcgagcctgacgttaactactgcttcattgagtacattaagaatgccaaagatacatacattcttaaatcaatgtcacctattaccgtgtttcctgagaacctattcactacattaaagaatagttttattgtaggtgatattgatgcattcaagtattttgacaaaggtgcaaaacattttgaaattcaatgtcttagtactgcactatgtgaactcattaaaatttacataaaagagtatttgggtattgacaatgtacgtgtaccagagtatactttttctattgaattcgattgtgaatcaatcaaagagtttggaattcttttcaataaacaaatagaacttgcaattcaaaacgaaatcaagtactatactactaacatttaatcagaggaaattatcatgcaaattatcattcttatcgttggcatcatgctgggtgtttacggtcactcctggatgaacgagaagtttcctaatacgcgtcctgagtattgcagttctaatgtattccagaatggtgagaaaccaaaggaaagcattggtaaaaagctggataaagtacttgatgtgatcaatgaataagggccataaaatgtttaaaccgaattccaatgttggtaagaaagttcaattacttgaagatgtatccaccatgagtggaattttcccaagaggtcacatcatgactattattgccgaaacatcccgtgggtgggatttggaagatgctgatggtaatcgcatccttgaggctggattctatggtcatcgtgaatataaaatcgttgattaaggatacaacatgactttagagattgtctttggtattgttagcttagtcgtctgtgtgggttggtttgggtatctgatgatttttagtgattaatacttgacataagatatcagtactgtataatgtttatatcaaacgaaatccactttaacaaatgataggaaatattatgtctttttctaaagaagaacgtgaccttattaaaaaagcaatttggttttatgctaatgaagggaagtgcgatgaagaaaaagcacgtgaactgtgtaatatccttgagaagaaacaagaactgaaagtgtttcgtatccgtgatttggatgaaggggatcgtattgtcctagctgaaacaaaagaagaagcagaacaaatcttcactgataaaaacgaaaatccacattggatggaagaagtctgtgatgttaaaaaaggtacttatatcgattgacagtactgaataatagcagtataatgtttatatcaaagggaatgcagtgaaaggaaagacagcataatcgtactcgtcactgcgttcccgcccttttaaattaaatgaggaattaactatgtttcaaactaacactcaaggttttgtaatcatcgatttgaatcaaaacagcggttattggatgaaacctactgacgcatgtatgcagtttgattttttaggttacaggattagtgtaagtactggtgcttctgtactgagaggtggttgtatcgttgaacatctggtaactgatccagaaggtcgtgagtatgaaatcgcaggttcagtacaagatgccattatgtttgtatgtcagcgtgaaatgaatggttcgaattcaaatgcactgactcatgctctttctcaagaagtggaggttcgttaatgaaatacattgtagcagtactcgtcgcatttctactcactgcatgtgatgcttctaccaaagaacgtacaagtgattttgttctacctgctgaattaaaagaagcagggtgtaagatttatcgtatgcaacaagatggtgctggtgcaactttatacactgtgtactgtcctaatgcaaatacaagtactggatacactagcggtaaaacacgaatcaacacttccgtaattcatggagaataacaatgagccttgatacaacacgtgcagcagatttattaactcgtctgaatgatgaagaatatcttgctgagataaagtacaagcttgacaaacttgttcgaagtgctgaagtaattgaagttgaaggtcacttaccgatggatcaataccataggttcaaggaagatatggtttattatcctaatgaaatttggattgagtggcaacattggactaacaaaactcttcgcattgaagggtattgtgtgaagtatgaaagttcacctggtgatgttacaaaaactctatcaatttggtgtacaaaaacaaatgaactcgttgaggtgaatttgaattatatgaatggattccgttggggtgatgttaaatgattaaaaaactcttgactggaatcattgtgtgcagtacaatgtttcttacagcatgtaatgatgacggcaggtttagtgcaaaagacttagttcgtcaggattgtacattcacaggtaagtcttttattaacgagtatgaaatatgtacacaatcaggtcgtatctgtggtggttgggaaaaacgtcaggagcgattgtatgtatatgaatgccctggacatctcaacaaagtactaagcacacacaaacttgtttatgataaggttgaataatgactaccaatgaaatgatgcaggttatttgggataaaggttgtgatattaaaatcactagtactgatgttcgtgtattcaaaactgaatatatggagtacttggaccttgatacttataataatattgtatcaattgaacacaaaggtgcagtactggaaaccattgacgtagtactcaagaaagctaccgacctattaggagtggcagtgtgaataacaaagagtgggaagattaccgcaagaagtgcagggagtttgataaagaacttactggtacagtgaatgcagtaatgtgggtatctgtaattattgcagttcttgcgttgggtgctattattattaataaattattctaaggcgaatatcatgtttactttatatctcgcagtagttctcaccaatggtgaaatcactcgtactattggtgaaggtgtatataaaacaccagaccagtgctactctgccactcattggcctcgcgatagtggggatgaaactcgcactgaattcaaatgcatgaaagtaaaaggtgattttgttaaccttaaggttatcgaggcgaaataatggatattaatgagttgttgaaattagtgtttaatcgtgaacgccgcgatacaagaccaattgaatatcaagatgtgatacgcattgaaactgatttctgttatggtaaaacaactcatgaccttttgaatctctctggaaaacgctatgctgatgtttgtttttcagagagaagtgatggttcagaaataacgagtactgatattgtttgttacgcacgcagtgctgataaatcttatgaaatagaacttatatattcccctagttctaaaacaaatcatcaccgccatattttatatgatgtttatacaccacctggtattgctgaatattttgttattgattatagtactgaagaaaatgtgtttcaacaaagtttgattcataactttgaggtgaatgatccattagtaccaaagttgttcaaactacttgacaccatagatgttgattttgaatttgttatgtgcattagaacttctttattcaatgaattcatggaactttttaatatatgaatagatactatgttgtgtatgaacacgtctctgaatttaataacatacgcgggttttccagagtagtcaccaagatggatgtattcattcgtgctcttagtgaagtagatgcactgtttaaattgtttgatgaaattacaaagtataacacacctaaaacacaccgctatgtggaaactgtacatagcattatgctaactgaaagtgatgaggaatgataaatgaatttatatctagttgaaggtttagtacaagtctataaaccagaaggtgaaggtcaacgtttttcacacgtagaagaatttaagtacgttgtacaggctgatggtcagtacgatgcggaaattcaagtagatgaatcattccgtaagaaaaatgaaattggtaaatttcaataccagaacttacaatataaagtatggcctagtataaatgactaagatgtggtggtgtcatggtgtatataacgtgtatgtaaatggtagatataaaatgtctagtacctatgcaagacgtgttaatgcgaacaaccaagttgatgctgcttgtgagatcattgagtggtatgctgagttcaatgcacctgactatatgtacgaaatagttacaataaatgttgtacaaatcgatacatctttgatacaataaccacatcaaaaaaattgcatctgaggatacttatgttagttaatcttaatttcatcacttcacctgactgggcattacgtggagtttctttaaacttcaaggaaactatgtttgactacattggtgagtgtacattggtaaatgcaacttttgatccaaatcatccgttttgggctgaaattcatgatccaaatgtaaacaacaatacatctgttatgactattgtccagactaaacatgcaggtatccttgcaggttatcgacctgcacatgcaattgaacacttcactgattacgatgtcgtggatgaatacccaatgatccatgaagatggaagtctatacacatctgaagacttccgtgctatctttaatagtactgatgatattctaccaagtggacgtccacgtcctgagtcttatcttatgcattcatcttatggtgtagcagatacgcttgaacagattatgaagaagtacaagaacctaattgaaggtccagaagaaattgtcttgtgctatcacccagtactgaagtctgaacaaccaaaggatggtggatggcgttggcataagaatggtgagtatatcggtactaaacgaagtaaagaacgttttgagtacttgtgtgatgagccagatgttgatgtggttttgtgttataattttattaaggtgaaaaagaaatgtatctagtactaagttttgttgttgcactattgtttatgttctatcctacactagtggcattagccactagacgaacgatggtagatctcactactgtattcttgctaaacgtggcattagtactggtgtctattatcattccagtgagctttacagttattgatattatttcggtattactcttcgtgttaagttatcttatgcttattgaagaaacaaatgttgacaaacgttcgtagtactgtataatggttcctgtagtctgaaacttaacacttaaacttgaggtaaaaaatatgctatcagtactaatttcaattccgtctttaattctgatttggcttctggtttacgaatgctttattactgatgataatgataaaaaagagttctctgagttgtttatgcttgattcgccgattgtgcgtattttctatacagtcgttgtggtttcagtaattgtatgggttttgagttttatcttcccactcggtgcagtagttaaaactttggatttagttgagaactttgttgcaattatgtggctaatcaaagcactatttgcaggaaatgttaaaatttggattgatattatcaaattcaagttcacgaataagatgtaacagtgaaaatatctctatagtattaaatacttctgtacatatatatagtacagaagtatttctcgttagaggtttgttatgaagagttatataaaattaatagcacttgtgtgtgcattattttcatgttttagttatggtgcagcagcagaaacatattgtcgtagtactaagggaacgtggcatgtattgactaacgaccctagaaatggtaaaaatatagttgttgatggtgtgatttatcgttttaaagtagaaagtattatcggtaataaaaaaatctcgacttatagagatgattctggtacattagcaaacgtaatattaattgtagacccaagaactggtaatggtgatatctatatagtaatttacttggactcatcggtacgccgtgacctagatatagataaattgaacttacactgtgaaatataggacttaaaaaaatggtaaacactattttacttttgttgttgaatattccaattattctgtcttttttaatttctatttttatggcaggatattgtttagttgcagtaattcatttcattttaacaaacaaatatgtcctaatttctaagcttgattctatttttgcttgcgattcgattgcttataacttgtggttaatttgttcttgcattatgggagtaactttccttctgtatgtatttgatgtccttgaccaaaagttcgtatacatcagtactggattggctctttatcctgctacgtggtacttgatttacgttggtgatatatggtatagtacttataaagaatatcagtacaagaaatcacttaacgttggaggaaaataatcatgaaaattattttattttttgtatgtatgttaatgtgtggattgtcatatgctgaaccattggaaggtttagtttgtacagatggtaatattaaacatatctatcaaggtgatagtgacgatcgagatattgtatatattgatggacaatcatatacgtttgttaaagagcatacagtaggcgacattagcttcactgagttttctaacgacacagaccctaacttcttagcgtttattgaagtagatgtatatgaagatagtaatggcacacaatatgctaaattagttatgatgcgtcgtggtgctaaagaaactagttttggtggcttgtgtaaatataaggattgatattatgttgatttatcaaagtgataatattcgtgttatgcagcatccctacttacaaatctttgatgtgcagcagtatatggaaggtgatgacccaagaacctatggtcgtaagtatgattacttcactgtaaagcagtgtaaaaatattaacgaagtacgacaattagttcaagaacttcaaaacaaaggttgacttcggtcagccttttttgttataattctcttaataaattagaggattttaattatgtatgtatatcgttttgaacttaaatttagttacattgaacctaacttagatcctgcacgaactgtaggtccgtttgcacggtattcaaccagatacagtactaaaaatggatttgaccgtttgcttatgactacaccttctcaattccaacctgaaccaactgaggatgggatctattcaatcaaaagtggatgggtatttggctgtcaaagtttgaaagatttgttcagattcttcactatggacttgggtaaattgcatcgtgctgggtttgctatatctgtatatgaagttccagaccaccatgtagacattggtcgtaatcaggttcagtactattgcggtagtgctaaattagttcgtatcatgtcagttaaggaagcaaaggatgagttccgacaaagtaaaagagaaacacatgaggtaatatatggataaaactcaaatagaattaaagaaatttgtttcattctatcttcctgatgatccacgtaattcacaaaaagatattgaatattataatatcctatctaaacagttaatgagaaagtttcaacagtgtttaactatattcaatacagatggaagacgtagataccgaatcgtttcaatgaatgatgaaaacgcaaatttctttgattacgatgtagtttttagagcatataatgatgatcgtataaaattaaattatgatcaaattatacttgacctgaatgttatatgtgttataatcactcacgtagccgaacttaatggttttaaagaatggtattgaatagaggataacatatgaagcttaaattacaatataatggatttactttacgtaatgatactgaatttattaatcgttctcctggtgctgaactgtttttacgagagatgaacattcctttcatcattactacagtgggcgaccgtgaagttctacaatatgcagagcatccgattattgatgttccttggtactctgagcatatgtacatggatatggcacgtcgctacaactgtaagttcgtagttgaaggtgataaaattacagtcgaatttaaataaggtaaattaaaaatgatcagtacttcagttaatgaaagcatcgtcgctgacgtagaaatggttaaagaatgtgcagatgaaactcttcgtgatatgtacattaatgatttaattactgaatacggtagtcgtggtgtacacgaatttattcgtttaagtggagagttgatgaaaaatcgaattcgtatgaagcttaacgtacatccaaaagcatgggcatttacattaaaatacgcagaagatattgttaatttgcgtcgatctgaagtatatgaacgtttgcacaatggtatgttagataaatgattgtaaaataggaattcttaaatgaattcctttttgtttataaggtatagtaatgaaatatatagtacttgtactgatattattcagtactgttgtaagtgctaaacaaaaagaatatgttaaatgtataaattatgaagagaaatatgttgaaacatataaaaaaagtataattaaaaacgtttcgattactaacagagcaacaatcattgtacttaaaaatgggttaattatgctatataaaccacacgttaaatgtgaaattattaattgaggaaattatgaatcgtaaaggtcgttttaaagtatcaaaaaagaacaaaagttctaggtttaaacctattgttttaacagttaaatctaacaaagatttaactgcacttagtaaaaagataatttcatctaagattgaagtatcatacgtaaattcattaaaatatatgaatgtcaaaccactggaccaactcatttcacttatatttgaacgtaatgattttgagatatcagtagatgattatagagcctataatgctggtttcattaatgttacttgtaataaaaaactaactgagttggaaaatttgtcatgtataataaatctagataaaggtgtagtgaagtaccattttgtacatttcactaatatcaataatggaatgggtgtacaatccagacctatagtgcctacgtgtgatgttactaaattagcaaagctcaatgatgaagaatattttcaagaaagcattgtaactgagcatttagatgatataatagctacttacaaagaatgcatatgggtgttgaatgctataaaacctaaattgtgtttaatgaatattgttcgtgatttatgaatggggaatcgtaatgagttgggtaaatgttaatagtattgaacttaacgaacaagatatttttgcatttgtaaatttaactaataacacagtactaaaagggcgtttgttcagtgctagtgatgggtacaaatggatctctttgatggatgatagtggtgtgatttataatgtaatgcaattaccccaatgggtatatagtaacactgctgacgatgttcttaccgcagttatgcgtgagtttgaaaaactcccaggtggtgatatcaaaaacaaagtttttaatgcagaacgtaaaaattatacagcacagcaattggaatcccttgccattgctgcttatcaagctgctattaagaagccagagtgcgttattcttaagtatgtaccagacttaaaacttacgttggaagacatggatgcatttatttttacatctgaacttggtcagtactaatttaactttgggacaaccattcttattatgatataatgttttatgtcattcgatataaatgacaacggaactataaatattatagtaaaatttatctcttataggagttataaaaatggttgataaatggaataagaaagatccatcacatgatgttgatatttctggtctagacaatgcacataagcacaagtatctagattcactaggtcttctaaaaccagaccaaagtcttgcacatgatcgtccatcccgtgaaaaagcatttagcctagaatcactaggtcatgagcttaatcgtgtgtttgaggatcacccaatctatgtacgtgatattatcgagaaacttaaagtaactcctaaagagcactttaaagcaactgtacactctgcattccgtgcattgcatgattctctcaagaaaactcacaatcttcgtaaaattcatgatgaaatcgtgaatgcaatcgaaagtgaaaaacataagttcaagaagtaataaaaagggttgactaaggtcagccctttgttgtatcataacttctcaatataactgaggtatcatatatgcaaggtttaaaatttgtagttgctgcactcatcgccgcagtactggttggtggtgtattctatgtagtggatcaaaaagtaaatccacctgcacaagaacaatctaagtaacaaaataaggttgacttcggtcagccttttctttatactataaatatagacatagagaaaaaaatgaaatctatggagagaaatcaaatgccaagtaattttactgataaaaatggtggtaacatggctggtcactctgataaatggagtgaacgcaaccgccgtccaaatagttatcaagcaggtcaaggttcacgtgggtcacgtaaccaaggaactggtctagctggtaaagcaaacgcagaagcaggtgaagttaagagtactgagaacatgactgagctagaaaagctacgttatgttaattcattgggacttcttaatgctacacaaaaacaacgcctagctgatatggaacgtgctgagaaagaacaagcagttcctaaagaagaaccaaaagcagaagtacctaaagctgctaaccctgttaaagagttatcagataacttaggtaagatctttgctaacaaaccacagttgattcagggtattgtcaaagcactacaggcagttcctaaagaagaactcaaaggtaaagcacaagctgtacttgatgtaatgaaaggtaataagagcactgaaccaactgaagtattcagtactatcatgcgtgcacttgaaggtacacacaaagaagattccaaagaacctgaacagggtgaagcaagtcttgatggtattcttaaaacttttgataatattggtaaagcggaccgtgctaatgcccagcaagtcaagaatgtactggctaaacttgaaaaccgtttagaaggtaaagacgataaggttaagctcgtatcagatgcagttaacagtgcacttaaatcttatgtacaaggtgagaaaagtcgcttcgtaacagctatggatgctgcattcaacactatgaaaaagtatgaagcagaacatggtgagaaggtaacaccagatggttatctaaagcgtgcagatgaagagggtgcagttgaacagaaagatgttgagcctgagcaagaagaactacctgataccgttgatatggatggatacattcatcgtcctgagatggaagagtttgggtcagataaagaaggttttgaacatgcaattgcagtatataaagcattagttaaaaatccagattatgctaaccgttttgttgacgagtttgatagtgcatggaataactacaaagagaaaggttatgacttccctgctgaagctgcattctttgaacttggtaaactattagctaaacatggaattgacgttggttcatctgattccgaaggtatggaagaagaacatcttgaaatgaccgataaatcaattcatgaacttcaaaagctaatgatgtggatatccgagattggcaaaaaagcaggtgctgatcgtaaaagtatcaacaaaaacattagttggattaaagataatgttggtaacaatgctcgtaaacttcaaaaggcgtgggctgatttagtaaatggtgcagatgatgttgacattgaatcaccagaagcatatgagtatgcactaactacacttgataactcattcaaagagtacgacagtggtgttggaaaggataaaaaataaacatttaaaaggttgacttcggtcagcctttttttgtaaatacaaaagaggaattaagaagagggattacaatgaaaaaatatattatatttggaattgtattattttccagtactgcttatggtgcagattatcattgctcagtagcaaggcaggatttcagaaatggggagttctatactacctcatacacaaaaggaataatacacgacaccgacagaactattggatttaatgcgtttgacaacaaagattcatatacttcaggtatactatctgagcgtaagactgatgtaatgggaatagaaaaagagttccggtgattcagtagcaatgtgcaatgacattgaaagtactaaaacaatttattataataatgaacgtaactatcgttttcataatttaaccacaaataaaagtttactattttacaattgtaaagaagtaatactcccatcagacaatagctgtactccaactaatcaacccccagcacaatgtaatactccctctgaacctgataaaaataaaaaagacaaagataaagataaaaaagaagacaaaaaacctttaaaagataaaaagaaagataaaaaacctaatccgtttaaaaataataaaccagcacaacccgatatgacgtgtaaaataaaataaggatatataatgaaaaagatttttttaagtattattttagtactttttagttttaatgtatatgcagcagatgctaaacaggttgcaaatacagtaaaagatgttatagtagataatgctcctacattagaggaaattggggtaaaaacttgtgatattgtaatatataatttagttaatgatgaacgagttatgttgaatacgtatgaacaagtagtcccattggttgaatctggtgatgcttttagctttacatataaagttaaattaacaggaggggttgaagttaatcttgacattgataccgcttcagtactaaaagataaactaggatatgtgttcaatcgtattcgtgaagaaggtcatcttaagtatgtttatgaaagtaaaatactaaaacgtgcaatagttatagaaaactgtaaatgataataaaagggttgacttcggtcagccttttttgttatgatgttgatattaactacagaggataaagtaatgactaagcaagaaatattcaaaactttaattgacattttgcgtccatcaaaaactcgttgtgcgatggagtttgatattccttatgctgaacgcgtaatctttccacaagttaaagctgctggacttactttgcttggaatggggatgtactctgtagtagttgaacataaaaactatcctgggcgtgcatttaaagtaaccacttcacgctgggatggttttcgtgcttatgcaaagtactgcattgaaaacgcaggaaccaagtttcttccagtgatctacagtgccaacgaacaaggaaactttggatggtatgagatggacaagtactatcctataattaaacaaaaaaataattatgatgactttgttagtactaaaattggagatttatattcttatgcacatgctggtcagtacgctacttcagtgaatgatatgcgtggtaattctgaagagattgctattgcaacggtcgctgctaacatcatgaaagagtttcacgggcgttttgtaccagacattcattcaagtaatgtaatgatggataaagatgggaatgtattcattactgatcctctttcgtgtgatgtgcgtagagaaataccaattactgaagaagatccagttttttattgacagaactgatgttctggtgtattcttaataaaccataaaaattgcggtaaaggataaaatcatgcgttcatttgaaaacttaataggtaagcatcttttatctgaaattgatgcagacgttaaagaattatccaaatcaaaaagttacattcatttggatgaactgtttattaagtacggtgagattggttttaagtcattatttgtttttactatgaaagtacatagtttaaagtacttcgatttgagtgctaaagatggtcaaccgaatctatattacatgtattaccttaagaacaaagatgaagctaatacattactctctgaatatatattggggtaacaatggaacaatattttgaattaataaacaaagtatcattttatgtagtatctttggtttgggtgtattatatgttttgctacattattgcattcttccgatacactactttatatgaacgtatctactatgatgcccccatttcattcttgatgttttgtgcatgtacgtggggaatattagaagtactgatatgtgggtatagtactgatgaattaaatctggtatcggtgttgactgggttttcatttgttgttatgatagctgccgttccagtatggttgttctttggactagttcatcgcattgatatatggcgttctaatatccctgaaaagtaaggattggtaatgatttattacactaacatgtttgcctatgctgttgcttgcatttacattgtttacttcttattcggtggagtactgtgcttctttaagtacaaaaccctgttcaaccgaatgtatccaaatcacccgattgtagtagtacttttgattctttcggttgctcaattgatcgtcgaaactacaatgggaatcagtagtgtacattatagttttggcactatagtaattattactatgctcattgcatacattttagtacttggatatggtatctttggtaatgttgcagtgaagttgtataatcgaattaaaacattacgtgataatctaccggagcgttgatatgtataatttgaacctaatctcatatattataacaacactgtttacattctatgcctttgttggcataatcctagtgtactttaaattttataaagtgtttaaccgtttctatccttcaatggataatgaattcttctttgtgttgtacgtaggttacacattaatggctacatgtttcactgtagccgatggtgtcatcggcattaaaactgatgcaccaaatggtagtacgctggttgcatttattcttaccggattccttgcaacttatattgccttcattacaacatggtcagtagttgaatttctcttgcgactacgtaagaatatgccgaatcgataggagacatatatgtttgcattgcgtaataaagacactaaagaattattatgtattgataccgtatgggattgtgcgggttcaactacagttcttgaagaaggaactggatattgcgtgtttgttgttcatgataggaatgaactcgaattattacttgctgagttcaatgctggtggtaatcctaacagtactgaataccctgagattatcaatccagcacctccaggttcttatgaaatcctaccactatgggtgttgaaataatgcgacaaatgtacaaagtaaccgagctaaacaagcgtctggttaaacaatctatgtttgaggataaagagtcttactataactttaaacgtgctgtagaggctgctatccacattcagaagcttaaagaacgtggttgtattattctggaaaatggttcggaagttgtaacggatgactttagtgtagcgtttgatgtttcacctgatgggacgctatcaatgccccgcttaggaactggaaacatgactgtttgggttggcttcactatggggaatgtacctggtactgtgtacgtagatgatgctgagttgaaagacagtttcaaaaacttatcgtaccttgaaccacaatacgcacatgaaatgaatttattttgaattgacaaacacattcagtactgtataatgcttatcaaggggatgaacttctcatccctacaatcgaggaactaccatgattacttttaagaaaactgctaaccatatccatgaaatctacattaacggtcacaaagctggccttcttcgtttactcgcccatcaccctgatgttaccgtatctgataatgaacctaaagattggcgtgtctttttctttggaaagtacagtgattttcaagtatcaaacctgaagaacattcgttcagtatgcacgttaactgaaattaaagaaaagttagcacaagcattgaaaactaatccagatggtgttcttccacctgataactttgtagagaaaggttatgccttagctcatttcaaagatggtactattcaatctatcagtactgcatatgaatatcaatggactgagtacttcacttatggctcccgtgatactttgatggcttcacgtagtaaattggaagaagtattaactattattaatgaacgtgaacgtcatttatatgataaacctgaaatgtggagttcaacttacattgaccgtattgactatgttattatgactccaatctttgacactgcttactatgattctttgaaataaggataacttatatgaaactacgtactcgtaatcgactgatggatgcactgtaccatgaacagctttcactgaatgaagtgaagcgtcagttaatgtacacatatcagtttcccgctcgcattgcaaaacaacgtgctaaagaattgctgaaagaagcaatcgagtactgggaatctgattcttattaatatgaacatagacttgaaaggtgcaacccgaactgttatcctcattggggaatacgctattaagattccaaccttcaaaagctggaagttattcctaactggaatgatagctaacctcaatgaacgttcatggatgcagtactccaatcgtagtgatagtggtatctgccctactttgtggtcatcatgcactggtttaataacagtacagaaacgttgtaagccagtgcaacataggggtttattttgggtggagttgtgtgctttagcattaaattcagagttaagtactgacttcttctattcagatgtgaagccagaaaactttgggtatctgggtggtaagttagttaaacttgattatggagattaatatgtacgcactgtataataaagaaaagaaacgatttgccaaggttgaaatttcgattgatacgtttgatatgttggagtactgtatcgtggaagacccagatgtatccttgtgttacgttcttgaggacgtatcagtactgcaacgacttcttgagaattctaaaagtcaatgccagggtatccatgatggttcatcctatgaaactcctgagtgttcatatggctatctggacgggtatgagattgtgaagttggggatcattgaataaagaaaagggttgacttcggtcagccctttttgctataatcatttcatcgaaacgagaggatgaatacatgacacgcattaacttagtacacgttaaagaacttgctgaccaacacctgatggctgaatatcgtgaactcccacgtgtatttggtgctgtacaaaaacacgttcaagcacgtaagcgtgtacgtgatttcaaaattaacagtacttatctgttgggttcaggtcatgtgacattcttttacgacaagttgctgtacttacagaagcgtcatatcgatattgtcaacgaatgtttgcgtcgtggtatgaagattcaaaacactgaagtaaacgacattagcagcttccctgctgagttttgtaatgattacgtaccatctgaatcagaaattaaaacctctcgtgagcgtttgattgagaagctccagatgaagcctaagtggtataaatttactgatgttgagttacctgagtattatcgttctatgatctaaaaaaacattgacaccagttttatctttcagtatcatgtaacaaagaaaatgaggaatacaatatggcatctttaagtgaaatcgcggaatacaacccactaacaatctcaacaattcaacgtacaaaaactttttatttccgtcctgctgatggatggaaacgtggaatgaatggtgactatcgagtactggaagattcgctcatcgagcgtatcaactctgaactacagaagtatgaaggtgttaaagttgtgcgttcaacttctcgttattttgagtactacattgagtcttcaacggtaaatgaaaactcatcattctcggtggataacactgatattcttcgcaatgcagttggtctgttatgcaacattgcagaagaaatgggattaactattagtactatgagtgaattagaataacataaagggttgacttcggtcagccctttttgctataattatttcatcaacacaagaggtaacaaatgaaactatcttttatacgattagctgaattcttcggtactgatgtaattactttacaacaaattgcagataatacttcattaagtacacaagaagtacttgacttagatgtaattaagtgcgataatacgtccatagatttcaaagaaggtcttgtcgaaaaagataagattcaagctaagattaatggtgctggacgggttcagtactggaaaggagttttaagtaatgtttgaacagtactattttaatgaagatggtgaaaaagtttatttttatgaagagcatggaatgctttttgagtggatgaaagccgaagatataaattttgtaaaaaaatccaacattgctcaagatcctattagtattatgggtgaaataaatgatccaagagttcttggattctatatcaatagatcacaagattatatatctaaatcaaaaaccaaacttgtagtgaataacgatggtatgttagttattggagccacctgcacgaattttattaggcagggatttaatgggaagattttttacaatattattaatattccatattacaccattaatcatattagtgtcatcaacaaaaaatatggttatgataaatttacttatagtggaataacttcgtttaactctacacttcctagtagaactaaaattgaagtagtatgtaatgattgtggtgatataaaaaaacccacaattactgacttagctactggtaaaattggttgtcaagaatgcacgaaacaaactttaaaacaaactttaggtgaatttataaaaaaatcacatcttatacacggaaataagtatgattattctttatatgactacattaacaaccaagtaacctctattataatatgcaaagaacatggtgaatttcaacaaacaccaaattcacatctgtctggttctggttgtcccacgtgtgcagtaaaaggatttaaaacttccaagcctggaagattttatattcacaatgattatgcaaaaaattcggataaagctggtattacaaacaaaactattaaagcaagattaagtccacaaaacttatcttataaaaaaatatataaagtagataatttttggagtaatgaaatttccattttatttcataagaatgtgggtgggaaacttgctagagaattggaaataataatacatacaattgcgttatgtggtaaactatataataaaggttattatgaaaagggagatggttgcactgaaacattcaacaacattcatcgtcctaaagttaacgaagccattaaaaagttcttagctgaacatgaaggtgaatacatcattgaacgtgatatcaatggtatttttggtgaagtaattttgtaaaacaaaagaggttaattaaaatgaaaaagttaatgttagttttgttaatgtgtttatcaacaacagtgaatgcaaaaactgaagcatcaacaacatgtaaatccacaaaaactgacactatctacaatttgtatttggatgtaacaacacaaacagcaaaaatagatggaaagaagtttatgtttgaaagtcaagaagtatttaaagatggaagtggttcgtatactattttttcaaatgataaattgaatcaaaaattaaaagtttttgttattaaacctaataagataaaatatattattacctataatggtaaaaatattgatatgggtaattgtgtgtattaaatatgtttataaaaagggttgacttcggtcagccctttttgctataattatttcatcaactgatgaggataacgaaatgaccagagaagcacgtagcattcaaattcagaaaaacttcaactccatgatggttgctcttgagtgtttgctcgacgatagcagtactgtaaaaagtatggttgtcagtggtgctcctggtgttggtaagacttacaccctgtctaaacgcctccagaaagctcatgacgcagcagaatggaacgtagctaccatcagtggtaaaatgactactctggctctgtacgaagttctgtacaagaatcgtcatagcaccaacgtattagtactggatgatatggacagcatctttgattcagaagacggtatgaacctgctcaaagcagtactagatagtggtaagcgtaccgtgtcttatatgactagctctaagtacctgagcaccaacggtatccctaacagctttgatttcaacggtcgtattgtattcattactaacaaagatttagcattagattctaaagctaaaacgaaaatgtctgctcactatgctgctcttatgtctcgttctgtatacgttgacttacagattcagaccaaaagcgatatcatgattcacattgagaacgtgatgaataagactaacattttagaatctaagggtattaaccgtaatggtagtaaagcaattctgaactggatgttgaagcacgaagattctcttcgttcaccttcactgcgtatgccactgttgatttcggcagtatataacaacaacccatacgattgggaagaacagtgcgaaaacttgttccttgaaaaaatttaattcaatattgacagtactaacaacgtgtagtactataacagaagtttaatatcagaggatttccaatgttagaattttttaaatcagatacaatgattagtattactttgatttatctttttggttttttcttttatcatgcactagttgtagtactatggtattttaaaaagaaaattgtttttaaactgtatccagtaaggaattcatcactaattctttacacacttgttcaaggtttgtttgcaattgttggtcttatggcacacttaatttattgtgctaatcctcacttgaactcaatctcacaatatattgtattcttggggttgttcatttggttaggtgtatacttaatccatctcattattcatggtagagataaaattcgcggagacttctaatgtttgaagcttatcttgagtttttaaggagtagtccagttgcacattcacttgcagggattattttaacaacttatgtaacattttgggtagttatgtttctaggatggtattttaaaagacaattctataaacgtaaaggtgaagattttatgaattctgtcattaatcaatcgatgtttgcatcaacattgatggcatgtattgtggcaacactcacaggaaaggtactacccgcattttccgcagtttacggtacattgggtatgatatgtgtagttttttacttgttcattaaactatgttgtgttatgattgaacttcgaaacaagataccggaggaatgatggagtactttattgatttactgccgtggtatatgaaagttagtaccatgtactatattattagtgctggattctactttctgatgtggttctttaaacgaccaatttcagtattcatcgctgataacatgctgcaattaaaattacacgcatggtttggtatggcgatgattatgcctattattcactactcaatgattagtagaggtttccgttctaatggtgaaccaattgtattagtattctattggggttcaactattgcatatgtaagtttgttgttgttcccagtcgttcataagttacgtgctaaagttcctgatgcgaggtactaatggatatagtaacattgatttacacgttgtattcattctatttcattatgtgttgggttggatttttatttgtactcaagatgtttgattatgttgaaaaacagataaaagaattttgtattccttttatcggttcaaccattattagtgtttcttgtgtgtattttttggtgtttgatccaccaaataacactgcaatgattgacttgatgttactaccaacaactgttacttttttatgtagtctgatgccgccgattagccgtagactaacagaatttagacgcaatcaaaagcgtaaacgagggatgtaatggaaattgctcttattatcttaactgctatgctgtttattagtactgtggttataattggtaaattcttttgtgtatcatttttagaaacggtatacgatgaaattgctgatgattatgaattacaagccggatttttcattacgtattggcttagtttattttgtctagtcattgcttggattttacatatctttaaatggggtatggtagacggtgatcctattatggcaattattgttctagtgtttggtatccttggtggtgcagtgcataatctaatggttatctggcaaactgttcaatatgttttggttccctatttcgaaaagatgcacagtacaattaaaaaacgtaaacgaggttagtatgaacgggatagaattatctttcgttggtcaattactagtaatggcgtatacatttatcttctcactgaatgcattcgtgtgcattgggaagtacttccataagcgaccattatcaaatatatatgatgtaatccaaaagagatatagtccagcatatactgtgttgggtacagtattcaattttggttttattgtattaataattggactgttcacatcctctttgaatacaataacctttggtcttatgatatgttcattggtattagccgtaattatatgttgtttagtactgcaccttgtggtactattgtatataaagatctctgaaatccaccaacgtttgggtatgaggaaataatatgagttaccgtgagatattttccattatttcaattattatgttcagtactggaacactggtatggttattatacttcttctgtattaatccagtgtataatatgttatgtaatattaaatcaagtgccggatatatcacttttatggtctttatgggatattattgtctaagcattttaggtgttgttttggttgttatatttgatgtgggaccaaatagtgatggtatggaaatacatgaattaataaccatgtttggatgtatgataccaacagcactactgtttgtagctactggtagtggattgataaaattatataattatttaaaatccattcataattccattcataataagcgtatgtcataataagcgtatgtcataataaaaatccagtactattaagtactggatgtataaggagttatgatgaaatcaaaattaggtttgttttataaaaattattttgttaaacaacgtaaatttataaaaaaatatttctctggagagaagtctagtcctataatctttaaaagaccaagttataatacttacttagctggtgctaaacagtctaagaaatttattactcttttacataaaaacaacattaaagcttcttatgttgaaacgagaagaaactcatcaataactccgggtgattttattgagtacggatgtttcaatattaagtacaatgataatacatactttatggatattgattgtaatacatccaatctttttaacattgtagtaaatccattaaaacaatataatgtttatggtgattctattatcaaattaatcaaaaacaaagatggctttgattttgaaataaatgttttagatgataattttgacgaagtacccgtaaaccctgaaatctgtgatattttaaacagtttaaaaggtagtacctacaatatatcatctgatttaatgtttcagtactcattaatccataaagatattgaaaagtatattgaatgctccagaattttgaattttctctatgatgaatttaaaaagagttctaaaataactgcatacactttgtacaatattcctaaaatggtgaatctttgacaaatacagtactggcaactccaccgtctgtaatattttgtccagtactgtaaatttgtataccatcggttaagtaagttctgtataaagttgctgtaacatatacgttattcatattcatctctgttggtagtacacatttggtataggccgacacatcggtttgtgtacctatacctaattgtcctgcgttatcgcctgtgttattaccagttgcgtaaacacccaatgaagttataatatgattagaaaaatatgaataacctacactgcttcttattatatcgccaggtgcttgtgttgtttgtcttaacgaaatatatgtttgtgatgtagaaccatttgctaactgaccaaagtattgaccaccaccatgatatgcaaataatttattagtactattattatttgctatagcaaaagcaaagtaacttgagtttgttgtataatcttttactgtataggtattagttatttgagaacataacgtgtactttgaatataacgtcatgtcggttgtacctacgcctgatattgcaccagtataatacaatcttccatcggttccaataaaaccttgcataagaaaatttgccaatattttggatggtgtaactccagtaggtactgttccttgtacaaatgatgaaagtgaatcagtacttctaccatttcctagttgaccataactaccatagcctgtattccatatagtgttgtctgtgcataatacgctcagtgctcctgcactaactacaatttgttttattgttttgcctagggctgttattctatcaaacactatctttgcagaagaccacgttgttgacttatcagttgataaaccgaatgatgcaccatttccagcgtaccacatcgtattatctttcttttttattaaggttgactcatacccgcacccatagatcttctacgtttgtattgcataaaacccatttcgtttgtgttataatattacctatacccatttgcccaaactcttgagagcctctactgtacaacgtaccatctgacataagggcaaaaactgtcgtatcagatgaagctatttttgtaacagaaggttgtatgttcttttttgatgatgtgataattcttccaaagggtagcattgtatcctccaaatgtaaatcgttattatatttaggacaaaaaaatgccagtacaaaatactggctttattttatataccacgactgggtattttatataattgaaatttagtgtaataatcagaaactgttgtacctgtcgcttgtgggatatagccactcaaatacacatccccttgattatccatatacacatttgtacattcacttggacagaataactcgatgctgccaactttaggtgcatcaactggaactacaaatgtagtacttgatgtggtattaccgcgaccgagcctaccatatgtgtttataccacacatataaagtgaattgttagttttaaccgtaagcccaccatatgttaatgaatttgatttcatttccatattatctgatattggtagagtggagattgtagataatactgtccctgatgaagcggctgaaccattacccaagttaccttccgattgaatcccacttgcacgaactgtatatgtattattcgtgttgtgtttagatacaacccatgatgcactcccaccaagttcataatgtataacagtattgttggctaatgcacccatttgtgtccatactttaacgttagtttcaccattacttataccaagtgaaccccatgtgttttgaccagtgacccaaagtgttttatcaattttctgcacaatcactgcacttgaacctgtttttacactatccacattcgtattaattgaagtaaatgttgataatcttgtggttgtgttattaccaaaatatccctgtgtattggcccccattccatatagcgtaccattttgaagtaaaacaaaaataccctcccctacaatttgaatgtccttaatttgcgacaattgtgttgcattgaatactgatgtaaaatatgaagtacaatcagtataagtactgacagtacttaatcctgtaccaatagctctacctacgccactgtaataaaatttattatcttcggtttggattaaattaaaagaaccttgggctgttctaaaacgttttacattttggtatattaaagcccactcttttactttcgcattaggtacaccatttccgaatccatagttttgtgaactagttccacctatacccattaagtctccatttttatataatagtaagagtgctgttgctggaataactgacgcactataaccattgtaaataaagatttctttcacttcaggaactttcattttatttgcgtattttatcatccttggaaaaggtaacataaatccctcctttattcattatactatatttaatcaaaaagaaaagccagcactctgtactggcatttaaaataatcaaattgtaggaagtaggaattctttcataacagatgaactgcttgcagatacattatctggtgatttccctgcgtagtataatttattattaatgaacatatacaatgttgcatcatttcctgcaactagtgattcacttttcttaaattgaacaccactaggtaaaattgcttcaacaaatgaacctgattctcttgtagtattatttgccaattgaccattgttattataaccagtactataaattttacctgaactataatatacgagtccacgagtactagtgttttctattcgaatgaattcactatcatctggaactgtagttgatagtactgggtttaacttataagcagatgttacattattattacccaattgaccataaccttgaaagcctagagtgtacattggacatgattctggtgtaccttttgttataataccaatataattcgaactacaaaaaatatctattgcttctgtaataggtgtacccttatattgaacccaagggaatacatacgtttgttgcttactatttcccaaagtaccggaagttgttgttcctgtacgccacattgtatcatcaagtttaataatccagttagctggcgttatcgatgaacagaattttttaacattatccactaaaaatgtaaatttattataatatgatgcagtgtttattccaaacttagcaccagtattatcacctaacaaatataaactattatctgtatctaaaatcaaagcataatcataacccacgtatatctctttaatttttgaaataccaaattgtgcgaaatagcttgtacattcagtgaatgttgtcactgtatttgttgtgttattacctagccatttatctaaaccactataaaagaatctatcatcatttgtgcgtattagacaaaaagagttcattgtactgcaccaaaaatctttaacattgctgtatatttgtgtccattcagttacttgattagtatgacctaaaccaaaaattccaccattctgaagaccaatagcccatattgaaccatttttgtcaagcatcatcgtgcatgtatatgaataaccacatgacggggtaactaatttaacaaaattgggaatatatggtaaaactttatttccataatccaacattcttacaaaaggtaacataaattcctcctttattcattatactatatttaatacaaataagaaagccagtacagagtactggcataatgtcaataagcatcccaaggtaatggtgtctttctaaacccatacctagttgcgttctgcccatctccggcaatgtatctaccggtcccacactgatataattcagtactgctacatatcgcaccaccaatagtaccactacaccactgtgttatattagaatataatattggtaaatcactacatttggtatatactgcaaccgtggcagtcccgctcggaccaccaaacacacttcggttcgaacccgtgtaatatatgccatctggactcataaatgcagatgtataagttgtactgcaatccactggacttcttatattattaagatcgcttgggtatgctctagcaccatatgtgtatacattaccagcagtagtaataccattacctaactgaccatcattttgtccaccacatgtaaccaacgatgcagtaccggaaacaattgcagtagcattatacgaagtacctatagcaatagaagcacccgccctttgggatggggtaggaactgcggctgcgttcccctgacctaattcaccattgacatttcttccccatccatataccgaggtggtatctaattgacatagtactgtaccataactaaacgtatatcgtatatctttcacagccgatggtaaaccactaactttagttgcaacactaataactccagaaacgccagtaactccagcgtttgcgttcatattacgtccatatgcgtataaagaaccatcagcagttttaatatgcatcatgccatctgtgcaatataatgcatcgatgctatccactacaaccgctcccatactagacgttatatcgttccacccaaacgttgtagtattagaaattaagttatttccagcgtaaagtattctattattatttgtaactacaactgtataattggcagtaacgccaattaatctaacattctcatatatcttagaccacattcctattgaatttgtgttagcatccagaaatcccaactgaccagcggtattatatccaataccccacacatcacctgcactgtccaataacacttcatgggaaaaaccaatcttaaaatcttttatcgttggtgttacaggaacaggtttaatattcccgtactgaatcattcttgcaaaaggtaacataattccctccttattcattatactatatttaatacaaataagaaagccagtacagagtactggcattgtgtttatctaaaaggaatgcactttttgaatttatatatatatccagtctcaccttgttcagtaaaatacccagggtttccagtccagtataaatcctcacctatactaactaccgatactgaaccattaccaatcgtaccaaaccactcaacatatgataagtcaacactatcatcaaagaattctattggtaatattgaaccataattcccagagaatgcgttgcggcctaatccagcaccattagaattatatcccttaccattcgtattaataatgttagtactggattttattgcattaacataggatactggtgaaagtttatcgaatgaatttgctgttatatcggtatagggatttgtagtaaatgatgaccttattatagcagtattttcagaaccacctatagtcaactgtgtgttccaaccagccgccattaaagacaaagcagatgtactactttgaacaatcaaacgtgttacccatcgtgtagcttgtactgcaattacatgagaactaccaagattcaatgcagtaaaagtagtaataggattattatcaccggttcctaattgataaaaagtattctcaccacaacgataatatataccatcttttatatagtgaaagtttctgctcatttcactagatgcaattgcagatacactagtgtctattaagagtggagatgtaattggtgtagttgctgtacccaattcacttgcaccattcatgcctataccatataactgaccgtcacttgttagtattaacatggaattgttagtactggttgatgatgttatttttatatcttttattgaactcggagaaatagatccaaaatatgattcacaacgagtccatgttgaaacagaagatgatataccaaaaactgagttagttccactatagtacaattccccttgttttgttctaattatagtacaatataaagaactccagaaatcatcaacactataaggacataaaacccatctatctaaaaaagatgaaccagtaactcccatttttgataattggtttccgtccacgcatatataatgacccatcactgtataatacgcttattgaattttcatcactattaattttaacaacagtatctttgccaggggcaatattcccataattcatcattcttccaaaaggtaacataattccctcctttattcattataatatatttaatacaaaaaagaaaagccagtactgaagtactggcgaaattattacaattgtctaggtgtatccagaacatatctagttgtactaggaccaccatcatcataagttccggttgaatatatatttttcatatcagcagttagaaaagtacgatacgaaccgcgatatatttttattttatcatacatagaatatgttatttgtgtaggcattggacatgcagtaaacttaccaacagttgcactagtaccaatacccaatgaaccagcataactactggcatttaaaccagttgcatatacaccagtactcgtaactagtatactagattgtgttgggtatcctgtatgaattgaatacaaagttccagttggtaatgtcgtactattgctccctaatacagcaagtgccgaactggttgtggtattgttaccccatgcaccattactcgctaaaccaccaactagaaactgacgtgcaccagaacttggattctcaaccaaagcactgactgcaccacttgagcatccagtgtattgtaacgtttttgtgtatgttgtacttggtttatataaagtatattcattaaatggtgtccatgtggtactggtacttatacctgacgtaccaccaccaatatataaattattttgtgtatcaaaaaacattacacagttatttgttgactgtatttgtgcaatatcaacattaggcgtgacagcttttacaaatgatccatctgttatttgttgagtactaccagtaccatcagcgaattgtctagccccactccaaccagtactccatattgtattattatccattaataccgtaaaccacgtagtacctccatacatctgtttaattgaagtacttgaactttgcgtgtacaaattttcaatatattggttataacttaaaaacgtagtagtactagttggtaaaccaagatgatcaccatatccacaataaaaataatttgagtcattatcttttactaataaagttccttgtgtaagccagcaatcgttaacgttttctctaattaatgtccatgattttaatgcagtgttgtttcctctaccgaatttcccaaaactattattcccacgtgcatatagttgaccatccgtatacagaaccacaacatctaaatcagttgggattattttcttaatttgaagtggtactgggacaatattcccataattcatcattcttgcaaaaggtaacataaattcctcctttattcattatactatatttaatacaaataagaaagccagtacagtgtactggcattaaatcattgtataaatgacatatcaacttctgtataactaagaatgttttgtccagcaattccccccattactaccatagcatacccacaataatataatttctcagtgtccgtaagtataagtgaaccagatggagtgcgtaccaaattacacgaactattaaacgaagtatacgaaggagtatatgagtactgattaatattattaccaacacctaattgaccaaatccattcgacccagatgcgtatagaacttcatcacctttaactatatgtgatgccatgttactaacacaagtatatagagtataaactcctgaactcaataatgtcggagttttgtattgtatatcggtagatgaagaagtaccacctgtgccaaattcgttcccgtattgtgcaccgaactgtttaccacaagcgtacaaattattatccgatttaataaaaaatgtactctgataacttacatcaaaatctataacatctgaagaaatcatcgtcaccccagtaatagaagtttgattacctgtacctaactgatagtaatagttaaaaccacaaccccataaagtattatcttcttttaggtatatgttaccaactgcctttttgaccgaagttatagtatctacccttttgaatgtgttaaaagaattaatgtttgtaccatcaccaaatgatgataggttcgagttattgttaactccacaacaatacaacgtaccatcgtttgttatcaaattcaccttcatatcattaaaactactcatgtattttatatcagaaacattaataccacctgatgttatccacgtagtacagtccgtccacaaagtttttgtatcagttacaccagtgaatgccttcgtgttaccagtgataaaaacttttccagtacctttctcttcatacaattgacaactactactgttatcttccaatagaactcgtttaacattctccgcacaaagaataaatttactcgatgctacacctgttccagtaccccaattcgtcgcagaagatgcatacaacttattagtataagtatcatgaagatacatagaatcacttgaatatattttaaaacgcctatccttaccaggggcaatattcccataattcatcattcttgcaaaaggtaacatatttccctcctttattcattatactatatttaatacaaataagaaagccagtacagtgtactggcattatattatttccacggtagaagtgaatcaggaacccttgttggtacagtagttgaagacattccagtaagattgggtacaccacatgtgtataaattattatattcgtcaactaacatcgtataagaatagctcttacaaaaactactaagattactaccttctaatgcagtaagatccatttcagcgaatgatgttatatacatatcagttgtaccaataccacattgaccatttgaattaaggccacatgaaaataacttattattattattaattatacaggatggtccggtaaggtttgtcccaagctcacccaccaactccacttctccttggaatgataaatttggaattaatgtactcattggggctactgacctatttcctgtacctgcttgtccatagtcgttaatagatgcaactttaacattaccatcattaagaaatatataagaagtttcatttgtattgactgctttaattgcattactaatcgaagtatcttgtgtaaatgtgagcaagttttgtgtcgtcgttcctgatacaaacgttctacctgcataccaatatgaaccatcatttagtactaatccagtactatatattgcacaaccagcactgataacattttctattgtactataggtgaatcgtgaaacgcttgaagttgatccattcccaaaaacaccaccagtaccagcaccacagtagaaccactttccattttttaaaaatacacgcatacacgaagatatcacaacactatcaatatcatctgcactgacaccgaaatcagtaaagttctgtgttatatcaacccaaacgccgttagtgtttgaagatagtattggaataacagtacgtctaccagtgtaccaaatagtaccatctttctttatagcaattgttccttgtaccccaccccaatatcgtgtaacatttgagttgacaagagtccattcagttgaagagtccaatgaaccattaccactttgtccatatgctgaagaaccaaaccaatatagattaccatttgtgtgtaaataaaatttggcatcagcagaacattgtaacctgtttttaggtagaatcagttcaggtgcgatattcccgtacttaaccattcttgcaaaaggtaacatattccctcctttatttgttatactatatttaatacaaataagaaagccagtacagagtactggcattatgttattttggtaaatcaattttagtaaagactgcaacatcctcgattgcacctggaatggcgtaatacgatccagtactatacacgtctccatttttggttaatatcgatgtcaaaccatcactaaaaagaacatccctaatctcactaacttcaacgggtaattgtaaattggtagcactatatatagcaccagtttgagaattgtttaatcccaaaccacggttcgccccaacacccttctgatatgtactagtaattaccatttgtgtagcagtatttaaggcaggtgaattcgtcataaacaatggagaactattaggcaaagtacttaaaggaactgcacggaatgtagtcgtacctgaactaagaaagtttggagtttgaccacatacgaaatatgatgtaccattatagtaatttaatgcattaccaccaatggctgcatcgattacaccagaactacgcaatccccaagtgttaatttgtgtttggttccccgtaccatgctgcccactactattccatccagaactatatagcttattatctaatgtaagatacatactatcattcgcattggtcattactttacgaacgttcgtagcacattgagttaatgtgtaaattgatgatgaaccaatacccaaagaaccacgatatccattatctcctgcaccatagagtactgaattagtgctaagtacaaatattaaaccatttgtgcatacaatattagcaatttcactgactggtatagcattggtaaaccaactagtcctttcaactaatacagtactgtaagaagtagttgtagaagatgagaaccagtacgtttgacctgatgtccatatagtattatcatttttaataataacaagtgtacgatcacccacgaaaaaattagaaacatctgcacttactaatgtccacgaagacaccgtgttggtattaccatttccagattcaccaccttgatttctacctatgtaatataaatcatgtgaatcagtcaataagaattgaccttgtgtagaagcaccaactttaattatttttttaggaccagggacaatatttccatacctaattattcttccaaaaggtaacatattccctcctattgttgccataactgcgttggcattaatgttagtgtagtaatactataagtgccatctggcaatctaccaccatttccattccagccaccacatgcatataatttataatctttagtaattattatggttctgctccaatctttagatgccataagaacattttcataaccaccacttattgcactaagattaaaaatattccaagttctaactaatgtattagttccattaccttcttgaccatatgagttagcaccactacttctaacatatggtgcgtattgtgccataggtgcaccaattgatgcatttcccatattacttggacaaataaaagtactgtacttacttacatcaaccgtgaccgatgtgttcctaattggtgttagctgatttaccgatgtagtcgtaccattaccagcttgtccagaactgttagccccgctataatatacaggcccaccagtagtaaaccaccaagtaacatcgtatgtagtactaatatgttctacattactaatcacgaatttgttcaaatatacaacagaactaccaccacatccactttcaccaaagttatccttaccacaaaaccatgcatctttatttgatttgatatagtgcgttccttgtaatgaacatgccatatgtgtaacttcacccatattagtcataactgtgagtgtagggatggaatttttattaccagagccacattcaccattagtatttcttccacacgcaattactctaccatcggttaataatattctagtactttcacctatatatacactcttgatcatattagccataacacctattttattaaatgcaacagtaacatcagtccatgttgtcaaataaccattaacaggtgttgcatctccataatcagaaaatgcagccacagacccagtgtagtatattttattatccaaatcaatcatcaacgaaccttgaacaccaagccaaaaggctgcacagttccttgcaagtactgtaaatgacgaaactgctgctgaattcccaagaccaaattgatacatgttattactaccataaccatataaagtattagttgggttatggagatacatacagtttgtataatgttgttgtaaaacatctgagaactctacaggttctggacctggtgcaatatttgcgtacttaaccattcttccaaaaggtaacatatttccctccttattcattatactatatttaatacaaaaaagaaaagccagtatcaagtactggcctgtatttaaattattgttggtaatggtaatggtataaattcatcactcgatggcaaaccatataacgtagttgcatttccagaataataccatcccgttgaatcttgcactatagatagataggctaacgatgccgcctttgttatatcattaaacccgtgtggtacttctttaaatgtagatgaatattcaacaccagggtcaccagaagatagtgtagtgttagtaccagcataatataaagtattgccatctgtgcttatagcaaaagaaagaacagagttattcatatcactccacaaatccctaaacctgcctctatatccggttaattctgtatacgaatatacgtttgtggtatttgaagaagaattacctagttgataatatctattttgacctgctataacatatctagtgctaccattagtatcataatataatataccagagtttaatgttgacataccaactgcacattcggatgcaaattcgggagcagagtacaaattataagaagttaaatttgtgctagtacccaatgctccagtattgcttataccacagcggtagtaaccaccagtagtactagaatatatagtaccagatagagaagtgtagaattttgaaacatttgacgcaactaatacagcattaactttgcttgttgaaccaccaaatgattggttattatcatatcctttagcatataatctattatcatttgtaagtaatcctacacaataagaagtcattttcatttcacgtactgtgcttagattcactgcactaaattgtgtcgtaacatctttccatgtaacaactttagaacttgtcgaaccaccagattcaaaccattcatcaccacagtagaaaattttattatctacagttaatacaacgcatactaaattactagcacaagcaaacttaacatcatctctaactttagtccactcggttacattcactatagtatcagttcctatacctaatttgccatacgaattattaccacgcacccataattcattatcctcggttattagtaataatgaattagcacctgcaacaatatcacgaacttttagtttttctggtgctacgttcccataatttaacattctaacaaaaggtaacataaatccctccttattcattatatcatatttaccccataaagaaaacccttgacatcctttcagtactggtgtactatagaaggaatataaggagaactacacatgacaaatactcttaagtactacctcaatactctaaatgaactagagtacggggaatttctctcggatagttcgtggctaattgagctaaaaaattataatagtccaagatgcacccttatgatgaacaatgcaattgataccctcattgtgagtattttacacagcaacatctgcggggatagcaataaacaattatcaaaaatcttagtactgctatctatatgaacattgaacagtactacatcgatgcactaccaacaaaaggtctacgagaaagcctactgtatacacaaaatacttttatacactacaaacgttgtcctaaactcctgaactcgtacaggagtaatatcataagaaatgctttacaaggggcagaaagtatgcaatactattatatccttgcccttttaatcgagtactaatatgaatactgaacataaagaattctacaccaaataccttagcaacgaagaacaattgtttctaaggagtgtatcacctgtaagtaccaatactcacttcggtagagattgctttaataattgtatacgtagtactctagaagcaatcgaatgcaataacaaaaatattatgtactcaggtttaataggactaatctacttctatgaataatcataaagatttctatggtagtaaactacacaagcaagaccagctatcattctctttagcaccacctatgagaaaggataatctatattacaattacgatttcaggatggcgacacgttatgcaatagaacatcagttccctgaaattaagtaccgctctatcctgaacctcatctttaagttctaaaaggtgctatatgaaaactacaaacattcatcagtactacatagatattctccctaaagatgtacagttcatacttaaacaagaattcagtactttaaaaaaactaaaaagaaccgcaccttcagcaatcatccagcaccaaaaaaatgtcgtgcgtaatatactacaaggtacaccagggaccgagtactttaatatagtaaggctaattacattataatgaatcatataagctactactaccaacaactatccgacagagacaagtacagtcacaactcccatgtgtggtactacaaacgcggcagtataagagacaaacaacattacttctgtatttctattaaagaagcactaacaactaagtacacgtaccgagcagtacttaaacttattgaaatgtaaggaagaaaatgaacatagaattctatttaactaaactacaacacgccgaaagattcaacttcaataagttcaatattttctacaattgcgggaacaaaaaagataaacacaccttcctatatgtcgtcacaagagatgcacaaaacgaaaagtacacatacagagaagtaatgaaactaatcgctatttaaggaatactatgcaacaattctatagagaacgtataaccataaaagaccgtttcatgtacgacaccttcgtgaagtactacaaactaggaacaaaaagtactaaaaatattaatctcaatagctgcatttatgctgtactaacacaagataatccctacagggaaatcctcgctctggcatctatataaaggaaaccaatatgaaactcaatccacaaagtaaacgatacctacagcactttaagtacctcaatagtattcaggcagaatcagttacatctgcatatacgtatcacccgaatgtactaaagaaacgaaataaaaaggaaaaatccagtacaaatggagttaacgtatcaaagaaccttgaattgtacatgaagaaaaataatatagctgttcattatatgaatatctataatactgatttaaaagtattgagtactaatacgagcacaaaggtactaaagaacgcatccttcatcatcaatatgcagttggataataccccgtgcactttaatgctatacttcgggaatacatacttcttcgggaattgtaacacctcccacgatgtcaatacagcacaattccaaatgggtggcatatactctactgatgcagaaaaagtacacgagaatatgcacttctggcaagcacaacgtacagaagaaactgatacagtactacaattcctcaaagaactagaacacaaagaactacaggaagaagaactattcatgtacagtactgtaatcgataatccagtactctataaaaacgcgtacaatctgacaaaacatgtacaggaaattatcagtactgataagaaaatgcatcacctcattacgtatattacaaactatgtataaagaattctacataaaagaactaccaaagtttctacaaggaaatctattagaagatgaacctcgcggtattgactgtatatatgaagctgattacttccgtacatgtactgaacaagtacttaatgaagaagctaatgaaaacaattatcaagtacaactttaccacaccctgtaccttgcgttccagtactaaggataatatatgtataaagaatactacatagagaaactcccaatgtatctccaacaccttgtaccaacagaaccattgggtatagaaaaaaactacgaaaaagactacttcattcagtgcactaaatcctcgatatatattgacgactataatcgagtactgtatcacatccttttactaatatataggtactaatatgcacaaagaatactacacacaatttctccccagcatttttgaacactacgccagatataaagtccctatggataacgatttggcagtactgggattcaataactgcatagaacgaagtatagaaaatagtagtagttatgaccagctatataacactatcctacttatattcaggtactaatatgcataaagaatactacacaaaatatttcccaatgtacctcagaactaatctattagataaacctcgcggtatcaatgcacaaaacgataaagtgtactttactatgtgcactaaagcatgtatactagattttgacagctatcatcgagtactgtatcataccctgtacctagctttcgtattctaagagaacaatatgcataaagaattctacttaagccatctcgatctaaactcccaaatgcttataccacaaatcccaatagatatcaaggataagaaaaataccgaacaattcatttaccatacacagtgtgcgatcaccccaaattacattccatatgaattgtactacattctcgccctaatatataggtactaatatgcatagagaatactacacacaatttgttaaagggaactacaaacatgccgtacccagaacccctttaaattttcatgacccaagtactatattcttgttccatgacgcaatacgtacagtactcaatactaaagatgaagatgtgcagtacgtattcttactattacttatatacagacactaactaatatgaataaagaacataaagaattctactccaaatacataagcccctcagaacaaatgtttctaaggactactccacctttaagtactaatacatttttcggcagagtatgctacaataattgtattcaaatgactttaaacgcaaacgaagatggtaacagtactaacctgtactcaggtatcataggtatactattcctgtatgaataattacaaagacttctatttgaatacactacctactgtactttctctaagtgctcaatgtaaaatcccgctggataatgcttacgccagatatagctattccataactgttaatcgatgtatagagaatcattgcagtactaaccagtactataacataatcctacttatattcaggtactaatatgaataaagaacataaagaattctatatacgaaaactaacattcgtccccgtaagaatatataaagaatgcgacccaagattatacctatggcacttcaatgagtgcataaaagattctatataccctaagaactacaaagaacaattgtgctcagtactaacactagtactatcatattaattaatagagaatactatgtataaaaacttctatataagtaaactaaaagaaaatgaacaagtatggattagatctataattccactggcatttaatagatatgcatttaacagatgtaccgagattgctatagacccttataatattaaagagaatgtacagtataatcagtactactatatcttaatgcttatatataggaagtaattaaacacaagtagacaggggaagctcctagtgaacaacctttatgtacaggcgaattgttaaaattcagcctggacaaatgcgatcactaggattctccccaggctaaaccccgtaatcataggtagtcataagtaatcatatataaacatttatatgagcaccgtagaatcacagaatgattatatatgattcagtactgattagtatagacaagattgctcaagaatgctagggaaggattcagtactgatatgccactaagtaggcagaggaagtctgccgtactttgtagtttccaagctccttttccatttttcaaattacatcaaatgtaatcaaaagtaatcacgcaatgattagtactgaattattactttcaccttaatttcaattacccctttacccttcggggtaaaattccattaccccttgaggctccagcaaaaagttggttagtactccatcctaaatctcgatcctaaaaattttggagtacctatgaaataaaagttggatcttcgaaagttgaaatttacgttgggacgtttatgatttgtgggatataatgatgtttgtagtcgggtagttctcaagaatatcagtactgaataatgaaagaaagctattgacattatgattcagtactgtataatgttctacatagggtgatgagttgctgcgaacaattcatttactctacctcctgtcgtgagacagtacagaaaagatagttcctccagtggtggtacatctttttgaacctcatatgaaaatcgtaataacagtactgatattaacagaatggtgtcagtactgattttaatctaaagcattatgccaccagcttgtgctggtggattccctctaacagtattcagtactacatgatggtcttcatcctcctagggtaacatagtgagggctatgatggcagtactgaatactccctttcaaaagatagatctatggtatagtactgacggattttgggtgtagttaccctgggtggattttggacgtagatatgtctagccctccaggagtctggaagtaaagatggctatccatctagacggctaaacggctagatttctggatggctagacgtttggacggctaaacggctagatggttacacgtctggaagtatagacggctaaatcaaaattttattttgttttttccaatagttcccctaccgcgtggggatagtttccccgcagtatctggagttagatttttctgaatctggaatcattatcttataaactgggggcaatgtcaacggcctggacggatatttttaaaaattttttcagtactgaattttgggcgtaactatgcacccggtgggcttgagtctttctcgacttgatggaactattatacagtactgaaaaaataaagcaataccctggaagcaaaaaagttttaattaatttgcttgctatcctgggccggactatggtactatatttcagtactgagaaagtgcgtttacctgctagggtgcgggagtgtatcctttttttatatcttgaattttgggcgtaattccgcaccctctggggtttccgctttctcgcgtctatgtagtaattatacgctttttctgtactgagtcaatagctaaaaacaaaataattgaaaataatttaacgcgtttaaacggcccgtaaagccctggaatgattggaatggtgcaaatgtatagcttaggtgtattaatgcgttagaatgcgtctgaggccgttttatggggtgtagtagtgatttggttgattcagtactgaataatagtactgaatgatagttcccctatatagaaagaaaactattttaaaagtacatgtagaaagtacttgcaaactatgtttaaaggcgtataatgttttacatcgagagcgggaacacttcccgctacactttaaaagagattaatacgatggcgacccaaatcaataaaattattgctaacctggtcaacttccgtgaagagatgaaaggtcttccggctgaaacggtaaaaattcacatttcagcttatcgggaacttattacaatgttgccgcttaagcgtgaacaatacgccgctaccgtgatgcttgatgcgatgatccataagatgatcgccagtgatttaacgatggtttatcagtatatgggcgaaaatttcgcggtgtatagtaaaccagtaccaggaatggaaagtacagaagtattacacggtttaaatttaaaacaagatgcatgggataatatgcctcgtttcctggtatgggctgacagtggcaaaatttacgaataagtttaataaagtacttgcaaactaagtttaaaagcgtataatgttttacatcaggtggggaatagttccccactatataagaggattaaaaaatggctaaatcaaaaatgttcttaggtcacaaaaacaaaactcattggaatgtaagcctttggattaataacgatgagtcattgtaccggttggcccaggactttattgccgacaatactaatcgcaatgatgcggcccgtcatatgatgctatttttagaacagactggacaagataaaactccagacggctttaagtatagcactactgcgatccgtgcggcgatggttggaatgtaatagaatttatttaaagtactatcgcaaaaaatgatagtactttataatagtgttttattcatacaccaacgataagggcaacagcatgaatattaagtattttgcgacgcgtgaacaagctcggatcgccgcacgccaggacggggcaacgtttaaagatatgggcgtacaatcggaacgtggtaaacgttgggccattataaagcgtagtaccgccagatcattacagtactggttagcggcgttgaaaagtcctgatagtgtatcgcgtcgagtggtagaaataaagctcgaccgaaagggcaaccgcgtgaccgtgtaccgtactaaaaagattgcagtacttgaataaaaagtacttgcaaactaagtttaaaagcgtataatgttttacatcgagagcgggaatagttcccgcctataaccaggagtaataaaatgaccaatatgtatatgactgaagttaaaaccgtaaaagatactaccacaaataaagttacttacttacagcggatctgcggtgtatggcaacgtatcagcaaatcaaagtactttaaattaacatcatatgccaatcgttcggattcattcagtactgaaataaaaggtaataaagtacaccaatacggcacttattattattatagcctggacgcgattgcagtataagtagtttacaaatctttacaattgccagtattgacttattttgtcagtactggcataatgtattcattggcagataagccgtagcccatagggtgcgggagtgtatctatagaaaaagtagtttattacagttacaattgtgcacccggtgggttagctgttgtcatggggtatattatgccagtactggatagtgctgtcaatacctttttactattcagtactgaaaactatttttaaaaagtacttgcaaactatgtttaaaggcgtataatgttttacatcaggacggggaacgaaataagtaactccccattaagtagcccaggagtaaggcacacgaaaaactcccctgataaaatagtttgaaaattgtttttaaaagcgtataatacttacatcaactactgaatgagggttacaaaatgaaaactatcactactactactttcgttatggatttttctgaattgaacgcagaacaaaaaacgtcagctatcgaactggttcgggaacgtgaaaaaaactcaaacgacaattatttttctgaaagtgaaattgaatactataaagaaacagtactaccggaatatggcattaatgacgctgaaatacaattcagtggtttttggtcccagggtgacggtgcatcaatcagtactgaccacgttgacgcagtgaagtttttacgcaaggtaagagcattaactaagtatcgctcaatccgtcacttgctgaatgaagatgatttggcgatgagtgtaaagcgttctcactcccactactcgcatgagaatactgtaagcgggtacattgaatcggcttacactgatttaaccgcaaaacaagaaacgttagttaatgagcttgaggaactactcactgaaactattcgtgaattatcccgcaagttgtaccgtgatttagagaatgcatatgaggatcaattcactactgaaaacattacggcactgattgagggtaacgaatatcaattcaatgttattgatggcgtagtagaatcaatcgaatattaattcaaaaagtacttgcaaactaagtttaaaagcgtataatactttatatcgaggcggggaatggttccccgctcaaacgaggatttaaaaatggctagtactaaaacttacaacggacacaaaaacaaaactcattggaatgtaagcctttggattaataacggtgagtcattgtatcggcttgctcaaagttgcatcgcacaaagtagaactaaagatattgcagcggaatgtatgtaccgcagattaaaagccaacggtactactacaacgccggacggctttaagtatagcactactgcgatccgtgctgcaatggttggaatgtaatattcagtactgagataatggcgggtaatagttcccgcctttactgaggaatatctaatgagtaaagtaattagctatacagcactaagcaagtcattatctattagccagtgcaccgatggttattggctatttgatgaaacgcgtggaatgaatttagctatgcgtgcaaaaactgctgaggcggcgtatcttgaagcattggaatactaccaggaacgtttaacggaagtagaagaagattataaaagcctcaaagcgaaagtagatcatttcgtcggtcaattcatcgaggaagacgacgacaaacaatattgaaaaagtacttgcaattagtttttagtactgtataatagtttacatagaggggagaaatggttctccctggtaatgaggaaaatacaatggctaatatcactactctttctcaactggaagcactggttaaatctatgcgggaacatgccgacaatatcggcgtaaaagatccagccgtttgcttctgcgacgaaatgaatgatgatacactggtaatagcagaagtacaagatatttctaactattcatcgcgttacactggcggcgtagcaaataaaggtgacttctgtttataccttaccaaataacaacgcggggagataataactccccgttactttttcagtactgaatcatttaatagacggatctcggcacccggtgggttagtgactgtttcgtcttgatgtagtaattatgccagtactggatgcacttgtcaacaattattttccaaatactttttattaaaatacttgctattagtttttaaacgcgtataatgttttgcatagggggagcggttcccctggtaactaaggaataagaaaatggtcgaacaaatcaaatcaacgtcttcgaatgtaacgggaacggtagcacactttactagtgatgaatcgcggggcgttccctattgtgctgtacatgtaaacactgagggtaactactggtttacggtttacggatcttattcatttggtcgccctggacatcaaaaaattctggataaagtacaaccaacgggtaaaaatatcactgccgaaatgttttataaaaaatcataaagtacttgcaattagtttttagtactgtataatattttacatcgcaagggggagcggttccccctggtaactaaggataatcaaatgaaaattgcaatcatcgccctggctttatctgtttcctctttcgctgttaatgcgtcattagatgtaagtagtgaaaaattcattcagtgcactgttgcaatgaccgatgaaagaactggcgagattgtattaaaggatttagagatccagccggaagcatttaaaaacggcccgttccatgaagaagacgaaaacggtagcacaacaatttattatgatgccagtactaaacgcggttcggtcactgttatggatactgagaaagtaactcataccggcgttattaattgccgttgatagatactacggggtaacatcatgactaagcgaattgttttacttaacgaaagcagtactacacaactacttaacgccgtgcattatgatattgaaacgagcgttaatcttatcagtactgtcgtactgttggacactggaaaggtcgccaatgataaagcgattgcaggtatactaacggatcttgagcctggtagcagtgcaccaataacgttaaatggtaaagtgtttaacattttacttactgattaagtacatagcccacctggtgggcttttttgtttttgtagtacagtagtactgagatactttaaaaatagttttaaaaaagtagttgacattaccacaaaaaggcgtagaatgtattacatcaagacggggagcactaagtagaccgccagtaagtcgaacgaaaaactggacacgtcgagaaaactttgatacactaataaacgtaaactaaactttaattgaggatttataaaatggctaatgtaaaatcattcatcaaagcactggtagcaaatgaaactaacgtagcggcagagatcctggctgaactggataacgataccatgaaagcggtacgcaataattttaacatcgcttacagtactgcgaaagaactacaagcaaataaagcggcagagattgaagcagcgaaggcggcccgtgaagcagaactacaagcaacaattgaaagtatccaggcggcagtagttgggctggatctggaagtagttaccgagatggcacaaaaagccctggcggttaagtacggggaagataagccggaatctaagcctaaaaaatggattcaagaacgtgtagcggtagtactggataatggggaagaatatctgattccggtgcgtggtaactgcattgcggtagtactggatgctatcaaagaaagcggattgactcgcgaggaatggatcgaatctcatcgcaaagttgaagcataacaattaaagtactgaatcactagcccaccttaaacagtgggcttttttgtgtctatagtattccagtccaccagcaccgcctagaatcgattctaacgcattaaactgattatctgatgcatcgccctagctggtggcgttaaggtcgttagaatgcgattgaggacgtttaaagtattttgcaaaaagtaataaaaagtacttgcacgattaagagattagcgtataatgttttacatcgagagggggaaacggttctccttccaaatcaaaggaatcaaaacaatggctatcgtaatcactcgcgtatctggtacagttggcaatgcggcagtagtagcggttatcactaacaagaaaggtgcggaactacattttgcaatgtataactggtcagttgatgagtttggtcagtacgctagtgtagaatacattgaaacctatcaagtgccgtcgattagtttaactgatttgggcgttgagcgtatcctttgcctggatgaattaaattaaaaaagtacttgcaaagtaaatcagataaagtataatacattacatcaaggggagaaatggttctccctgataatgaggaaactaatatgaaaacttgtcaatgtggtaaaaaatctattactggtttaaagcggggcgttgctctttgtcagtaccattataatttacaagtatggggtaaagaatgggccgaccaggtggaagcagcaaagaaagcaaaaagtaagtaaaaatattatcacagtactattgacatagtttgatagtactggcataatagattttatcaagacaactgaggaaaataaaatggctatcatcactaaaatcaaagttaacaaatcactggttaagctggaagaagtgaaagaaggttataaagtatcttggtgcggcatgtatcggatattcactgatattgatgacgcaatcaattattacagcgacacggttaaaaactttgttcgtgctgatgtggttatggcagtggcaacgcacaaagcagcgaaagaaagtaagtaaaaatattatcacagtactattgacatagtttgatagtactggcataatagattttatcaagacaacatattaatttaaggaatacaaaaatggctaaaactatcattaacaccgtttccctggctgcaatccgtgcaatcaatgttgacggtaaacgttggactgattcatatggcaatacttatcattcttgtcatgtaagcgttgaactggataacggtttgaatgatctggcggttgaatcatttacttatggctatgaagatgcatatcaacaaacggcgttatctctcttaaaggaatcagtagacgggcttaatactgatgaaacctcccttactcgtgtgtgcaatgatcttaatatcccgttgcattgtactgtacagaatgttaaacgcaaaaaagatctttaattagctttactttatgcagatactttgatatagtgtctgcataggggaaagaaattaaattaacttaagaggatcgtataatgaaaaatatcagtactttaatcgatgcaggtactcatgttcgtcggtctatggttgcaaccagtactacaaaacaagtagcgagcggttatcttgtatttgtgcacgatggtaaactcctggaacgttcaatcaattttgatgttaaaaacaattgccgttttattatctttaagcgtgagcaatataaaattgatttaccagcaaagcccattagtggggcgtacaacgtgcaatcattgtttgaacgtcaaccatacacctattaatcaaaacatcgttagcggtcgattcaggccgcttatattggggattataccatgaacgttaatcaagtactgaatgagatcgaaagcatcattaaaccgatgaagcgtactgatgctatgttaacaccggaagaatgccgcctttatgagcgttacagcgtcgaacaagtccaggcaatggctatggctaccccagccgttaaaccgcctgagaatgcgttacaggacgttacaggggattatatcatcaatccagtactagggaagatggctgcaatcaccgaagatcaacaagactacttaagccagtacttaaaaggttaattaatatgcttactgtacaggataagatcgacatcttaaaggttaatatgtatgtgattgatgccgtacctggtaaagtatttgcatacgatgacactactgtaagcgatttctactatagccaggccgtgggggatctttctgtacagtcggttattgaaaacgtagttaatgcagcgtatgagcatttactttcaaatagtacttgcaattagtttttaaacgcgtataatgttttacatgaaggggagaaatgattctccccactaattaaggaatatgaaatgaaagcatcaaaaaagagtactaacaagaaagcacgttcaaccttagatggggtattccctttacgttttgttgatgaagtagtttcctacccgccgggccttactcctgagatggtagaaagtttgcgtaaatctaaaaaatagtacttgcaattagtttttagtactgtataatagtttacatgaaggggaaaacgttccccttacacctaacgaggaaagtataatggaaacaattttaatcaaagacactgctactactgtaacttatgataatgattgcattatcccagggactgagtacggcgaacgtgtacccgttcaagtagagattgataccacatacatcgacaaggctgaccagtgtatcactattgtaattggtgaatatcgttttctaccagaagagatccaaaaatggcagaatatgattgaccgtgcgaaattagtcgcacaaagtttaaaatacaaagtttaaaataatacttgcaattagtttttaaacgcgtataatgttttacatgaaggggagaaatgattctccccaagaacaggagaaacaaaatgaaacaatataatgctcggtttgatgttactatcggtaacggtaaaggtcaattctctttcagtactcgccgcagttatacagaaaacttcctgcgtaattgtgcactgaccgccgcacaaattaaacattactttcaggctaaaaaatgaaatcattagcttattacagttcggccctggtcggtgcattgatcgcggcgttgttagtaacctatctattctttatggtgatttaaatgaatcctaacggtttaatttacagtactcctaaaacgaaagcagataaagcgaaagcacgtaaagcgaaagtaaaggagtacatcaaacaaggaatgacacgaaaggcggcgattctaaaagctaaaaataaatgaaaaaagtggttgacttcggtcagccattttgctattatatattcattgagagatagctcactagcccacagggtgcaggagtgtatctattgtataatgtttgagtactgaaaactatttttaaaaagtacttgcaaactatctcaataagcgtataatgttttacatcgaaaggggaaacggtttcccctggtaataaggaaacaaatcatgactatctcaattgctcaatctaactttgaaaatgaaatcatcgctcaggcactgcgtttaaatgatggtcgggccgaaattaattacggtttcaattcaggcggttgtgaaaaatatcagtactttgtaacggctgatggcggtgtcctgggcatcaatacagttattgtaaacatacagaaaattaatttcaatgatccagacgatagccagttttacatcactggcgtagacgtgaactatgaggatgattcactaactgatgattacactggcgagaagttagaaagtgcatacggtgaagatgattatcagtccggtccagaagatttcgaataatataaaaaaatagtttgacaatagattatagtactgtataatagtttacatcaaggggagaatagttctccccactaacagagagagaaaacaaaatggctaatatccggtcgaaattaaaaaatgcaaaacaagttttattttcagatcatgaatactttaataaagatattacaggagttacaagtatcaaggaagtaaaagaaaaaaccggcgttttgtgtgatgtgcgattagttggaacatttgggaataacgtgctatatcgctgcggtgattacaattttacactgactatcattaactaaaaatattatcacagtactattgacatagtttgatagtactgacataataacttttatcaactacactactaaggaattaaaaaatggctatcatcgcaaaaactgaaatcgttggtctggattctatcatcatgacgtttgaagatcaaaaaggtatgtatgtagtttcctatggtgattatgttcgggagtatgaaacggtagacgaagcctttgaaagttacattcgccaggtgaataaagcatacgacgattaccgctaaaatatattaccagtactattaaagatattgacaacgtttgatagtactgtataataagttttataaacagtagttaacttaacctaagagagaaataaaatgatcgcactggattcattcatcgacgcagtactggcaaaaactggcgaggatctgaccgcagaacaatacgcgatgatcgaacaatgtcaacaggacggtaaatcggtgaaagatactgttaagattatccgcaagatgtaagattatagcccactggttaacgctggtgggctttaattcattaccctatacaatgccagtactaaaccgtttatctcgttagaatgcgttacaggacgtttaccaatgattagcatgaaatcagtacaaaaacaaatagaaacattatcaaaaattaaacgtaaacagtactcgttagaatatacaatcaatggtaactatcatctaatgaaagagaataattttatcgtcattgatgaatcattgcaagttattagtatagtactgaaagcattaattaatgatagaaaaaaattaaaataatctattgacaatatcctccagtactggcataatacttacatcaagacgagaacgtcactaacccatagggtgcacaaatgtaactgtataatattgatcaaaaaatgatctgatcaatacttgatcaatttgcgtaaagtagtataattctatgcagttggttagacgaaaggttatgattagtagtgcaagtgtataaaaattttcatggtgtatcgttccgcacatatggcaatgaatatgtggtatcatgtggattggaaaaagtaagaacaagtaatattattgtcgcattacagtactatagtatttttataatgaggttaaaataatggctgtaggattcgcgaaagatggggccgaacaagacgagattaacgcagtgattcaggccgccgttaaccacgctagaaagcaaattaacgcacaaatagaatcactgatacattgcctcgactgcggcgatataatccctgagaaacgacgccaggccgttaagggatgtaagtactgcataacttgccaggaggatcatgatagtacttttaaacgtcccccgcgtaattgttggcatagatctatgagataaaaagtattgacagtactatccagtagtgttatagtacttacatcaaggggaaacatcttcccctactaagaggaaatgaaaatggaaaacttatcaagtattttagtacaagatgatttcggtaatcctggaagtgctatcattgttcggggtaataaagcaacatttgttattgctggtggacctgtacagcgtagcattaaaaacaatgccgttactattaataatgtacgctatcgcttagataaagaattgattcataaactgtaatattaatttaatagaggataacaataaatgtacattcatactactatcacaaaggaagtccgttgccagttcgaaagtattccgggcgtatgtttcatcactggtacgttttcccctggtgatcgtgataatccagtactgttacaattacgccatccatcatgggataaagcatttgatctaccgttgaatgaattcgcaactactgctgaaaagtacattaaaaatattcgcgagaatgatcgactattcattaatgctttcagtgattccgcgttaagcgagatccacggcgtattggttgcaatcatggaatcaatggagaaaactaaattcaaacaaggtgaataaaaactattgacaagataatctagtactgtataataagttacatgaaggggagaaatgattctccccactgagaggaaagaaaaatgcaaggtcaactaatcgttcgtaaatggtctgatactaacgaaaaaccgtgggatgtacaatacatcggaccggatggggtatcacgttatcagcctggcgtaacgcatagtactgagcaatatgccgccgctcaccgcgaacgcctgttagaatccatgaaacagggattctgtgaaaaattcattcaagatcattggctgaaagattaatagaaggagtacagcttatgcaaatgaatccgatgattattgttttagctgtacttatgatcattcatgcaattgtagaagtattaacgcaatcaggagtaataaaatgattcaagtagaattatcagtactgaaagatctgttttatcggttaggtactactggcgagtatcctaaaagtgataccgcaaaactttttgtatcactcgacttatggcaacgcgaacaattagtaatgtcctggcgtaaaggtaaagcagatagcgaggtgaaagcatgaaagaattcttattcgaagtagtgtttcaaggtgtcggtagtaaccaactgattcgctcaagtggttacaatgttaaccaggcatggaataacattaaacaaatgtacccgaacgctatcacatatcgcaacccgaaagaagtttaaaaataattgaaaaagggattgactccggtcagtctctttgctattatatacgcatagaaacaaatcagcccacagggtgcataaatgtatctattattagctggtggctagtactgaaaactatttttaaaaaagtacttgcattgtacttagaatcaagtataatgttttacatcaggacggggaacgaaataagtaaccctgttaagtagtccaggagtaagacatacgaaaaactcccatgataaaatagtttgacaatagaaagtaaacgagtataatacttacatcaaccactgataaggaaacataaaaatgcggattctactgacagctaacgaaatcgaacaagtactgactactaacctggaagactggaaacgtgaagcagatatccaggcggttcaatggcttaacgataagttaacgccggatgacttaagcaagattgtagatcctcaattctacgaagatatccacgacaccgcgttaagcgtcgaggatgtactagataagcactacattgatattgatttgcaggtttacggtcgtaaaaactttatcactattcacgacatttacaataattaagtattgacaaagtatcttagtactgtataatagtttacatcaagtgaggggaaacggttcccctcctaacaaagagagagagaaataaaaatgactatgatccttacccagaaagtagaactgaaaattgtaacctcctttgacattaaagttaatcgctggactgatcggaacggtaacacttaccactcttgctacgtgtccgcgttaattggcgaccgctgggaagacctgggacatgaaacctttacttacggttacggtacacaaggcgaatacacgggcttggagatcattaaagaaaccgttataggtttcaacccgaaagaaaacgtgattcaccgcatcgaggaagagatcaacaaagaaataacagttcgctactacgatgtaaaacgtaagaaagacatgtaatagaatccatttaaagtactatttgacattgcccagatagtactttataatagactctaacttgtagtactaactcaactaataggatgtataccatgattactaaattctacgctacccgtgaagctgcccgtattgttgcacgcgaggaaggagcagcatttaaagacatgggcaaagatgcaccgaaaggtcaacgctgggccgtacagttcaaagaaatctctgatatcgtgaattcaccggagccagtactaacagcagcagaactaaaacgagcggatttactggcggcagtacttaacgcacaagatgaatttatcgctgattctgatatcaaagtacagacaaaccataccgcttggactcacgcggatcacctggcaaaccttaagcgtccaagtgaactggttcgcaaccagaaagagatccgacacgaccgtaagggtaatcgtgtaacagtatacagtaaacgccgccaggttatctaataacttgcagtactaacaacacggcgggatcagttcccgccttttttataggataaactaaaatgattaaggtacaactatctaaagataatatcttgcgggtacactataaagcaccacagagaatcatcacaaaggccgtacagcttgctaatgagtttattaatggtaacctattaccaaggaagttaagcaacggaaaactgcgtgtaatcgatgtagacactaacaacagaatagtaattgagaacacaggaaagataaacctatatgaacaccaacaatataataagaaaataaaactaatatcacgttgacagtactcaattgttttagtattatgtacacataccaacacgggagaaacaaaatgaaattatctaaaatcgaaaagaaaactattgatgaagcagttaagcacggttatacctttcgtaatgattcacattttaccaattttcaacaaggccaaaggactattaaaaaactaattgacaaaggtttattagttaaagtagataacggtaacggcattgagtatcagccaacccaagacgcattatctttaaagaaatatgcaattatctaattgacagtactcaaatgttttagtactatatgtacataccaacacggggaaaacaaaatgattactttagaaaaacgtatcaaagaaactacatcgctggtggaactgttaacagtactgaaatgccgtactactcggtttagtacaccggactttattaatatggttgatgttaacggtcgttatcgcattgcagtagaacaaggaacagcgaaagtattcagtactaaaaacactaaggaagtgattcacgctgtaagtgttaaaaaagtagttgccattgatagtaaagtactgtaagatagtttcattaactcaaggagaacatgcaatgcgtaattatactaaattcatccgtaccctgtcagaaatggaaaccaacaaagagatcctttcagcttgtcggttagctggtctggagatcatcggtgcgggttcttcccgtattgtattcgctttaaatgatcggttagtgatcaaggtcgcgaattgtgatgcgggtgtagaacaaaatgaaactgaatgtaaggtatggaattttttagattatgaccgccctcaattgaaacagtactttgcaaaggtgcatatgcatttatgcgatcctgataatatgtttatcgttatggatcggttgagtactgcaagtaaaggcagtgtaaagcacgtaaacgcgtgcaatgaattaaagtacaatattaaacgtaatgccattgaacgccagcaccgctttgctgatgcactacaacacgttgatgatacattatcaacactaacgataagagatatcagaaaacagaatatcggccaggatcgtaatggccttattaaagtacttgattacggtttaacccgcaatatctggaatcagtactataaaaagcgtgatgtagaagcaagtaaggtaacacgataaaaaagattaaaaaagggattgactccggtcagtccctttgctattatatattcattgagagataactcactgacccatagggtgcggaagtgtatctattatataagtattcagtactgaaaactatttgataaaaagtacttgcattgtacttagaatcaagtataatgttttacatagagagggggaaatggttctccctggtaataaggaataaaatcatgactacaatgacttgcatttacgcttccaatcttctgaatgatgcggcctttaatgttgattcagaatatcaatgttatcgggatgaaaataaaaaagtttttgtagttgataataatggtttccatattgaattacaatccggtttcactggtgttgatggtaaatcagtgtggggcgtacaggatgataaaggcacatatcattttaaacgtaattaagtattgacaaagtatatcagtactgtataatagtttacatcaaggggagaatagttctccccgatactaaaaggaaacaaaattatgtccagctactccgctactatgatcattaaagatatgaacggtaatcctacttctgctggtggatcatttggaaacattaatttagatggtcggttatccatgcaatcagccatcgatgcagcgaaagaagtttttaagaatgaatgtactgttagtaagctggattatatgggattcgctatcgagaaaactaatcgttttgtgaactacaaaaatccactgatgattgatactaacctgaaagctaacgaagtggggtacttattatgacagtagaagaagttaaaaaagtactggcagtactacgctatcataatcattgcaaggtgaagaatgatcctgattatgttgattcatccctggaggaagacacattaaacgcaataagccatatgcaaacattagcaaagcgtatgaccgaaaagaatagaccggactatatcggaaataaaatttaaaaagtacttgcattgtagttagattaacgtataatgttttacatagagcgggggaatagttctcccgtcaatagtttggagtaaaacattatgtctatcgctatcgccctggttgaagtactgaaagaagctaaagccaaccttatcgatgtacagattaaggaattacaaaatggtttaatcggctgtacttgtaccgctggtggagcggcagactatcgggaattcgaatcacttgaatcgatggtccgttatcttaccatgatcgtagaagattggagaatcatctaacaaaaaagaataaaaaaagggattgactccggtcagtccctttgctattatatacgcatagacaaaaactagcccactgggtgcaggagtgtatctaaaatatatagttaataacggtgagtaactatctgctggtggggtgaaaactattaataaaaaaagtattgacaaagtatatcagtactgcaataatgtatctcgtagggcggcaatggtgcgacggcccacaaagttaggagattcaaaatgagtacttcaatcgctatcgttaaagctttcatccgtaccaatgtttcatctgtattcatcgacggtctggatcgggaagtagaatactcaatcattatcgcacagactgcaaatggtgctcggtacatcctgaatgatagtgaagcaaatcactactacttcactaaagctactggctttaaacgcatcgatgctgacgtagtatacgctaagatgaataagctggtagacaagattaacgctaaaggtactatcgatttacagtactggaacgaaaccgatccagaatacggatctcaccgctacctgaatccaggaattaaaatgtaaaaagtacttgcatagtacttagaatcaagtataatgttttacatagagagggggaaatggttctccctcctaaattaaggagttttatcatgaccttctcaatcaattccttcgctgacgttttagtactggtacggactttcggtaaagatgcactggagtacgctgtaagtaatggcactatccaaccggaacaatgccgcatcattggaaactgcaaacgttgggcggtatccaatactattgcactggaaaacttcaacgatggcaacaatgaatattctgttgatgtagtattcgaagccgtagacctgggcggtatctataacactaacctgaatgatgtgcgtatcgttcgcactggcttcggtgcttatgatgtatctatccgtgaagctatggacaagggatacattagcaaggacttacttgctcacatcatgcagctatggacggaacgtaacgaagcacgtactatcttagggctgtaagcaatacacatcaccaaacatcataggccgctctctagcggccttaactatatcaggagtacatacacatgatctatacagtatacaacgttctaggcactattgcaggcgtacatgataacgtcgatagtgctatgcgtacagtactgcaacaggttccactaaagcctaagaccattaagcagatgacagcacgactaaccagggcgaccgatggcgtggaagtatggcaggactacggggatacacagataatcgttagcgtaacgaaggattaatgcgtaaagggatctagtactgattcagaaaaaagtcaaggcgtttttaaaattatgcgttaaaaaaatgcataggtaatcccttgacttttttgaaataaaagggattggactatggcaaaatgcgtagggggctaaagggcgggtaaccttagcgacttcgataaaggggtattacgaataaaatgttattgactttttatatgaatcgtataaaatatgattgatattaattttaagggagtccctatgcgtattttaactaaagaacagcaccacgaaagacttatcaataacatggctatgataatgtataagtcccatgaccgtggtattgcctataagcgtgaattaattatggcactattcattggaactaactttcaggaaaggtatgtcaacgattggatttggtatttaattgaagatataacgagtaaactatgaaaatgcgtattttaaataaagaagaatatcaatcactgttacgtaaaaactacgtaaagatttacaacacagacacacacgtagaacgaatggagttataccttttgattacattgggaacaaactatcagggtagatgggtgtggcaatatatggatacattgaaaaataaaatattgtccacgaggaaacaatgaaaactataacacgaacccaatcatacggtcttatcttgaaatacatggacttaatggtggatatcagcaaagacctgcctaaaactgaaattgaagttgcaagagcagagatccgcatgttggctgtactgaacacaaaccatcaggaagattatgttgaagaatggattcgatttttaatagaagatattaagagtaaaatatgattattatagaaaactcatatcaatatactgaacgcatcgctgccagacaacttgaaatcctcataatatacgaagagacgtctgatttaaacttagccgaggtattggaaaatgaaatacttttgggtgcattcttgggaacagactatcaggagtattatgaggaaaagtatttgtcatctcttgagaaatacatcaggagcaaattatgattatattaacacctgaagaatataagaaacgttttaattctgtccagactgaaatattacttatatacctttcaaatgcagaccttaacttatcaagggcaatggagaaggatttacttatgggtgcatttttggatacagactttcaggagtattatgtaggagaatactttattgcactccagaaatacattaagagcaaactatgaaatatttaagtaattacgagaagaataaaattatcgttgctgcaataaacaaatattttacacttcctcacacagaaggtttatgtgtaagggaacacaggataaacaccaccgatatacgcatgatggctgtactggggacgaactttcaggaagagtatgttgttgcacacatagttgccctcactgatttaataagggacaaatgcaaatgaaacacttaactgatgatgaatttgaaactataattcgtaaactaacccccatcacaaggatagtctacggtgaccccagccttacatggaaccaaatgcgagctaaagttaatgagctatggttgctgtactttatggggactcaatatcaagataagttttgcacagaatatatcgaacaattaacgaatgttatacaggataaactagatgattatttgctcacaaaacatgaagattttatcaggagtggagtatcagactgccctcttctctcttctaaacaccctccgcacgaacaataaactttataattcccgtgaagctgatatcgtcaacgctgatgtatatcttaataaattcatagggactaactatcaagaactgttcactctacgatatatcgctgcattgagaaacgaaatatcagataaaacccgtcaagccagaagagaatggaataaacaatgcgacacagactaaatcacaaaatgtattgtaaactattacagaatctgggacaaaaacactatgatacagtatctgaaatattaccctatgatatcatgcgtttaattcatagtgaggcagagatgcttgtactgatgacaggcactgataaaacagcaattaccaaatctatagatatgttcatcgatgcacactgccaacacattagaaccgagatatggagacgtgagaatgaaaatcctgactgagcatgagtattacaataggttaagaactatacaaggaaaagtctcgtggacttttttagataattctattgcagaagcggaccgatgtgttataatagctgaaatgaagctattactcttcattgggacaaactatcaaagtatctacatagacgcatggttaagcagcttacgtctgaagtcggtgagtttaaaatgagaaaattaataggtttcgaatatgttaagcttctacaaacctgtggaatcagaaggagaatgattcaaaaggataaaagaattgccgaagaacgaaagtatataatgataactgaactttatgtcttaacactcttaggcacaaactatcaacacacttatgtagacctatggatcgatgcactacagaaagaggttaaaagtaaatgcaaatgattaatttaacttacattgaatatcaaaaacgtttaaatgcatccagagatataaggattcaaatattcaataacaaaagattgaagcctgatatcaggaaaatcaaaatcatagaagccgtgttgtgcaacttcctagggactaactatcaggaaggtaaggtaaaaaactatcttatagaactcatgaatagtattgaaaataaatgtaagggtaattaacatgcaaatgatcaatttaagtaaagatgaatataccgagcgtatgacaaaaattacgcacaaacgtaatacaatctatcacaacccagaaattcaacacagtaagaaaatgattatgatgcgtgagttaaagatgggtgtattcttaggaacaaactatcaagatacagaagtaaatcgcttaatcgcggagttactactggaaatcagaggtaagctgtactttcatcaaatgacccaaccactgaggtgtactaagaaatgatcaacatcacattgcaagaaagattcatccgaatcaactatgcaattaccaaattagatgctactataggattccaaagtctaccatacaaaaccagattgttattagagtgtgaagctaagttgggtgtactgttagggacgcaacaccaacaacgatatgtggaaatctggattgaccttttaacccaaaatatatatgagagaatgtaaatgcaaaatgaaatgatatacttaacgaatgaagaatttcaagagaagatgttaaaaaccaaaaacattactcttaagttcgttccaaatcaatcaatatctgaagtatctgcaaatgtattgtttcagaagctaccatacgttcttggaactgataaacaagaatttatggttcaaaatatgattgaacatcttataatgagtattaaggaaaaagtaaatgcaaaatgaaatgatatacttaacctataatgaatacgtcgagagattagttcgtgccaagagatataccaataaacgtccaattgacctaaaccaaaccccagcagaaaggtgtgcagaagtattattccaatcactaccatatcttctgggaactgatagacaagaggaatatgttgcacgtatgattagatatcttaaaatcactattaaggaaaaagtaaatgcaaatgaaatacttaacagacgatgagttaaaagaacgactaattaaatcaagaaaacatacaaatcaacttccaaacgacacaaacaagtctccagcggaaaggagtgcagaagttttatacattcaactcatgtactttcttggcactgacagacaagagtattacattgaaagtatgcttcgatatcttaaattctctataaaggaaaagatacatgatcaagtatttaaaaatcctaactgctaatgaatatcataagattgtaatgaagactaatagtgcttacgctaaaaaatcaaaccccaagtacatactggaacacacatttgaagaacgtcaattagctttagttgaagcaaaacttcttgcactattaggaacaaactatcaggaagaatacaatagaaaactaatataccttttaactaaacatataagaaaaagaaaaaatgcatgaaacacttgacagatgatgaacatgggcttatagtaatggatgtaatcaacatcgaatacaaaaagttgatacgctatcgttgttatgaagataagcaactcgttctagcagaacagaagttgtttcgactcttaaacacaaactaccaagcacaatacgaagaatcgtatatgtaccttttggcgaggaaagcaaaaagagattatgaaaattttaagcaaaggtgattcagtaatattacttatagagagttcaagtaaattcttaaacataacactgtctgatatagatgaagatgacaaagaagtactgagagcagatttaagagtactgttacatatcggaacaaacctacaagaagaatatgtagagtgctacatcaatgaacttaaagaatcagtactgagaaaatgcaaatgcaaatgaaaatcattaccgatgtagaatacctaacaatcataaatggactgtttttgaagctcttcgtcattaacacatcagatataccagatatggataaaattattaagagaaatgaagtctatgttctagctacccttggaacgaactatcaagaacacgacattaaagattatattaatacacttaaacgagctattgaactaaaatgccaaaaccactaggaacagcagaatacattgaactcatgggattacacttctcatcctttcagaaacttatgcgagaatcaaagaatgatttagaatataccatcagaggttccgatttaagaatgcttctcaccctagacacagattcccaagagcgatttgtcaatgagcatattagagcacttttaatggaaattaaaagtaaactatgaagataatatcaaaccaagagtacttggcactattcaggaagaataatcacaaatatatggcacttgattcaagaactgatataagtgaacttgaaaaaaatcttttgcgttcagagatgatagtactgacactcttaggaacacagcatcaagagagaactgttaattcacacatagggattcttatgcagatagttcaggaaaagatatgagaatcataacacaacaagatattcttaagttcacaagggttcatgcatctgaatttgatgctatattatcaaaaagttacaacaacccttatacacaagatgtacattacagtgaattatggatgtatatacttttaggtacaaataagcaagagcaagccgtacagaagtatttgacagctttacgtgatgctactgctaatggagtatgtgtttaatatgaaagtactgacagaactagaaatgtatcatagatttaataagtactatcatttacttaagcctatacagaggattaaatgtccatttgaagagaaacaggttttaatctatgagcacaagttctttgtatcattaggtacagatcaacaagagtactatttgacgttgtacttgattacattaatagatttaattcactataaaaccaaacaagctaataaagagaaatatgaaaactaatatacaactcaaggtatataaatcatttgaacatacatatatcaaaagtagtctatgtagagatgtaatggattacaagggtaagccattcacaattacctatgattcttatgttagtgatttatatatatcatttgttaattacgaaaataaaatatacaagcacgttgatattaaagatttaagtactttatcaccagaggaatactttcaggaatcattagtatgggatttagagtttcctatgccattagtacataagatgatagtactaatgaaagaatctaaacaggagcctaatggtgattatgaagaacacacagttgagtactgataatattaagagttatacaagctcaagtactgtgacaatcgaagtgaattctattaatgctggtaatgcagtagataagttctttattgctcaagggtacaggaaagatattcatcaatattgttcagtatatggggagtacaatagtactgaagatataatttattggtcaacacatcaagattatataactaaaattggcgttccagatgttagtactttatctgaagaagaatactttcagtacagcttagtacatgatgtacctatacctttagggttaatcaagggtatgcaggaagaggttcataagcttaaatccatgagttcaggtactttcattagaacagtgcaatactagcttgacagtacttttcattactgatatagtacactaacgttaatcatagggtaaaaattatgttaaattttttaaatttccttatcgttttgtgtattgttcttgggattgcaccatttgtattgtatttcatggattcagatgaaatgcagaagatgaattgcacaaggacaggacagagtagagaagagacgattcttatgcctgttacggttattgttaacaacatgcccattacaaacatggtccctaccctaacgacaacgtaccagtactcttgtgctgacggagagaggtggagatgaaatttaatatagcaaaaacatcgagtatatgtatttttggttatgcagaagagttaggtgatattgacattcttttgtacaaaaaggatggtgttatgcatttcaagtaccaggatgaagaggcagacaattatcctttacctaatttagtacaaatgcaggaagatgaattattccagtacagcttagtatacgacattgatatttgcacgatgccagtactaattagtattcaaaaagtgatgctcgatatgtatgataagctaatacaaggtatgtcagggaggatcattgaaattgacatataagaatatacctaatgcatatgaaatgaagtacagggagtttattaaaaatgtacacaccgatccttttaatatcaaaatatcagattttgatgtattattttatctagggacaatagcacaggatcaatgcgttgataagctcatatggtccttgaaaatggagatacaatgcagacccaaatatataaaaaggtagattctttattgtacgcttcaaagtacagggatttttgtttacgagggggagaggaagatttctctctgagattatctgaatttaatatgttattttatcttggtacaaaagatcaagaagatacagtacagaaatttatcaagcaccttgaacaaaaaattcatatgcaaatttttatgcttaaggtacataatgagataaacaaatatgaacccaacaatagtacaggatcttaaacaagtaatattccttttgaataccagaagtgaattgtatacagagttaaaagagattaatgcattttatcagaattttgtaatccaagagttcagtgatttaattacagatgcattatttgaattctcggagaaatacaaaggaacagagttcagtgttaagaatgttattcgtccaagtacaaggaaaattatattatcacattttacatttgacaataaagatttattcagtcataatccaagtacagctttatattttattcctgattcagataaaaatcatcctattcattacggatggattttgtcatatatagtacaaggaaaggagtatcctattaaatggaaagattagggcgattagattattacacaattaatacaaattatttgttgcgtaatataaaatccgattacaaaatatggataaagaacagagatagcatgtgttatgaattttatttagattatgctatcaaacgatttttaagagaagaacattaatgcaaaagattaatacgataacattaaatgcattacaggattcattattagatagtattaagatgtattacaatatacatttgaagggtggtattgataattacgattattatttgagtttaattacatttgagcacctttcagtacaggacaggattttacatcctacaaatcctaggtatccatcgataggtaaattatgaatgagatagagttattagcacacaagataagtacaataatgcttatcctcaataacaaccatcctatatcgcagatagatggaatcctgagtcagaggacaggtggtagtttatatttgtccataaacgcagatatcgcaaggaaatacattgatattgacattgatgttgaaatcgaatatgatacaacggggattgttggtgtaggtgcattaatcagttcaaatccagtatcagcatccccattgaccaaagatgttagtacaggattcgaagggtatttgtggtacaataccaatgatgattattttatatatcagcattccaatacaaattatgatgaagacaaatttcagttcatagacccttatgatgaagctggcgtattccaacaatcattaatcacaaaaccgcatgagatgatgtatctaatgttattcagtacaatgcatttgaatccattaattaaaggtttaaaattttatattcaattaaatttagtccatgtagtttatgatttattaatgcaaggatatagttatgaagtataaaatgatgtataccccagatatgatttatgttgaattagaagatgatgacgatgggtggaatttgatttattcaagaagttcaggttggtacatggcacatttaaatgattcgatagttacagattattttgtagatttcaatacattatccgatgaagaattgttccaacagcaattagtgattgacacgggtggttatgatgtcttattattaaaaaagatacagaaagctgttattgattttaagcccatgatatggcaaaggaaatattatgacctcgaagtaccgtaccagcaatgaaattcagtacacctacgctaatgcaatccttatgggacaaaagttagcttgtattgttgcagccttatataatgcccagaaatatcacaagcgtcatttccacaaatgtattggtattattccatcgaagtacaatacatatattgcgtgcacgagtcattttgataaacgattcaatacacctgataccccaaattcccgtagtgttattggtcttttggatttcgcacctggtgctgttattggaaagaatgatttagagtacgcatggtataataaaaatgccccattagtaatggtaacatatgataaagaaacgaacaaaacaatagagtacaatacatataaatcagaggaagaatttttccaaggttcaatgcttgtaccagtgcgtttgttattttataatgtcataatgagtacagtacacaatagtccattacacaagaatcacaaaattaatttcaatttttgtgcttatgcgattgatggtgtgtatgagtgtttaatggaggtattgagttatgaagctgaataatacatttgatattaataagttaagagaatggttttatagtattgaaattgaagccatcccgtatcatagatatgaacaatataatttaaccagtattgatatcagtgagttgtacgcgtattatcaaagtgcattagagatgcataagttatttttgagtacagattttgttctaaattacaattttgaggaatttaataattataatttagtacagaaatatgtagtagcaaagtatatgtaccttcaaggaattacaagtaatttggaattcaatacagtccttgctttagttgaggtaattttatgcagtacatgtatgatttagagtttagtttagatgctgcatttaaatatgttcacaagatagaaacaatatacagtacattatgtgcaatacaatcagtatcatctgagtttgatgttggtgaaaaatatcaggtatggaataatacatttctaaacaaagaacgttgctctacggggtttaatattttaacatttaatcccagcaattgttacccagagaagcatgaacgttatccgaatgacgacatgtggtttgattacacaaaagatggtgatatgtcatcccttgtagttcctgatgattttaatgccgaagatttaacggaagagtggtggtttcaacagaatttagtacacgatgatattgatttatttttttatgtagtatttaaaatgctttaccacaacaatatattaaaagatagtgtgtttttttcatgtctatatattgatgatttatacaatgaaatccaaatcaacattcccagcacgcctgtatcgtaagatatgggcttttttcgttttggtattgacaaagaagtgcaaagctgttatcatgtgtaatcattttaaaggagaacatatagtgagtttcataatcccaagtacatacgaagatgcatcaagtgcagttcataagattcattatatttttaatttaattattagatctgcaaaaaataaaatgtatgcacctcttgtggaatacgataaaaatgaggaaatttttgttagcacagaccaaattatttttccatatttcaatgaagatagattgtggttcatgcatttagctgcattacaaaaatataaaatgtcaattcgtaataatttggatataccgttatatcatcctgatattggagaggatgaatattttcagtacagtacagtacaccgccatgaagatatctttgttgctatgcttattgctaaattgaataccgttgatttggagcagtacaaatacaataataaatcatgtaagatcataatccctgcattcatagctctttatgattatgtggtgcataacaaaaaagatgatacatatgctttcaatgaagagtatttgaatttttttaaggagaaaatatgagcagtgaagtgcagaaatcaatgacattcaatgaaattggtacatttaaagataagatcattgattgcattgaatacatgatttgtagtaatatcgaaagtatcgagatatttaacaagacaaatcgctcttaccatatgatgtacattgcaaacaataatggtatcattccatttatttcggatagtacaatatggtacgcatgtgatacgaaaaaaaccacaataggtttacatttatttgagacacattatgatctaattattcctgaacattgtatgcaagaagaagaatattttcaaatgcaatgtatacattcaccattagtgttgtttagtttatatattataccttatatcaccaaatgtgttcatgagaataaagctccgtggaatcatgaatttgtatcgttgaagttattgtataatgtattagtagaatattatgattacaggcacaatggtacaatcagtgatgtatgggattttgaatcgctaagggtgaaaacatacacaggtgaatgatatgaccagaattaaaatgtatgatttgatgcagtacagtaaaattgccattccggtgcttaataaagtgctggatgcattcattgccaaataccctgagaattcagtgttatgtattccatttagtgttccagataaagatgatatattccaagtgaatgtcagtacacgtggtattacattacagcagaaatacatggatacggaatattatggaataaagttggattcagtacagggttcaaaatcagcctatgatttttttgttcctaataatatagagtcatgggaaacaaacatttcaaagaaagatgaaaatgatgttcctattagtggtgtgttcaacaataaagttttttattattacgaaaccgacaaattccctgaagagttatattacaattcagaaatgaatgaagatgtagatgcattcatgtttcaattatctttagtacatgatatcattgatgttcaagagttaagagcagaaatcaatttagctaaagagttatcggacatgctgccaccgtttagtatgcttttttgtgaaggtggttatttttcaaaagaagtgtttgaacatttcgtagatgttgtaaaagggttggatatatagtatgcttacagttgatgttaaacaaaaataccgtaagtttgattggttcaccgacagtttccagcttgaattattacatttgaatatctgtgaaacattatgtgcagaaacacaagatgaatttgatgatagagtgatgaacatagtaatgctttcttgctttaaacattttggttattttttcggacagaattgaggtaaaaaatgcatcaacacaagcatcattcatatgattttgcaattaacattatgaagttcattcgagcgttggaggatgggaagcttagtcataagtacaggaaagagggtaacaattggttcagaaatgattccgagttcagttgtcataaaatcgtgtatagtaatcagtacagtgccaattacctacaagatgtagtgatgtgttttgaatacgtgttgcagttcaggggttcaatccaagatgagttgatggagaacatgtacatccgataccttccaatgctcaaagatgaaaatgtattattaaattcaatataccaacgagttcgtgaaattgagtgcagggatatattagatacagaagaatcgtatttccagcaatccctgatttattcacctgatttattacaggtacataatttgtttaatacattacgtcagaacatcagtacagacatatttttgtcattatcggattatgatacatttgtcaaagatttagaggaaataggtttatgagtcgattttcggtttgtgtggtaaacataaaaagtgatggtagtttaattgaattagatgtatatgatgatgataatgcatatggtattaaagtacaggacaatgatgtgcagttcagttcaagaacaaattttgaaaatccagtccaagttcctaatttcatagaagatgaagcagcacgttttcaatacgaaacggcatatgacaatgtacatatgcatattattatgcaacaaagtttagttcaattagttcctttgttcagacaaaatatatatgtacatgaattgtcgatcaatgacgttcgcagttccgtattgttcgatacaaatatgtaaggaaagtacaatgagttcaatgagtttattagatacattagaaaaagacagaagtgcaattaagcgtttaaaagagcaagtacaaaagattgtatacaacgttgataagtttgaggttcccggaagatttggtgatatttcccatacggagatcaaatcccttaagtcagatttgttgattaaaaataaaaatgggttgattttagttttgagttcagatatgatgggggcaacacatagttataatgcagtatcggtgcgttccgagtgtgaaggtatatatctatcacagggtttcaatagcgagacacaggtttgtttttgtgatgcagtacatgaccctatgaagttcacgagaagtgaagcccaagcgttattagagctatcagacgagagtttgtttcagtacagtacaatgtatgacaatgataagcttcgttgtatgtacgctgtaaagcattatacacaggagttctctggatttgcataccttttagttagaaccaataccagatatattgatatgttagaagattacatcgataaagttgttaatgtatgattttgtgatgggatgatgctaatgaaagagttatttgaagatcagttcaatacatatgtggataatattctttattccagtcgtgccagtcaacgaggaaatcgtgcttacaatattgattacctattggtggtgctgagttcacagtacaccaatgcggtacaaagggtttattatgaaaagtgcaagtaatagtgatattgcaaaggagaagtttaagtgcagtttagattacggtttaaatgattttcttacatgcacaatgtacaggaatgatgattatgaacaatccgtaatttcgttgcatcgatatttcgaaataatttacgcaagatatcttagaaggttagatgggataggggattggaattatgattacgtttgaagaaccagaaacaatgagtccatatacgatgaaaggttttgaattcatgatggattcgattttgaagagttcgtgtttagtacacaatcctgagcgtgcaacagtgagggaatatcaggacaatgcattacagcgtgtaatgaatatgtacaggaatacgagtcgcaagctttgtgcgttgaaaaggattgaagaaatcaaggtttctaggctgaataaatagagacgtttcattttgacaggccgctggagggggtcaaaaaaatttccgctgaaaaacatgctaaggtatatgtttaatataaagttttatattgtgtttttcagagtacagttcatgtttccttaaacaaaaaaataccccgccaccgaacgtgctccttatattggagtttaccttattaattatagtagagagtacaatggaaatgaagatgcaaataaaatataatgaattttgtgcaaggacattcatgtacacaggtgaaatggcgacgcattgtaatttgtttaaaggtgacttaaactacgctagggacaagattttaaagtactggaatgctaacttttatttgatggattttagtactgggtttcatgggatatctatcgagatgccggactatacattactggatgatgctgcactgtttcaggaggcattagtatttgaaaagaagtacatctgtacattagaagagatgattgaattacagcgtagaattaaatgtattcacagggaatgtatagatatctggtgcaggactggtgatgttgatttctggaaattttttaatctaggggaagtgtgatggaatttgattttttaatatcagtacattcttttaagcacagtttacagtacttttgtaatttaaacaaaggtgatttaatgcacagtgcgaatgagtatattcattttactgatggtaaattctcatttattgattacagttcattagattttccatacactgatatgccggactatacattgatggatgctggtgaactatttcaagctgcattagtatttgacaagaagtacatctgtacatttgaagaagtaattactatacaaaatgaaatgaaggtgtatgcatcgttgaataaacctaatgaatgtattaatcaagaatacaaattcaatataggaattccaaaatgacatatgattattctatgtactattataagttacctaaaggatgggacttgtgctgtaatcttattaagggagactcggaacatgagttgagtttatatatgcactacaaagattcttgttttaaatttattcatgtattacatgatggctatgactatgaatctgagagtcttatagattatacagtactggacgatggtgaactatttcaggaagcattagtgtttgataagaataagtactcctgtacatttgaagaaatggtttctttgcaaaatgaaatgaagagatttgaaaaagaaaacgtatttaatccatccccatcaagaacgaataattattatttcaatatatgagattataaaatgacattacaaagttcattggaaaaagcaaagaagattcatgagtacatgaatatggcaaaagaaggttcagtttacggtgttttcaaagacacaagtactcaatattatgtaccggataacctccttaataatgactactcagatacagaaacgtgtgtactggatacagaaacgtgcatactagataccgaccctaatgattatgaatgtttcattgatatgcataatgagtacatggtctatattaatgatgcagatattaccatatacagtactgacagcgattccgatgacattataattccgagtgaagtactggaaggtccgtgggatagtgaagagtattacttccaacaaagtactgtatacgatgatgaagtacttgatgttattataattatgtggtactttaaaagtattggttctgggaacttctatttcgattacaaatacgtaaagaaaactgtagataacggtattaacaggggttgaaatgagtttagaaagagcattagagattgcgaagttaattgatttatgcagcaaagaaattgtagcaaattgtctcaatggatatctattcaaggaaggtaaatcttattgtcgaatgagatacgatgacagtagtgagtacattcacatgtatgaagaaaacttagattcttctgaaacaacactcaatgggtgtgatgttaatttggaagataattacatgtacttctgtcgtgatgctgatattttaatacaagattctgacattatatctggtgcagcagagaaacatcttccgtattcagtactggataatgactggggaagtgaagagtactacttccagcagaatacgatctacgcagaagatgtacttgacaagcttgtcattctgtggtactttaataatacagattgtcctagcttctatttggacttggatctactacgagttattaaagaggatatatgagtttagcaagtgcacttgaactagcacacagaatacatcacttccacgataacataaaaagtgggttctatggtgataaagtaagtgcatttggtgatgagtattatctatcaggtataaagacatactctgatgatattttacttatgggacaggataaagacaatactatacagtactcttcatgtagtcaatatactagtttttttgtatatattccaggtactaagattacgtttgacacatcaaatgcacctgttgacttcggggtacttgatggcccgtggggtactgaagagtattacttccaacagagtttcatttttaaccaagaaatgcttgattccttggttgtgttgtggtactttaaggaattgaattttgaaccattctttcttgactggggagcatgtgaatatttaagttcaggggatttgtaatgtcgttacaaagtgcattgaaagaagcaaagaagattcatgagtatatgattatggtacaagaaggttcagttccaggtgtatataaaacatctgatactgaattttttgtaaaagaccgtgacgattatgacgagtccgagatatgtgcagaaacattagtactgcacactgatactggtgacagtgataactgtgaatatcatatgtacaatcagtacattagttattgccgtaatgaagatattaccatctacaacactgatagtgatgctgatgacactatcattccttattcagtactggaaggaccgtgggatagtgaagaatattacttccagaatagtacgttgtacaatgaagaagaattagatgttattgtaattatgtggtatttcaaaagtattgactcctgtagtttctattttgattatgaatatgtagagaatactgtaggagaaggtaatgtcattacaaagtgctcttgaaaaagcaaaagaactacatggatactttgacgatataaaggcaggaaagttcaaagaagtgtacaaagccgagaacggcaactactacaaggatgaaatgtataataactccgttggtgtaagggttattcttgggttgaattccaatagtcctatatcgttttctgaatacaatagagatgcagaatttattagttatgttgaaaatggtagcattcgttttattaatcgcaaaaaaccattaattttgaattatgaagtactggaaggtccgtgggatagtgaagagtattacttccaaaacagtactgtttacgatgatgaagtacttgaagcattagttattatgtggtacttaaagagtgttaactgtcctcgattttatttggatttcgaagaacttcgtaaagatccagaaggtatagaatgaaaaacttattcagtgttcagtacgtccctggtgaaattagtttattgtatctgtttgatcatgataattcattattactagtagtaaagaaatgccaagctagttcgtttgttgaatacattcacgatagtgaatatatacctgattttttagagtgtgattattacgatgaacatgaatcatttattttccaggaatctctcgtatgggataaatcgatcaacttctttacgttaattgaattacaaaagcaggtgaagtatcattgggattatttaatcacacaggattacattgagatagaaatataatgactaaaaatgaatttgattcactttgtacggtttataattcattgacagaaatacctgactttattaattacatttcagctttaaatcaaattatgcatagttttgaacaatcgtttgaagagaaatatgctggtagaaaagttctatgtcatatgtcaatgtacttaggagatggtgagccttacactacaagtactacatgtgaaataaaaaaatataatatattattggggacaatagaattcacagtatccaatggtggtagttatatgtactttagagatggagtggttgaattattatgagttacgaaagtgcaatcaagaaagcaaatgatattctacgcgtcgttaaattcttcaaagaaaatcctgaatacttagctgatgaaaaccatgatcacgatgagagattgagacgaaaaattgtcgctttatttgacactaatgcggataattatagtctaattgagttagcatacgattatatttcattgaaccgaaacggcaatatagttaatatagaaagacatgcaactgaagaatcttttaaaatttcagatattttatccctgagtactgaagaagggtacttccagggtagtactgtttatgaacaaggaacacttgacaatctatgcacattcagtgtaatatatcagaaatctgtactagatgtattttatcttgacactgctgaactggatacactaaccaattttgttactactgaagaggctacattcgagtgatgaaagttaacatcaatgactttgatgcattacaagatttatcaaaaaagattcgcaccattgtaccagtactcaaaaaatgcagtactggtttaatcgatcctagtactgttgttaatgagaagtacaattttcattatgtattacagggtactggggcattccagaagtgtgaggtgcgtgagacacacgtaattgatacatcattgttttctattggtgcacctgtgtcgaataatactattttcctagacaacgctggaaatattcaacaattaacatttaagaaaaggaaaaagaacaataacattggtgtgtatgcgatgaagtggggtcaacctgatttgaagcgtgaaattcacatccctaagtacaattacaatgcatttgacgaacagtgttttcaactatcgtgtactgaccctgactatgctatcattcagttctatatggaattgcagatagcatttaacagtaatttgtatattaacttattggcgattaacattgatgaagtattcaaaaacatttaatcgaattgaatacatgagaactgtgagtgcagtgtgggacatatggttcactactaaaccaaaaatggattaccatgactttaagctcttgttcttcgttggctctaacaaacaggatgttgcaatgaagggttatattcagcacttacaggaactaatccagaagagaatatatgaaaataatagaccaaaatgacattgctaaactattcaatatatattctactagaatgatgcaaacagactcatatagtactgaattcaaagagttgaaagtcctgatgtacttgggaacccaatatcaggaacaagttattttggaatatattaattcgctgaagaaggatatccgttatgtacgatgatttagatattgcgtttgaacgtatggtaattttaatgcaatgtgcagaaatgcatgaaacaatccgtcgcaccaaagggattgaatatacaagtaaactattctcatacgaaagtcgtcgagggatggatcatttttactgcactgattgttcaaagttttcagtactgaaatattatcatcctactgtttccaataatagtttaatatccacatatgacggtgatctgtttagtgtaatgtatgacacattacatccatcaatttcaatctataaagattgcgatagtagtttatcgtatataattgaagattacttatctcctaatactgaagagaatatttttcagaacagtgtgttgcatgatgaattaagtataaaatgcatctatatgttcaataagttaaaagagtacgccgataataattacttaattgataagttagcagtattgtctgtttccgtttttaatacaaatgacattgatatgaaatactataatgagatttgtaaagtacatcatatgtataaggaactattatgtcaataaatgcaaataaatgttgtagtgcagatgtgcatttgttttttaagaaattagcaaatgatattatatatatgcaggaaatgatttatcacaaacgagcggatttagaaaaagcattagtacagttctcatttatgcttgatggtgatatatttctagagagtgatgcattgcgaatagtattagacaaaaatgctaaaagatttttatttcatatagataataaattatgttcctccgtatgtcgtactttttataatcgtgattcggacttatatcaattcctttattctaaaggtgcagtagaagcatcatatggtgatggttatgccctaggaaagagtattccatttatgaaatcatttaaaatagaacacatcagtactgatgaagatgcaatgttcacaaatgatataactatgggacgtgaagatgcaatgcgatatattacaaattctatgcatacattctttcaacgaacagaatttgataatgtatatatatcaaatgtaaatattttcaatgacctgtgtcagtacttgagaagtgtttgtgacttcgatgaaagttattgtaagctatacactgaggtataaaacaaatgaacacattaagtattacatactatacaactaaaaaattagttacttgtttaatatctttgaagacaaaccatgatgatatgtttgatatggctgcatatgaattagaattatcagaagatggcttcaagagctatgaagtatatagctatgtccgtgaagatgtaattgacactacactaatgcaagaggatgagttattccaagaaagtttagtatgggataataagtacgattgtaactttgatttcttatgtttaatccagaaagaaatgaaaagaatctttgataattatccaatcaaacgtttcagtactgcacctgagcaatataaaaggattatattcacctatgaagattgaatttgaagttattacatatagtataggtgatggtatccgttgctatgtacaagcaaggcatatggttcctgatgataaactgtcacccaaaagcttctgtatcacacaagatctcttagatatcaacggagagtacaagtacatatattatcttactaagggttattgtagtacacgtggttttaatattgtagctgtttctagagatgaaattgatgatttaactgagtacggggaagaagagatgttccagtacagtactgtttttaatgaactggatgtgtttctgttacgaaaaatacaacacattatgcaagaatgtttgcatcataagagaggtattgtatgcgacgtgaatctgaattagttaaagtaatgtacgctactcatattaaactactacttgttaaatttgattataataaaaaacataatgatttctatactttaattcgtgatgaaaatacattctccttgcgatgcaacaatatacccttgaagataaatgattttacttcacttgacgagggggaattatttcaagaatcattagtttttaatagtaatataaaaattgatatagaagttattaaaaaataccagattctattgaacaaaattatgaattgttatccatgtgaaataggtggtcatatgcagttcaaatcaaaaatgtatgaattatgaggtttatatgttagataaaaaaatgaactctggaacccaatataatcatcttaagttggatacattcgaatcagctatcagtacagcacaagatataattgatattatcaagttcattaaagaagataagttcaaatgtttgaaaatactaaatcgttcaatgtaccgtgataaaaatattcatgtatcagtacgtagaccgaaagatcaagaaagtgggagagatttctataacaacagtgagcagttcgaatgtgaatatgatccagaatttagaggtggtttcatgtgttacagtatgaaggatacctcacacattgagatacgttcatcgaaaggtggcatacgtacattagagtttattgatatagttttaaatcaggaatactactttcaactatcattattgtttcctgcatacgatttaggagttctattcatgtataagtactttcatgagcactggaatgaagacttctatctggacttagaagattaccaattagtttgggaagaaatggtagaacttcgcaaccactcttgacacccaccgattttttgtgatataatccctttatattaattgtaaagggttataacacaatgtccaaagacctatcatttagcaatgcacaaaaaatagcaaaagacattatcagggtttataaattccttgcgaatgttactgaagattttttaattgataaaaataaagttattaaacgaaatggatatctttcctttatggatgggttactctatagctcagatgaatcaacttgtagtattagagtgcttgatgaagtaccaagtggtgattttatttcataccatttcccaagttcagataatttcaaatactacaatcatcttcttataaatgaagcatttgatacgattgtaattaacactgaagaagagttcttccagtacagtactgtgtatccagagaggattgttttcagttcagtgattttaacagcccttaaaaatgaactaaattccgatagtgatcatttctacttggacctgaacaatgtcgattgtattattgagtacctggagaaaaatgatttatgattactacagaatatgattacgatggtgttttagaatttgcagaaaatatctatcgcattgcaaaggagttcagaagtcctaaaccttttggtggtatgtttcaatacgatgagttcagttcatctaaaggaagactagcatttactaatggtagaggtaatcaaatctacgcggagtactttgatgataatgactttcattacaaagcagaatacatttcatattgccctgggtctgatttgaagattaatattgatacctttagagattcagtgcttgtcccttatagtgagttagttttcatgacagaagaaatgtactttcaagagtcttgtattcatgatgtaaaagtacttaatgctatgttattttatggtgcactacttcatcattacaaatacaaacaacgattctttttagatttagtagtatactataaatgcgtggattatttgaatgcaaaatacgacaacaattcagtacatgactgatggtactgaatactttgtttcaagatatgtaatcaaccacaaccattatgtaacctatattccagagtacaatcaattttatatccagatttatcaaaataatggaaagataaatgatatatattcagaaataaaaatccctgattatagtactttatcagaagaggaattatttcaggagagcactatcagtactgaagatgtgtacgaaataatggaataccagaaggtacttaaacattttcatgaagcaaatgatatacaaatcgatattgttaaaccgtggtgttacaatacatatgaggtaaattatgttagaaatgattaaaattatgcaacgctgtcttgttgatcaacacggggtatatggatatcgtttaagtgctcctattgacaaaaataaaacaacctatgtaagctataatgctgtacatggatttgatatattcattgatgccaacaataaaatcaaacaagctaaggatgtgtctataatgacccctgatgagttattccagtacagcttagtctttcctacatgtatcgatttacaacgtctaggagcgatacagaaggttttacgcgaacataaagtacaacccaataaagtcacacacattccagaaacaatcttcaaaaccatagaagtagaaactcctgattatatgttaagtgatgatgagtactacgagaaacacttccctggtaaagtttggagagactaatgaaccgaaagtacagagaaactatgaagttcgctagggagtgtttagaagtgtttgagttcatcaatgctcataaagatttactccatagatacattgcaatcagtgagacagatgaccataggtacatatgttctcgaattcaagataagatatataagattgtgttctcggaaacatacacagatacatctaattcactatatgattttgcacgtactgattacgtttcatacaaatcttggtctgatagtattaaaattgtgcacaagcaaaatacattttattcttttcttacggacatttccgaagaaagttactttcaaaacagtttaatttatacagaaaaagaactcaaaatgttatatattatgtcgtactttaaaaagtactgcaaatttaatacattatcttttgagatttctgcaatgaaagtattcattaaaaatgtaaaagaattaaagagggcttttaatgtacatagaaaatgagaatgtaaaatgcattactgacatttgtataaaattaatgaaaattttcattaatccaaaatacaaaaaacgttcattacatcataatattgatgagcattgtaccattaatatactaggtagtattcttgatgtaaaatatgatggtaaaatgttattcggtataagagaagagaaaatagatgatgcattcttttcctgtaaagataaatttgaaccttctgattataaagtaattattcgtgatgatagcatctacattagtagtgattattcaaattacttcgataaaatatacactgaaaacgttgactaccattatgaaatgatagatttaccagtaacagacattgatatggagagaatcaaattttcattatcagataatgagtacttaggtatacaaacatattattcactacaaggaaagattccacctgctatgtatataaggattgagattggtaatgtattcaatgataaggttatatcaattgctgataaaatattgagggttgaattatgaatatcaatgattaccaatttcataggcttgaatttcgtcattgtgttgcatttgcaaaaacattgatgtgcatcattgacactctttcatccaaacaatttcgtaaggataatgatttatttctgaaaaaaggtcgtgtaacatcaaccgatatcggtattgaactatttgttgatatcagtgttgataccggagacagtacaagggttggttgtataggtcatattggtacacattgcttcacatggaatccaaatacaagtcaagtgcgaattgattatagaaattcacgttgggttgatcttagtactgaatcagatttagaatcagctatgttccagctaagtttaattcacaatcctaatgaacttctttacattattactttcagttatctgttacaaaactacgataatccatcagggtttttcatagaatcggatatagaagaaattatggcagtgtttcctagtttaaaggatattctggaagaaaaagatttctatgaagacttcagagatttatacgacatgcacttggagttatttaagaatggataaagatgatattctaattagactaattaatagtttaataaagttctcaaataatgatgtcgatacatacaaagtaggggatattgaatttaaatcatttggtatgtacggtgaggataaaacatattatgcgtcaatgaaatttcaagattttcacgagatgttaatatcgttatcatatgaagatgttgatccaagatggagttccagtatttcactatcgagaatggtaattcgtagtaagcatcgttatatttcgtcaaagaatactcctaacttgattaatattgtgttgaatgaaaatacaaatcccctatctaaacatgatatcgtaccgttaaccgatgaagttctttttcaattgagtaccatttgtgatgaagatgtgatatcatgtatgaaaatttatgagaaggttgggagtgatattcccatgaactattacctaactatagatggaacgtaccttcgagatgaggttctagcgtacattgacagtgttttaccaaaataaagacccgtatgggtctttttgtgtttatggctttacaagagcattcaggtgtgttatacttgattttaaatagagttggaggaatctatgagtactgaattaattaaagaagtcacattacttctgaagcattgttttaagttcattcctgatactggttcccgccagtacattaaagtcaatgagaaatataacatcaatatccttgcatccgaaactgcaagcagttatgctaacattgagttggattctgaagaaaaatatacagtattacaaatcatatcagatgtacaacgtaaacaagattatcgttcttcattttacaacgatcatctgtgtgtttgctcaaacttcagtgagaataaaattgtgtataagaatttatacacacatgaagtgattgatacatataattataaaatttcatctgatgaatacaatgttctaatgttcaacgcaaaccttttgtatgatgccagtactgtacgctgtttagagttagcatataaaattccaaagatcatggaaagaaaagatttgattcactttaaaacaattttaaaatacagtacaaaagaattagaggatttagtacaggctcttaagaatttcattaatgaacatgtacctgttaaattcgaggatgcacaatgaaccatatcagaactaaaattttgagactcatgcatgacattgcagaactttcagagattcatgacattacggaaattgttgaatttgataattatcgactgaaaattgaaaacaaatccaaacatcgttttggttcagttcagttggatgtatataaaacttatgaattttctaaaaaaattaaaagttcatgggatacgattactatgtacattcgcacatccagaaatcgtgaacgtattggttctatttcttataatatggtatttgcgaatgcattacatgaaaaaatgaataaaattgtagaatctgatttcagtgaagatgatggttttattgggttggatgttccaccagaattagaccaaagtgaagatattcgagatgcattcattttccagaaatcattgttggacaattacaaagaattcgagtacttaatgctttgttacgatactgcaaaaattcttgattgtggtgaactagttatgtacaatgattttatcaattgcaagactgatgttctgaatacactacttcaaaatatagaatctgttaaggaaaaatatgaacgcttatagttatatgacagaacgccatcagttattatatgatatcagtaaaaaaatgctatcaattgttggtagtgcgaaagaaattgaaaaacaatatctcatccgtgatgtatcaatttcatctaaatgttggtcaaatgaatattacgaccacggtattcttactatttctggggccagaaatatttgtattgtaaaaaataaaagtaaaagtaatgaagagtgtgagattagaaccgatatacaaattaaggatgatggaagtttttcacatcacccattccatattagtactattggtgttttatataatattaaagtactattcggtgatgaagagtatgtgttaaaagctatcaatccagattcaagtacagttgaagaagaactgttccagatgagcactgttatacctgaagaggttcttagtactgttgttttttgtagtttaatttatcatacatacaaaaagaaccaattcgatttccacattttaggaacgtacatcttcaatactttgaatgttgatcgtttaaaagcattaaatgcagcaatggataaggtgctacaatgacaagagatgattgtttgtacatatgggatataattgaaactacactttcaaatccagaaaattataaaacaaaaaaaagacaacgacacaaaatatggatagatttgttcgttgagggcatacacgcagtgactatttgggattcaccgagggcatcagcatctactctattggacaatgaatgcattgattgcattaattccacttttcatctctacggtactacatttttcggtacatttctggatattgaaagtaaagatgatattgattcacttgcgttacaataccaagtactgtataatactaaattaatttacgatttagtactagcttcttatgtgtataaattaatgatgaaatataatcatatttctgtttcagtttatactaaggatattctttcattaagagacaaaacatgagtttattaaatgcacgcgaattagttgagatgtatgagattttgtcttcatataaaaattctcatggagatgtgattctcgacaaaaagttccatgtcagtgttgaacatatatcaaatatagatatgatttctttggtggaaagtaataagtcaggtcttgaacgcgatatcatgcgtttgatttatattcccaaaccatcatatactaatgatagttcaattagtaatgagacattcatgtatagtcctggtacggattctactatagtatcgctgtccaataaatcaatgggtactttccaattcatctataccagtactgataacattgaagaaattgaatttcaaaacaatacattaagtccatgtagtagtgttataacctttatgtcatatctatggtcaactaaaacaagtgctgttgtatatagttcaaattatacacaagatagtattgttgaatcatataaagttctaaaggaatactatgaaaataacaaatgattttattaaaagtgtagtacaccctatgcttagtattatgaaaaaaatacagaatctaccggaagataacgattacaagtttaatcgttttgattcagatgtgttttgtattgaaattgaaattaataacaatcgcaatttacatttaaaattcaaagaatcgtcaagtccgtactacaactttgatatgaattttaaaatagatactgacattgaagaaaacgtaatatcaaatcatactagcaaaaatggttttatgcatagaactactatgtacaataataaaaatagtattatatctaaatggaatcatcaattcactaaaatttgtgaaattgaatatagtgattttggtgaagagaattactttcagttaagtacaattcatgaacttccaccgtatgattatgttaaaacatggtttgatattcataatataattgatgatgcaatcaaacttccatttggtgtgtcaatatcatatactgctcctaaaacatttgtttttactgaagatatgattatgaaaaagatatgggcaattatcccacttatgatggattaaattcgtaccaggggttgactctggtatttttgtatgatacattgtcctaaaggagaattttatgaactacaatcatgatctttttacattatgtgcatccaaatgtgttgatggatggacagataaaatcaataccataattcatcgatatctggtctttagttctcgtgcacgaagtgagggggctatggatttcaaatatacactatctattgatggtgtaactatccatgcagacgaagaacgtctgagcattaatttgtatgattcctgtgtatttgctattcaccaaaagatggggaaaggatggggttgtaataacattaactcaaaagctatcttttgggttggtcaccaccagacagtacttgatccttcaatcaaatctaatcttttatccgataatatggtttatgatttattgtactccgaagaacaacattttcagttaagtacattacatgatctggcacagtacgaggattgttacaaaacattagaactatgccattcccttgaacttaaagataaattgatacaagtttacccttcattctttcatgaagaagtacaaagtacactagatcatattttatatggatacgataaatgagaaaaagttatcaagaagctattgacttaattcgtgaagttatcaaggtggctcctgctgctattgagttcaagaagtccatatacaagaagtatggttcaatgtcgagtatgtgctttcaaaagaaacgtagagcattcactacccagtactggaatgattctatcatcctgagcaatgagactcagcgtattttaacactagaatctgaacctaatgagtacggggaagggaacatttgtgtacctgattatgatgaaattaacttcaactgcggtgattttgaaacaacattattacttcatgagggttatccagaaggtgatgtattagctgagtacaatccaaaaactaaaattctcaaaagaggaatccagttcactattaataacaaagatgatgttcaagcagcactgatgcaactgagtacaagtgaacctatcactattagtgtagaagagttatggggaattatttcagtactcaatgagtgctacaaagtaaaatcattgcgtaaacacagcattatattacataccaatatggcaaatataaaatgtaagcacattcaagaaatggtggttccagatggactttaaagaaattgaaagtaaattaaagtacttcaaagatatcaaacttctttggaaaaagtataaagttgattacaatttcagtgatgatgagacaataaaatacattgagattaatatcaaaatcaagttcaagaataataattatggtgaagtaaccttaaatcatactggtatatcactcaaggactatgatggtacaacactcgcatattttgacttcacaccagaaccaggtgaaacactacttagtgagataaattcctatgacatggaagtgttcggcgggaatccgttactgttccgactttctgaagagtggagtgaagagtactacacttacaaagatggtgtagtacttgacattcatggagaagttgtgaatgacttggaagaacgtttgttccaagaattgtgtgtttcaaatacttcatatgcatacaatcatatccttgacatgtttgatttatatagtaaaatagatgctgaaatgaatgcacatggtattcattaccttacaattaacgactatgctcaactcgaaaccgctgtgaaagcattgactaaagtactgaaataggaatgaaatatgaaactgtatcatgcgagtactgtaaaaattgataacttttatatcccgtatggtggccttcatatgggaggtaaacacagtgctttagaagctgccttacgcaagctgagaagcccactgaacgtagtagacgcatgtacagtatacttgcataccttagaagttgatgttgataacgtgcttctgtgtgaagatttaggcagtgatgatgagtggcgttcacttattgagaattgcactgctcaaggttatgatgctgttcagtacaaaaatgattacgagccagacaatgttcctagctttatgatttgggatgcatctaaagttcgcatcattgaagttgatgctatgcatatggatgaagctgaaatgattatcgaagattttcttgatgaatatgaaggtgtataatgactgacccgatggtagcactggcacgtactaagttactattaaagattggtgagatttttacggttcttctgtccaataatattgatattactgagctagatattaagcaaccgtgggaagtgactatgttctcggcgttccaccgattgtcatataaaggtgaaagtgttcttgattttaaccctaaagcaaaattcatagattatgctgcgttgtacagagagttgcaccgaaatatttattccggttgtataaccaataacttcaaagaaattaaagttcaaactgcatcacatgagttcaatgatttactttatccagaatttaatctaacggaagaattactctttcagtactcgttaattctcacaaatctcgaaacgctagagtactacaaagagttagtagatatttttatgaatacacgactttcaaaagatattgtgatattctggtatacagagcatgttacggaggaattgcttactgaatttcttctaaatatgacagctataaaggagaagttatgttagatattttaggaaacatcgatactgcaaattattttatccaggacgcactgttcaatacagttcaacaaggattagaagttcgtcataacgtttaccaaggtgatggttatttcgttgatattgttgaggcacgaaagaatacgtttaatgttaacattacaacactgggtagacagaacattgcacgaattttagtaagtaaagatgaaattgtattgagatacagtgctaagtttatgttgacttataagaaaaaaactgatatgttcagtactaatttatttgatgagccatttgaccttgaagatattgaagctactttctttactcaaagtactatggtaaaatacactgatgttcaattttctgctgatgtaatgtcagaaacattacaaatgatcaaggtattattttatgcatttgagcaatttagagaagaaagaaacaaggttaacaaccacagatgaactaatagaggcgatcactaaggagtcaaaataccacaaagggattcgtctatattttatagatattggttcaatggaaggcatatacatttatggttcacaatctttatcttatgatgtaatgccaaaaaaacatgtaaaaatctttttaggttcagataaaaaaactttcttgacaattaatgataaaaacgttattatgaattcgttgggtcatgataaggtggaaattgatctaaacacattggaggatattgatttttttcaatacgagtgtttaggtgttgacttacatggcattagtagcgatatgataaaatcattaatcaaatatttcgaaggtgttcataaatgtatctaactaaatcaatgaaaaattcatttgataaaatcaagagttgtcttgatggggaaaatattacaagtgttacacaaactgctgaccaaattcaaagcagttcaagtgattgtactgttattttaggtttacatagtctacgtttatcaatagtaaataatattgacaacactgctattgtaatcacaccatgccatattcaaaatgagaatggtgtatatcttcatcacatgggaacagtatttcatattttcaatacaaacgaaaacattgttaaggaatacaaatctcttaatattgattcaggtgaattatttcaaatgagtactttgtactcatgtaattttacagatacttcatgtattttgccatttttcttggaaattattaagaaaatggaaaatttaaaacgtgaatacaataaagaaatggttcctgaagctatattaaatattactaatgctatagagaagtataatgcagtgacttaataaaaacgcacatggagtgcattagaagatcaaggatagatcatggagattaaaactgttgaaaatgggaaaattgatgacattttagagttggacgcattcaaagttcatgatataatgtttaatgtgaaggacattattcaatgtctatttttgtgtagcaagacaatgcatgatttttttcacaacccaaatactaacgtttttatactaacaatcagtactgaaaactcgtttatcatgggtatgcctatgagtacaaatgaacaatatattgattgtgttattcgtaataacgatagtattacaccacaatctgaagtacgtaaaaagaaaaacacctacacaatcaaagatgataaaattatgatgtgctgtagtaaagggtttatattagataattttatcgtcaaagacagttatcacgactttaaagtgtctgaaaatcaatccaatgtagttctttatgcgagtgacatagaaagtctaacagttaaagaacccagtttggagtaagtatggctaagaaagtaaacaatttcgtacagaaacacatgaatgagtttaacaagcctcagacacatgtggatcgtaaaaaagaaatgaaaaatggtaaagtaaaacacaagtcgagatttattctcgactaattttttgtctaaatttatgaggattgtatatatgttagacatttcagattttcttaattttaaaaagtattcagtacttgaacatatcaacgaatttctgaattctactacaccatttggtatcagtacatcagatgcatacgatggatatacaatcttcccatacaatgactttcaaatttccgtcaaaaaaggttttacaaaagaagttgcaattcgtgatgtagtaatgtatagcgattcttctatttcttactgtcatgacgtgaacaagtttgaatctctttcaacacctaattgttcatactacaaatcccatgacacgatgatgtataaagaacaacatattaatggtgtttcgttctataaaactagcagtgataaatcatatacatctagagatgattttggaaaatacacatgtactatgcacacggataatgaaaaaacaaattacactcattcattcgagtccaaattccaagagagtgaagtttcaaatatcactatacaagaacaggtttcagaaggcattgtatatcgtagtactgcattctttcgcatgaaagatattgccacaggcagaccaatgatgtacaatattgacatatacatgaaaggtgatatatccgaagtagtgattagtactggttatcgtgaaaaatatacagttacaatggaatcaccagatgcatcattagttcacctctttaacaatttatatacattccaattcgaacttagtttcgatccaaatgaatatcaaatatttgatatattaaaaagtaatattattaataagttagaatattactacaagttaggtggtaagatgtgcatagttaatactatgttacataacataaaagaaacattataaatctggaggatttggtatggatactaaattcaaaattatttttaaaactaagccgtatattccacatacagcagaacgttttataccacatggtgctgaggaaattattcaccaagatggtactaagttataccttgttccttgttcttatgaacgtgcagtagaaatgttgctaatgaatgctagactatgcaaaaacaagtacattagttacctatacaatgaacatattttagatttcaatgatgaaaatatgttcattctagcaattgaggattttgataactggtacaatattattaaaatctaatgaaaataatgtgaacatattagattcttgtgatataatgttcacatctttttttgataacggagatatagatgaatacaagttcagtcctaaaagcaattggtggtgttttactcattgaagtaaaaggtgagccaaagctatgctgtttagaagatatgaagaatacaaaacacttcagtactggtcagattttcaatgccattcgtattctaaatgacaaatccattgctgattatggaaaagtttggcctgtatatcaaaatgctgatggtgatatcagtactgattggaaaacaattgaggcggtacgacaaagttgtgagagtgattgggacttcattgttgaagtttgtgatcaactacaagaagatgttccagaaattgttgaacgaaaagaagttctagcacgacttgaaaaattccgtcacggaacactacagtatgacacaatctaatctgcttattaaaaatatctaattaacattatataaaaggaatttaaaaatggaagacaatggaatgaaatttgatatgtttgaaggtgtaccagagttcgatttcaacaaacttgaagaaggtgaggaatcagaactagttagtgttacacttaaagcagattctaaaaagaaatattcatcatcagtacgttcacgttcacaagaagaatacgaatcatttattgaaagtattcattatgaaacattccatcacgcagatggaactccatatgaagtacgtgtaacagtactgaagcctgaagtaaatccaatggaaaatctacgtcctgtttactgctgggcaagtcactaataaaccaaaggacgggatttgttatctcgtccttttttttgtctggagatgtatgaaactttatctaatcgttgactacaataaggattatgctggtaacttcaccgaagattcggatggatattgcacatcgactaatgtcaatgtacgtagcagtagtgctcatgaacatgaatcttgtaaaaatctaaaagattttatcgcataccgagcatttgaaaagaacttctgccgcagtagatattcgaagtttgagtacccgttaattgatgttcctgatgatttaatgttccagttaatgctgactggagttcaagattatgattacatagcgtataatcatattactaagaaaatttatattggtacatcatcacatgacacttctatgtatgcatcatgcccagatgatcgaatgaatgatagaaaatcatactatagtgggtcagttggtttaaatgattcattaaataaaaattcattctttgagtatgtttatgattaccatcatgagaaaaaagaacgtgaagattactgtatagcaattgatagtactaatgggtatgaagacgtgaaagaagcacttatgccgtacattattgaaaagtactacaaagattttcagtactgtagtaattttctaatcagaaattctattataatcggtcgccaatctagtgcatactctcagtactataatgattcaccagtagcatcggcaaatgaaatgtgtgatattttacaaattccacgtgaagatatggcattcatttttacatcttttattgaagatgatgagttgtatattaaaaataaacaccgtttcatgccaagcaagattgaggttattcgaagttttagtgttgatatactaacaaatttcacagaaaaaaccgaatataactgagacaaatgataagttaatgatataatataaggtgacaacataatatgttagtcacctttttttaatcctgaaaggttcccataaggaaatgattaaaagcctaatccactcgaaaatgtagagggtagatgagtagtcctttcagtacgaacagcagatgaaacccgttagatgatggcatagtttgaaccactcacggcaatgcggctgtataaagaactccaataggataaagagagttcctcgatagacatataaggatcgcaccttaccaattatctaagggagatttcataagaaatatgcggtcggaattatacaatatagttgcgtccaaattttgtgaaatcaaatacaagtactggtcatatggtatttgtattatgtgtcgggatgtttaagaccgacgaccgttgctacaagaaccgcgatagagagaaacagagcaacccgctttcgtctcgtaagagaattcgtgatatgaactatgtgaaggccaccagcgtcaaacttttttgttctttcccctgcggggggatgaaatatgctcaagcaaaccccgtcaatattaattaaaagaaaatagtacttgtagaattagacatgcgtagcatggtaattctactgatgttgatgaaatcaacgtcacgtatattcattgatgtttccataggaataatgatggcatttattagaaaagaaaaaactgttacttataaaactttgaattttgatgattgcattaatcaatcacaagacgaagatatctttactggatatgtggttattaaagaaaaaggatgcatttcttatataaaggaattgcaaaatggaattgaagtaacttcagttaaattacttcctactcaaaaaccaacaatatcaaaagcccagtatggtaattattttgaagaaagatatagtaataattcaataagtgttaaggctcatattattaaaggagaactagaaggagaatatagaaaatacaacccacaaggaaaatgtgtttgggttaaatacttcaattcaggatatgatgtaacatctgaaattatagagttcttaggtttaaaatgtacccctgagactattcacgattacaagttcaatactgaagaagagtttaatctgatgatgcgttacggttcacattttaaatttttatatgaatataacattgacagtagtacttttgataagatagtacacaactgtctctaacaaaaggaattatataatgtcgaagaaggatgcttcgaaaaaacattcagtacattttagtactggaaaagataactggacaactcccaaagatttctttgaagatttggatgagttatggggatttacacttgatgctgcttgtgttgatgagactgcattgtgtgataattttttcactccagaagatgattcactatcacaggattggggaaataatatagtttggttgaatccaccatacagtgacttgaaaacttggttatctaaagcagtagatgcatataataacggggcaactgtagttattcttgtaccctcaagaaccgacacaattgcttttcaggattatgctgctaaaatatgtgattgtatttgttttattaagggaagattacgatttggtataccagaagaacccgataagaaaacagattcagcaccatttccttcgtgtctgatagtactggataagtacttaaccactgctaaaatcaattatcttaaatctcttgggttggtgatgaagaatttatgaaagaaacatgtgtattaacgtttggtcgtattaatcctgtacatcgtggacatggtttagtttttgaaaaggccaaaacattacaagaacagtacaatgctgatttaaaaatatatctaagcaccagtactgacaatataaaaaacccactcccacctgaactaaaaatgtattatacagagggattctatccttcagtgcaagagaacatctacacagaagacaatctgtttgatataatgagagaactggatggaaagtacttagatgttcttttcatatgtggttctgaccgtattgattcttttcaaaaaactcttgacatgtacaatggtaagttgtataatttttgtagtataaaagcaattcaagcaggtattgaccgtaatgtaagtcaatatagctcaacacaaatgcgtaacttcgcaaaaaatgaagattttgatagttttcgtgagtttttacctagaaatgacgaggacttaaaaatacaattatttgaagacgttataaaatacatgaggaaataattatgtcagtactgttcaaaaccaatccagtactttgggatcaaaatgagcaatcaggatttcgttccatccatgttgaatacaaaggtaatactgtagttgcaattattgctaacaaaactctaggaaactggactgcacaggttgttcctatgggatattcttacacatctgatgaggttcaattcctggctgaactatatcgtcaagtgccgtttatcattaatgtactagaaggtaatgatacattatcacatgcagatgtgattaattttcttggaaacttgcatgtgtgatgaaataaatcttacaggatattttttacaagaatcaatgattaaatttagtgataaattttcagtactggatggtatcgaaatgtggcatgtcaaaccactgttccacactttcagtaaagagcacaaaatgttattgactgaagccagtaaatcaaataacatatgtgaaatcaaaattggtgtaaatgtctataaagggatggttatcttttttgacaataacagcaactacttttatattgttaaggagcattacgttgacaaatacaaatactaatacatacttccgttatcttcgcttaggtctttccctacgtccgatccgtggaaagtgcgattcactggctgaccttgactatgcatatgcattacatcatgaaggtgtacagtatgtattgggtgattatggtgaatttgaagaaacaaatgacagtactggaattaatgctggtgtagaaaatcttaacaacattgctaacagttctcgccatgacattgtgttacagattcaaaactttattgagcagcacacaggtaaacgtgtttggtgctatgtcggtacggatgcacaaatgtcaatttcattcggtaacgatgaaggatatgttgcacagcttattatggattttgaatctgaagagaagtttttagaattcaaagaaaagattattcagtcacttgttgatatgggtatccccgaagataaaatgccagaagtccaaaacattgatgaatttgttttgattccatctgatgagaaatatgatgcaatgtttactgctcttaatattccaggagttattgtggagtactttgatgatggtgatgatagtatctatatcgatctagatgacgatgacgacgatgaataatgtacatagcccgacataagttcgggctatttttgtaaggggatatatgaattataaagttctacaatatacatacagtgttttgtttgatttacatcacaatggaagatatctcaatacaatacgagaaaacacattcactcatactatctggattaatcacttaataatgatacgtgaatattttgttaatagtgagataatcattcgtggtaaaaaacagaagatagaacaagttaatagttttggtggtaaattagtactatcatttatagatagtaatactaatgaaagatatagtatagatttggtggacatatgaattataaagatttcctactaacatacaagattattcgagatttagcacacgacaatgatagccctagtctagaagacacatgcactgaaatgattcatacgattcgtggtaagattaaaaaaaaattcagtactgttattattggtgatgaccatgcagaattttctgatataatcattagacgtgatggtaaagttgaggttcagtactacactgattttggatttaccagtattccgttggagatattcccttgggattaaatttaaatgatatacaattcacttataagatcctatatgatttgtatgatttataccttgttagtaacaaaataggttcacataactcatccaaagaacaaccatttattgatttatatattgagtacttagattcagtaggtgaatatataaaaaagaattacagtacttttaacgatggaaatgatatattcgagttctctggagttaaatcatacaatgggattatccatgttgaatttcttgaaataaccgataggggatttatcgagattaaagttgtgaagttggtgaatttataagaggttacatatgttattaaatgatatacaattcacatacaaatttttgtatatccaatacgctacggttgatgctggagaatatctctacggtgaaatctatcgttcggtatggataaagtttttggatgaattacatgaatattaccatgatttgtgtatagttcgtgataataaaatatacaaattccgcgatattgttagtcatagcggtaagctacgattggaattaagtactgatagtgatgttgattggattggtgtaaatttactggagttggagaatgaaaaacaacttaaaggaaatacaagtattttataaattcttatacttgtcatatgtaaaagatgagtactatgaaagtgtgtattattttttatggcaacattaccgtactatagtaagagatttatatataggaaaatctatcatatccaatggtgaaaaatgtatatgtactgatgttgttagttttaatggttctttaacactgtgtttcagatgcgataataatagtgggtcattttcattaaacgtatatcagttagaaggaataaattttgaataaatgtccatattgtaacagtactcaattagctcgtttccgtttagattcagactgggcgactggtgctggtgatttcttccctattaatgatgatgcggaatacaccgaagaacagcacaaagattttgataaatcatggcgacctgacattgagtgcatttattgccttaattgtgagcgtgttcatgactaaagctgaactaatagttcatacatataaaatgatatcaagtactaagttatcatatagtgaagataatccagtactggattattttgttgaattattgaaagagcattatattggtaaatcactgattcttaataatattaatttcacggtaaaggatgtagcacctggaaaaaacgtactaatagtatgtgttacttcatctgataacccagtatacccaatatcaataatttttgagatattaggagatttatgaatatcattttaatgcagaaaacatatgctatattggtgaaagattattccattactttcgattcacaagaaagtgctctacataacctatacaaaaacgtaacacaagaatacagaaatatgttttctgacttagtagtaggaaggtatttcagtactagaaaatacccaaaacttcaaatagttgatgtttctttttatttcaatggtcatattactattcatactttagaccaagattcaacaacgtacttaaacttttcatttgatgaagtaacatttttatgagagcagtattttttatctggagtcttttttcattggcagtactgacagtatgtgggatttgtttcctttcatcaattaatacttggtatatcaatttactatttccatttgtcggtgttggtttagggtttactttgcatagtgtatgtaaggattacaatgagaacaaatgaagtacttattgctgaaacaatgaagatgatttacaatatcacgtcagcacagaatatgccctatccaactaagtctttattgaggactgtgtatctggggatagtacaggagtactacaaatccaagcaccgaagcattattagtgtttatcgtgattatgaaaggattcgtattttattctggaacaagaatcgagtacgttctgaatgtgacctagtggactttaaattagagaatctttattgctataaacagggacaatagtttaattcatgatataataatgggtaaggaacaataattaacacaaggagtgtgtgaaatgcttgaccgtatccgtttcgctacagagatggcgaatgaattaaacatggcaaatttccaaatgttaacatcagtaatggctgaacatgcatgtgcttattctgtaagtggtgtgcagtgtggtcaggagaatatgttagcagatgtttatagtgaagtgcaaagtaagcaatatagtgtaaagacatataaggataagtttgttagtctttatatgaacgaagatattgctgaagaccgtaaattcactgattttattattgaacgacgagtatcaggtgtatctaatcctaatgcatcaagcgaggaagtttttgcagaagtactgaaagatatatacgaaaatgaattaaaaagtaagaatcattacaatgtacgtgaaactaacacagtgctcttgggatatgatgaagacgaagaatactattattttcgtatgactgaagttccttttgaatacaaatctccatatacaactacagtgaaagaatttactgaaaaaagtaaaaacttcatgaagcatgaaggaaatcgttgtagtataaatggttacgacgaaaatggcattcacatttatgagtgggttcacccaaattgtcagacatacactcgttgcttgaaaaaacgttataatttagaagagcatgaatcattctattttaaagttaagaagcaaggttacactcgccccgccgattctgaattgatgggtatgatatatttctaaggaaactgctatggatttttatctacacacatggacatacgaacaatatattacattatatcttgaaattattaacacagaacctaggtgtggttgttggttcgcagatatcataaaagagtatgcggacgaatttgagttcgtgtatcttggtactgatatatttgtaaaaagtgtaggtaaaaccggacgaatcactgatatagattacgacactgttagtgtgaatttctatgttgattttcctgatgctggcgttgatggtgtatattgtctttatgaaataatttaaatttttaggccagcgtttgctggtcttttttcgcaggtacaaagatgttcagtatagatttaattaacagtactatcaaaatgttggcagatttggtgagacaatccaatggaactttatattctgcaatgtataaaatgtttgaccgatatatcaaggattgtaacatatcattatatggacttgctgttgatatagacgattactatggaattaatacttcatataaaacaggaattttaattggtattaatataaagatggggtatttcccttattactgtataggattaccagataatactttggtagaatatccagccagtactataaaaataagaggataaaactaaaatgaatgtattagaattaagtactaagctgattactatgcgtaacgagtggtacgattggttttataatggtactgatatggatttttcaaaatatccatttatggaatcaggatgtgatgcaagataccgctggttgagcaaagattgttctggtttacatattctagttgacgatagtggtcagggaattataaaagatttacttcaagttgaacaactcgtccatgataattggtgtgataacgatccataccttggaaatatgatttatgtaagtgaagatgattgcatattcgttatccagcgtcatggtaattctatgttttatgtagcagacagcagtactccagaaggtgcagcagccgatggtcttatgcctaagattgatatattggaatttggattacctgagcacttccagattagtactttatacgatattccaccacttgagttctttgaagaatttaaattgtactacaatgatcttcaaaaattgagtactgagagtcgccttgaaataaccgtcaagtacatggacggaacgaaattaaccgatacggggatagaattttgattaaagatttagatagaattttatatgtactaaggggtgtaattacattacatccacaaatcaatcgaattgaaagtacatttcagttggagtcaagagaaactccatattcacatatatcaaatgtagttggttcactcagtactgaagactcgtcttacgatatttgtgtatgtgaagtacaaccaagttcggatcttggatttgctatttttgataaagaacaaaatctcattagtatgtttcagtgcaataatcctttttggaaaacatgcctgtatccagagtgggctatgcttgatccaaccaagagtaccattaaagtttatgactctaaaaatgatgaagtcgttattgatttggatgagtcaatgtcagaggaagaacactttcagctaatgatgatgcgtgctatgcctgagtacaatgcaatgattaatactatacaatacattaaggataccatgccatcattgcgtacacatgagttttgccatcctgtattgtatgaacatttggatttagatttcagtactattaaatttaaagatagtgttattagatatatccaagaaaatgttaaatttaatttcattagtactatgaacaataatccaaaaactaattttaggcatcagtacaatgaatctttttctaatggtcgtgataccagttggtggaaataatatgaatatccaagatagattacaattactatacacacttgaacaggctgcttttgaacttgttcgaaaaatatcagatgaactacctaaaggaactaaagttcgtgtacgtgagatgaattatttttctggagtaattgaagaacaagtactaacagtgaataaagtaacatactatgaatctgagttgtctattcagtgtgaatcggatgatggattaatatcatattatggaactgatgtagatatagaggtaataaaatgacccttttacaaatatatgaagatttaatgcacttatgtaatacaaacgatgcattcttttatgtggatcataaaagtcctgctggtggcacgtatcgtgtattcagttatcgcctagcatcatacactgatttcatgcaaccaaatgcgttggaaacccgtggctctatgtgggaaattgatgaagaaggtgacatgatacgttgtgcagcacgtacaatgaaaaagttcttcaatgcttacgagaatcctgctacaatgttccctgctaacaccacatgcgatgacattgcggtcgtgatgcctaagttggatggttcgattatcagtacttatcgtgataatgatggtgagattcgttgtaaatcacatactgcattgtattctgaccatgcgattaacagtactcgacttattaacgagaaccagaatttgtatcagtacatcgacgaagcggaacgtttaggttacacagttaatatggagtatacaagcccagagtaccgaattgtattaccatatcaggtagaacaactgtttgtactgaacgttcgacatcgtgtgagtggtgagttgctatgtggtaaagcactacgtgataagtttccatgtcttgcacagtacagtactaatatgaccggaaaagatattcatcacacttttccggtacgaaataccttccgtgaaagcgtggaggaagttcataaaatgcttgatattgagggttttgtgtgcatcctaaataatgggacaatgtgtaaaataaaaactgactggtacagttcattacatcttacaaaagatagtattattattgattctcatttatatgaagccgtattaaatggttcaagtgatgatttaaaacaattgttcagtactgatgaatatgctatgcaaaagatattaagaatggaacatttggtattttcgtgctataatgcattacaagatgaagtagaaagcttcgtcaaggaacacaagcacttggagcgaaaggaattcgcaatgaaggttcaggagtgtttaactaatgaactgaatcgtcagggcttggcctttgcaatgtataacaataagaaagttgattacaaagagactcttataaaatacatgaaaattgtactaaaggatttttagtactatctagcctaagcacaaggagaagtgatggctaaacctaagtataaaaatgacggttccctttctccgactgaattcaggaaaatacaagaagaaatcgatgaattacagcacaaacgctcaatgaaaggtgtgaagataagtaagaaacgaatcgagaataccttcggatgtagtagtactgaatacaagaagaaaaggaaaccaaaaggtgttaagccgagaatacatgatgtaactcgctatacatcgaaacgtgaaaataaatttgatccactataaggagttcatatgaaagttgaagttcagcatagtattgttcaggatatgtcagtagttaaatttctttctctgaaagattacttcagatgtatcaagttcctagaagaatctcaattacagtggaccccattaaagttcagttcatccaatgatacagctagtattcgttgtgatgaatctgtacttgtgaaaatctccaaacgatttggagtaggaaaagttaatgagcacagtaagtgacctaaaatactacaacaaaactgcggatacgtttattactcatttatatgaagaatttagtcgtatccgtaaggaatatacaggtaaatgtattttatatagttcttatcatagtggtggaattgaaagtgcttacattactaaagtgaagttttctgatgactatcaattactctttgaattagatgattgtttcgttattgaagcttgtttgatagtggatgttctagataattgaggacatatgaataaagaacttgcatttgagaggatcgaaaagttaaagtacattgaaaaggaactaatagaatctgtcgaatcaatggtcgaagattacgttttcgattttaagaaaacattgattggatgtaaagttaaatgctgggatcatacaatcagagaatggttcagtactataattcttgatgttaaagtatcgcgtactgctattggtaatttagtaaatggtgaatgctttgtatacactgaatacaataacggaacaagaaacctttcaagaggatggcacaaactcgaagatgtagaattcattgagtaacaaggagtaataatgccaactattacactaacagttggattacctgggtgtggtaaaaccacatgggcagttcaagaaattaaaaatgccaaatccaagactatcaacatcaaccgtgatgatattcgtgaatctatggctgggtcacatgatgcttacaaattcaacgatgctaatgagcagtacgtaactaatttacagttcagtgcagcaaattcagcagcagagaatggttggaacatcatcatatccgatacaaaccttaaacaacatttccgtaatctctggaaagtatgggctaaagataatggttatgattacaaagaaaagaacttctatgatgattttgtacctaatgaagaccgtggtgcagatgttcatgaattctttaagattaaagagttcgtaaaactttgtaagaaatataacctccagcgtgagcgttcagtacaagatgatatcattgacacaatggcagatacgtactattatagtaaggcattacacattggttactatggtaattcacgcgaagctgctatcatcgttgatatcgatggaactcttgctcataaatggggtcgtaatccttacgatgaaagtactgttcttcaggatacacctgatgaagaagttattttgtctattatcgctgaagcagtttttcataaacgcaagattatcgtcatgagtgggcgtactgaagggtgtcgtgctgataccgaacagtggcttaagaattggggtgttccttacgatgcattgtttatgcgagatatcgatgataaacgtcctgatgatgttgtaaaattcgacctgtacatgaaaaatgtggttgatcattacgatgttaaaaaggtatatgatgaccgcgatcaagttgtattcatgtggcgtaagctacttgggttgaaagttttccaagtggctgaaggaaatttctaatacaaaagggatcatatattggtccctttttcttttaaggtacattatagtgaatgtaacaacacagatgttattacaaaaagactacttagaaaatatagaacgatactatagattgtctttgtatgaaaataagcataaaaattatagttttgataaactactaaattccagtactgatgattatctattttcatcaatgttttatgtgagaggtttattataatggataaatttcacacagatataacacagataggtaatcttatcaatagtctaattactgatttagaagaaaagtacttaggtcgaaatgtatacgtagaaatgtatgaaacatatggtgttattgatatgatttattacagtgcattgaagtgtgaaatacgtttaacagtatgtttgtttgaaaaaaatacattcaacagaagtactgcaattcgccaagttggagttgatgatatagaattatacgaggaacaatgatgtttgagcaggacttagagatattcaaaagtcatattgattacttgactatattagaaaatgatttaactacaaagtacaaaggcattcgtgttctgtgctggtatgatgattgggattataaacgtgaactcacgattgatcgaatttatttcagtgacggtgtactaaatgtacatggtgtaaatgattttggtcattcatatacatattctaataatgctaaatttaaaaggatctacaatgaatgaatattatcataatttattcgattacataaaactaatagatgatctttcttttgaatttctcagtactgaaaaagttcttgaacctctctattatgattgtattagttcactatgtttagatgaaaaagagatattagcaaacaacttaccatccacggtctgtacaatcaatggttccaaggcattagtgtgcgaggttaattttcataaatcacttaatacaattgtttacaagttcgataacacttgggtaaatcatgtaaccagtaatattaaatctgtgagatttttatgaatataaaaaaattatttgaacaagtaaatttattgtactggtgttcagacggttcagataaggaatatagtgaagtttatttagaactgtttagaactgaaattcatcaaattcgaagatacctaattgataacaaaactaaagtacaagtaagataccataacggtactttaaagaatggtgtaattattggattgatagttacacgaatgtctaataatattaaagttgcagttagattaatgactgatgatggtgtctacacaatagaagctagtgagattatatattaaatggatatacaaacattcaataaacttaagtactatgatgatggttttgcattaataattaacgaacttgatggaataccatacgaatatcataatcaagtaatgaagataataaaatgtatatgtgaagaattaaaaagtatatttaaaaatgaatatgtttatgatttaggtaataatagcaaaaaactatacataaagaaattctggggaacgcattgcggtttgatggtcgatttaggtttaagtttagacgataattctgaatcatgttcattatatatagatgaaatgcgaatatcatgagacgtatcagaattcggtgatataatttgattacatcaccaatagggagaagttgaagtgaatggttcgtttttaacaatattagaaaagacaaccgagatgctttctagctcgttaatgcagattttcagtactaataatttatacaatacccaggtgttagattcaattaataataactatgtggtaagtatatctgatgaaatatgtccatttaacgcgtattcaatttatagtgtagaagagtttcatatatccgagattcgatgtggttttggtgcttggttagttctaaatgaacgttcagggttgtctttatacatcgaagaagttagtaaatttatatacaaaggagtagaatatgttaaccccaattattcttagcagtgcatatgtaatcggtattattatttctggtatgcttgcatataactataaccgaagtgttctaggttatgtagtacttggtacagtactaagtccagtgattgccattggtcttcttgttatgctaggtgagaaaaatacaagcttctttattactaaagaacttgataaaatcactccagcaccagaaacagttattccagaagttaaagaagaagttaaagaagaagttaaagaagttgaagttcaaatgcaagttaaagtgtataatacacttgaagaaactgatcctaaagttgtagtgaatgtagttccagtcgttgaagatgtgaaaccaaaagctcctaaagtacagaaaaatactaaaactgcaaagaaagctcgttacactaaaggtaagaacaaaggtaaatctaaggatgaaccacaactaggtgttcatgaccatactgcacaaattgcaacggcagcgaccgcagcagcaatcgtaacatcaccaatctacaacaatgatgattacagtgattatagccgtcacagcagttcttcctctgattcttgttcctatgatagctctagttctgattcaagttcatcgtctggaagttgtgattaatgtcaatgaaaccactaattcaacataatattttttataggtcattattcaaaattcaagatgatttttatcagacgttgagtaatgatcttataggtaaaactgtacgatattcggaacaatacatcaaacgtatgacaagtgagtatattgaccctgaatacgaatacgacattgaacacattaatcccaatactagaatgaaaatcattgagatatttaagaatgggagaactataggtgctgaaattgagtacttgaattgtgattgttacatagataccgagttaagtttggattatcttgttttagtggatgatgaggaataattatgataacattttttgcaatatatggttttgtagcatttgttacatttataaccaactttctagtacttaattggggttgttttaaagatgaaatcatgattatcatgaatctccaaacagcagcactgatggctattatttggcctgtaacattagtatatatttttatttcacttacccaagatattattaacaaatataagagaaagaaataatgttcaacactgacttatcacatttgcgatatcttatgtctttggctgatgattttataaatgatctgaagccaaaatatattggtcaagaagtacgattaataaactccagagggtatggaaagtatattattactgatatgtatattagtggtggtgaatggcgttttaaaattaatacttatcttaaagatggttcttttgctggaacacaagttactaaacacactaatattatatggttggagtaataatgaaacacttcttagaagtaactgtacctgatgataaagatttatacattgtaggtgatttgcatggtaatggtaaactatgggatgctacagtgaaagaatttggtattacacacaatgattatgttttcagtgtaggtgatattatcgaccgtggagaacaaaattcaaagctcctttttgaatttttgttcggagaaaatcgttacatgattgcgggtaatcatgagatgatgtgcgttgattcggaaacacttcgagattggtatcattgttggataagtaatggtggtgataaattccttgatgaagttggaggaacaggcattcaattctttcgtcagtacttaaaggatctccctatgattatccaaatcaatcaccgaggattgaagattgggttagttcatgctggagttccgttggaatatacaacatgggaacgatttgttaatgggacaaaatcacttagtgctgatataattgataagtgcttgtgggatagaaaaacattcgattattgtagaactaataatacatattatgcacctaagttagatggagtgcattgtgtctttagtggacatacagcagttacagacccactcatttacggtaatcgcatttggattgatagtcagttcttgacgggtgacttaactctcgctactccacaaagtggtgggatgagatacttacgtaaagaaaaagatgagtactcattcaatcgtttcaaaaggtaataattatgcatgatgtagttaaaaaatatttgaatgatagatatattatgaaaaaatctattaattctatcctaaaagaccatgcaaatcaaatacgtgagattctatcaaataaacttattggttgttcagttgagttcaactacaaaaagaatgtcgtgaaggttggagttattaaacgtgtagttgctgtttatgaccaagatgtatatgttgaaatagaatatgatggtaaattatcacaattaagtactgaagatttaacatttttataaggaaatagaaatgaaagtaattcaagttatggtagaaaaataccaaactgaagatggtcgtatttttgattcagctaaacaagctgaacaccatgaacgtattatttctggtgcacgtaaagtatgtcctacatgtaatggaacacaacaagtaccgtcagaagattaccgcagcttttatgcttgtccacactgtgatgggaaaggctacgtagaaaaacaagaggtatggaaatgaaattgtattgcttaactaatatgtactgccaaggtgtccaagctggtattcaagcattccatgctggtgttaaactaattaaagaatatgaaggtactgctttcagtactattattgatgaatggtactatgaacacgaaactattgtagtactaaatgctggtggacatgataagttaaattcttattataacaaccttagcaaacagggaaaagttccgtttgccaaattcaatgaagctggattgaatgatgctattacctgtgtagcagtactgtgtacgtctgaaatgattgaagacatggctgttatgcgtatgaatcttcctgctggtgatcaactaatgcaagtaaaatatggtgcattgtttgacacattaaaagcaatcagcacaatgaggacaatttgatggattttccagagaagttatttgttgcacgttcctatgtaaaccacaaccaagttgatggttttattatcgatgcaacaaaatcacatacaaaagcgtttgaaacaaagaaagagagagcagagtactgggcaaagaagaacaatcttccatcgttatatattgacaacgttccaactacgggattttgtgtagttgataaattaacaactcatgcacgagaaacatatttcacgatccgtcacccagaaggatttgaatttatgattagtgcaaaaaacatgaatgatttaattatcaataacgatataatcaaaggtgtttttgtagacccaatgtttttcaacaataacttagaattaattaatagtaaaacaaaaacgtttgctaagttagttgaaaaagaaaataaaaaagaacaacaaaaagaaactgtagcaggtcttaaagttggtgatggtttcacttatcttaaagaagattactattactgcggtaaagtacatgcaatttgtataaagaaaactaaagaatttgcatatcccgacaaaagttcagtttatcatttactttttaacagtactcgtggaacttatgcattgaatcaacgtttggataattacaatattgaacctcgtgcactcttgaataagaagactacggcagatgaagaaattaaacttgctaatgaattttggcaaagctatagaacaaacagacataacccattaggtgaatctaacattccagtactggtacacaataaatcatttaaagcaaaagaccttaaaattaaatacgaagaaataaatgttgatgatcttatgaataatggacgtttcaacgagaacgtaccatttatgactaaagataatgaacaaacatatcgcgtattttttggtgtaagtaataatacaacgcgtagttattatgggcgtagtggagattataatatccattataatgataaatttgaacgctttagtgcatatccagttcaaattgatgataatgggattatggtaatggatgttgatattaatgaacactcatcatttagtacatggaatggctatcgttccccattcttcccaccaaatgaacgcaaaacatcaagcactcgttactaccaagacaaaccatgtcacgttcaactatcaattagtaatccactttatattggaaagtattatctataaaggaatatacaatgagcattttagcaattcttgaaagcattaaaaatactagcagtactctgggcaaaaaggctattcttgaacaaaataaagataatgtaactttacaaaaagtactgaaatatactctagacccttctatcgttagtggctataagaagctccctgccgctgatgacgtatatcaacatatgacgttagatgaagcaattgataagctagaatgcatttacaagcgtgatgtgacaggaaatgcggggcgtgatttcattgcttcagtactgggttctgtatctgaagatgatcaggaagttctacgtagaatgctcactaagaaccttgattgtggtattcaggagaagaactgcaatgatgtgtttggtaaaggattcatcaaagacgaaccatatatgcgttgttctttgattgacaaaaagactgcaaagaacatcaacttcaaagattatggttacgctatatcagaagtgaaaatggatggtcagtacttaaaccacgttgtcattaatggttcattaacttctacatcccgtaatggtaaactatacgacttcctgggttgtcgtgatggtgagatggcaggtcttgctcacatcatccaaagtaaagatgaacgttttagtagtggtgtagtctttatgggggaaggtgtagtactggacaatgatggagaaaccattctcccacgcactactggcaacggtataattcagaaagctggtaaagatagcatcagtcagaatgaagcaatgcgtactgtattcgttctatgggatgttgttccatatgatgcattttgtgaaggtgtatgggatgtaaaacgtaaagaacgtcgcgagatcttagtagatgcaattaacgaactcaatagtgattttgttcgtatggttggattccgtaaagttctaaacatcaaagaagcatttgagtacaatagtgaactaatgaacgaaggtgaagagggttcagtactgaaatgtgaagatggtatctggaaatctcatacttcacctaagcagttgaaaatgaaattgaaaatgcaactggacttacgtattgttggtttcaatgaaggtgaaggtaaacgtaaaggaagcctaggttctttacaactggaaagtgcttgtggttcattgaaagttaatgtgggtactggtatcaaagagaaagatgctgaatggacatttaaaaccatttgggaaagaatgcaagaacttattggtaaagtggttacagttgagtgtaatgacattgtattcgacaagcgtactggtgagccatcactgttcttaccagtgtttattgaatttagatttgacaaaaacacttgtgatgattatactcgtatcttagaaattcgtgagagtgctgttgaagtgttctcaaacagtattattgacgcattaggttaaccatttattggaggtgattatgaaatttgttgtaacatctgatgtacacggtgggactgattacctccatagtggtgattacagtgatacagtactgattattgctggggacttcgatgaagttaaacgcagtcgttaccgtactggtatagaatcactatgtaagcagtttaagaatgtagtactggttcctggcaatcatgaatattatggttccaatatccacaaaacgcataaagtactgtccgatatgcaagatgagattccaaatttcatctttttgcaaaacaaatttgtatggctggacggagtactgcttgttggtagtactctgtggacagacttcgataaaggtaattctttgacgaagtttgatgctcgtctgaagatgaacgattacaaacatatccgtcatggaacaacatcagagccttggcgtaagaaactgacaccagatgatactgagtttatgcatcacaaagataaacaatttatcaaaaattctattgacacagttcgctttatgcatgataatgatttcaaggtcatcgtggttacccatcacgcaccaagttatcaaagtgtttcaccaaaatataaaaatgattcactgaatggttgttactgttccgatatggatcagtacattgaagatttgggtgctgatgtttggattcatggtcatgttcatagtagttttgactaccacattggtaagacacgtatcatttgtaatccacgaggctatgaatcatacagtggagcttgtgagaattttgattacaatcctaaatttgtatttgaaatttaatgagaggatattgtgtcattaatttattttgaactgccagaatataccaattatccaagccgagttatttgctcagtttatagtaatgcatatcatcacttgttagtgaatagtaataaagctgtgcattattatcgaaataaagaaccacgtacattaaagaatcgttatgggtttgacccaactaacactgaagttgaactctgtgatctgttcggggaagtaatggtggtattgaaacgagatattcatcttttccatacatacaaacttaatcagtactttatggaaacactgtctatacgttcccatgctccgatgattaaagttgatttgaattatgttgatgataaattgaaatatgatttcattaattcacttgtttatttggagtaatatgaatatacgttcagtacgaatattttcatttgttgatatgaataaaaaacactcttatgtgtttgaaaatgtcaataagttaaatcctcatacggcaaaaatgattgaaaccatgaagaacttgagtttacatatagaagtttactatcttcatgacgattctgtttatgtatatgatgatggatggtatgacggtgtgttttatgatgacattagcactactgctgattactactttctagtgagtaatccactattcagtactaaaactttgtttgacattaccgatacaagcgtgtatgatacaagtcatgttgagttacttaagtttgatccagtattattcaacaaagagacggcgtattggatgactgatttcttttcaaatattccagtaaaatagtttggacattttaaatcttagtgatataatactcacaacaacgaaataatagaggaaattaataatggttgaacaattcatgtttggtggttatgctaatggcgaagtacgtaacatttctattccttacgtagttgagaaagttaatggttcagaacgtacatatgatctagcatctcgtatgatgcaagaccgtatcattttccttgatactgatttcaatgatcaaatggcacatatcatcaaacaacaattggtatggttagactcacaaggtgattcccctattacattctacattagttcaccgggtggttcagtacacgcaggtttgggtattgcagatgttgctaagtcttgtatttcgccaattcgcactgtagtaatgggctatgcagcatcaatgggttgctatacacaatctgttattgggactaaaggtttccgtttaggtggtaaacgctcatacttcatgtgtcaccaagtaagttctggtacacaaggtctaattacagaccagaagatttccctacaacattctgatgcactgaatacattgttgaccaaagaaattgcagaagctgtaggtgtatcacatgaacaattactaaaagatgctgaccgcgatttgtggttaaatgcagaagaagcacttgaatatggtgaacatggtttcattgatggtattattcttggtccacgtaacgaagaaggcaagtacttagttaagcgtcgcggtggtgtagaagagtgggtgtaagatagattttgatgcctcaatatggggcatcatctttgtggagattatatgaaagtactagtacgtaataatacggaagtagcaaatgtattagaagattccgattttattaatgttgcgttcgatcaaattagtgcagtagcacttgaattaaaaaatgtagatgaatctgagcgtgtgctgaatggttttgcaattgtacttgaattaatgaatgaagtactaattaaaaagaacattaatccagttgatgcggttcaacatgcagaagctgtgcgtaaagaacacggtacattctctgacaaaaaatacattcaaactgatgaggtaaaagaataatatgtccaatgcacaatataaagatggttatgacgcatacaaagcaaaagtagttctaagtgctgaacagctaaaaatgcagcatccattatatcgtcagggctatcgtgcagcacaagcagaagcaatgaagaaaaataatgtaactttccctactacactatatgatattccaaaacgtccacacatttttaaagctgaatggactgatattatggcagcgacaaagcgtccacgctttgctaaattacacaccgatgaaggtcgctggttgctaatggggattatgaaagcagttgagaatcaatctcataagattgttcgttataaagatgttgttgctatggttgataaagcatttgaccttgtacttcaatatggttatgatgaaggtgttctaactgtttctgattgtgaaaaatatcagtacaccccatatcaaaaataatattgtgaaaaggaatcctatcatgggattcctatttttattgctgtatatcaattttccattgatcatattttgatctatatgagctaaatacccaaggaatcattgttactagggtaggtgaatatgcagcaatataatttaactgaagaacaaagtgatattttttaccatcatatgtttttaattgatgaatttgctttaaaaattaattctgaagcaattgatatattgaagaaatggtatagttgttataataaaaacaaaaagtggtattggtttaatagaaatataaaatcatttctaaaaacaatcacatacactgatagtattgagttaatacatagttctattggatatagttacttaactaaacacaacagtactatgatgttatcagggtttaaagttgaaagaatttccaagttaacaggtttgtcattagaaacaattctatatgatattgagaaaatttggaaaactatagaattaatgcataaaaatatgtcattcatatatagaaattatgatatattcactgatgtacgacaatatcataataaaccgtatgtattggatgaaaagtactataatcatatggaagtttgttctaaactcgttgatgattggaatctagagggacataatgaaatacacacacctaagtatagatgatactaatatctggttagataacataatcaagacattagaattaattaaacttacattacaaaaaactactgatattgaaattaatattaaacaagaaatattaaactattatcatagaaacaaatatagcacgtttatctctaaattaatttatggattatatgatattgaagatatttgcatcggttacagtactggtatttgcttcacagttaatggtttaaaaaatgatttaaatttcagactttccgatgaagagcaagattttcgtagattttgtgataatattatggatacagataaaattacatttgttattgaattaaatcaaacgtggtctacatatgcagataaaccatttgaaattaatgaaacagatgtgttaaactatattcgagttatgaaaattcatgatttgtgtaaaaacgcattgttaagtattggagcttataatgaaacatacgacttggttgaagatagcagaagtagttgctgaggaaagtaaatgtatttcacaaaaagttggttgtgttattgttaaaaataaccgagtattgagtactggatacaatggtactccatcaaaacaaccaaattgttgtgatgtgaatcaacacttagtcaatgatggacgttttcaagactgggttagtgatgaagcaaagcatgaacatcatgagtggagtaatattcatgaaatccatgctgaaatgaacgctttactctatagttctcctactgaacgtcaaggtgctactctttacacaacactacaaccatgttatacttgttctaagttgatcgcaggtagtgggatttcacgtgtaatttatctcaaaaattatcctcgtacaccaccagaagctattaaagtactggaagatgctggaattattgttaattgcatttatgataagggtcttgataaatgacagtaataattattattgcttttctaataacagtgttttttatttttatgttatatatagttgctatggatgaacctaatacttcttttcgaaattatgaagttcgtttttctgcacaaaataataagtactatattgtaaactgtatacaccgtagtgagaaaagggtaacaagtagatttggatttaccatttattataaagaccgagtagaagctgatatgatttgtcagaagcttaatactgtagaataaaaaaaggagccacaaggctccttttttgttaacctgggaggttgcaataatacaaatcccaagggtgatatttcatcgccccagtactcaatttaattttatgaaactggaatgattcagcaaatgcactatcgtcaatcttaatacaaaaagtatttttggctagagttggtgcaatttccaatgctgttttagatgcatctaatctaattttatctttatcataactagtgatagttacaaaacgataaacattaaaatcagtatcaatgagatcgtaaacacaactagaacgttgattaaagatgttcaagttatatttcaattcaccgtttatattagctgcggttacacaaaacccgccgatattgaatggtagtttaccttgtgctgcgatagctttcatattttatttccttttttaaatataagtatgaaatatatttgttttttacatcagatgcaccatgaactagttgacaaaacatcagtggtatgatatgatctgttataaactgtacaccttaagttttatttttaaaaatttgagttaagtacagaaaaagtttgacttaagtgtttaagtactatattatttatatcttcctaaacaaaattgaggacttgttatatgaaaagactatggcttgaagtgatacaagcagcaatgtttctattgttaataaattttccagccagtgctggtattgaaagtaaaaatgtgataaagtataatcctgaaacccgaaatgtatatttcatatcagatattacagatgggtcactcaagagaatgatagagttgtatgataaagaacactatgataccatcacaattacatctcctggtggtgattttgatgcaggtattcgaatggcaaactttgttagagacaatgggataaatttaattgtttctaggtattgcaattcagcatgtactgtggtattctttagtgtatctcccgaaaagcgatatatgacaaatcgctcagtactgggtcttcataacatttcgattaaaagtaatgttactgatggtgataattcatttgtatctgtaagacagctatcaacttttaccgaagaaatggcaacaaaggtaggtttccttttttcactatatgcagcaaatggaatcccaccagaagttctatttagagttagtcgttctcgtggtgaagatgttgtaatattaacaaaaccagaactggttttttacggttcagtcaaacaataaaaataattaaaataacaggatgattatgatgtacttcctttgttattaattatattgagattatataactatgacaaacatccaaaacttgacatctattattttttatgctactgtagtaatgtatgctacagttatttttctaacagttttcatttacaaagattatcgtaatggctttattgatccaactacaatgaagttcaattcaaaattcgaagcaataatttattatgtactatcaacttcatacttggtgtgcctaatgttgttaggagcactaatttatatcttatacacaacattatttgcaattggagctattttatgacctgtattattgcacacactgacggagtaagttcttttattgctggcgataagttaggaagcaatggatttacaaaaactgttcaaactgagccaaaggtattcgagaaagaatttatcaagttacatgatgatggactaactagaactaaagaagtaatggcattgggttatactacatcatttcgtatgggtcagttgttaaattataaccttaatttacctgaacaagctgctggtcaaacattttcacaatatttggttcttaaagttattccaatcattcgtcaaatgtttaaagaagaatggggttcacgagatgcatcacaagatgtaggtggtggacaatttatcattctccacaatcatacaatctatgaagttcaagaagacttttcagtactacaacctaaaacaagaattaccgcagtaggtagtgggacatatcatgcaattgcagcaatgcaagcatatattgaagttgagaacgaatctaaaaaaccactacacgaacgtatcaaatcaatttttaaaattgttagtgataatgtaacaagcgtaagcgaagagtttgatgttttaaaatattaaaagtactaatattataagagagaatagatgatggcatacacaatttatgaatgggttttgagtttttttatagttttttctattgttgtaatttataacaatgctaaatgcttatatagggacttgaaatccaatggttatcacaaagataataattttatgtatgcctatcatattggaatcattctgttattatcaatatatttaattgttttttataaggattgaatatgatatcagaaaaatttataagcaatgaaggtaaaaagcgattactgattatatcaggtgcaggactttctgttgaaagtggtatggaaccttttcgatttgatgatggtttgtgggatacatttaaaattaatgatgtatgtaacattgcgagtttaactacaaaatatcatgttgttcattctttctataatacattacgtgtaaaattgggacaatgcgaaccgaatgcaatgcattattttataaaatcgttagaagatcaatatggtgattgcttccttcatatgacttctaacatggacgatctttatactcgtattggtggtcatgagcttaaacttcatggaaacttgtgtgaagttattgaaaattatagtatcaattccgatgattataatgttattaactgcggatacgaaccatacataccaaaacatgatgtttttgctaaaccaaatgtagtaatgattggagaatatcatcgttatgttgatggtattcgcttaccaatttacgaagaacgaaataatgtgttgaaatctcttaatgaaaatgatacagttattgtaattggtagtagcgatacagtactggtatggtcgagattagcagcagcattgccatgttatagtgttaatgttaacattcgtaaaaatgataatgattttttgtttaatgaaaaagttatcaagccagcaaccaaagcaataccgcatctagagactataattaaggaacgtatgaaatgagtgttaaagaagttccctttggtgaatatggcacacgtgcaaattttgtattttgttatttctttgcaagaaaatgcaacccttacaaaaactatgagttgaatgatataccagaagtaaatttagtattactgcaattacgatgggatggtcttcttggtggatgtggtggaaccgtagaaagtactgatatctcactagaagatgcgttgcgtcgtgaagttcaagaagaaatggattacaatatttttgtttcccatcttcgaccactcaaaacttttgaaatttacccaggtgcaaacagtcatagttttagctatgaagtgagctatgacgagttgaaacacattagagatggatacactaatgctaaacatgcaagtgcagaagttgctggtgtaaatttatgtcatatttctcgttattctaagggacaaaatcgagaagcgggatataataatcttatgacacagaacttcatcggtacagcaaaacaagaattggagtatctggttcaaaaagaaaacttactaattagttatctataggagtttaacatgtcttactcaatgtttttggatgatattcgtgatgcaaatctatattatccaaaccaagatatggtggtatgtcgtgactttaaaagtgcatgtgaatatgttattgaaaatggaattccagcatttgtatcattcgaccatgacttgggtgatgtgagcgaagacgaaaagactggatattcttttgctaagtttcttattgattatatgtttgataataatattaaagaaccgtttgagtactttgttcacagtagtaatcctgttggtaaaattaatattgaaacatacttaaacaatggatttaacgcattatgattcaaacacacatcaaaagtcttatttgtactgttctgttaggtgcaggagttctttggttcggacagtatcacgagaacactaagcgtaccaacattcactacaataccgcagaagttgttagtttaggacaatgtagcgagtccaaatgttcatttatgtataaaacccaaagtggtgaagtacgtaatggactatcaagagaaccagtttcaattggtcaacttgtttaccaggagtgctgggaagaaaaggttcgaggttcacgttgctatgttgaatacgaaccaaatatgtaataatccgagtcaataacattagtcgagtacaaggatgtactcataactcaaggatgttttatgaaaaaatatacaattgacacaaacgtactactatctgacccgaatgcatctattgcttttgatggtgctgcaatcattctaccatttacagtactggaagaattggattcaattaagagtcgtaatgtagatgtttcacgcgatgctcgtgttgctattcgtaacattgaagcaattattgcagatgcatcacatgatgagattagtagtactggtgttaatattgctgatgttcataccaatatgaatcctgatagcaaattgtttgttattacaaacgaagaagctgaagcactaattcgtactaaaggttcagaagagaaagttcaaacccttctcaaaagcacagtacctgatgataaaatcattctggtagctttagcaacagaatcagtactggtaactcgtgatatcaacatgcgtatcaaagcactaagttatggtgtcgaggtacaagattatcgccatgatattgttattggtgatagtgatttgattcacattggtcaacaccatttggaaattaatttttgggaagtatatagcaacttaaccaatactaatattcaatccgaacaagttggtcgtcgtttgtatcattacatttctaaaagcttgattgaacatttgcttccacaaaatctatgcatcggtgattatctatatgatgatgcagacgtattatttgtgtacgaaggtcaatcagcaattgaggaagatgatggaacactaacaccagaagatattttggtattccaagatattggacaatcagtagctttacgtgctaaagtatgggatattaaagcaaagaatatccaacaagcactcgccatcaacagtattctcgatcctgatgtacatctaacagtactgctaggttctgctggtactggtaaaacactaattacgattgctactgcattagaattagtactggaaaaacgtaaatacgaccgaatcatcttctctaaaactcaagactcacagtttgaagatattggtttcttgccaggttcagaagcagaaaaagtgattccattctgtggagccgcaattgacgcgttagagtttcttcataaagatgatgctaatccacaaggtagtattgaagagattatgaaacgtaatgttattcaatttaaagcactaaactttgtacgtggacgttcattcaccaacactattctagtagttgatgaattccaaaacattacacctgcacaagccaaaacaatcttgacacgagcaggattaaactgtaaagtagtaattatgggtaacttgagtcagattgacagtaagtttattagtcctgttaacagtggtttgacatatgtaactgagaagtttaaagattgggcaggttgtcgtgtcatcgaacttgaaggtgttgttcgctcaccactagctgaatttgctgaagaaaatatgtaatattgtatgggacattatgtcccatacatgatataatgttgttatcataatacagaaggagatataaaatggctaaacaacctaagaaaaaagaaccagtagcaaaagttaagaaagagaaagttattcaatctaaagaacaacgtatgtacgaacaacgtaagagtgaaaccctatccggtctacaagctctacgcaaacaaggtgtactaactcgtgcacagtaccgtgaactagtagctcagaaaggtttttgattcatttgaagacatattgtggagttcttaataaatacttttataagaataataatactttttattaaattaaaaagaactccatgtgttatttcagtttttcgtccctgtcttttggcagggattttttatatctatatcttgacaaaaggaacaaatcatgagaacatgtactaaaggaagaatgactttccattaggttattttaacttaaaggagatttcatatgttttttgaccaaacatttacgttgtatcacgattctggtaaagttgagattattgataatctgttagagtacattgcggaacatgacggtatagaccgtttccacagtaagatgaaattcgatttagctgaattcaacaaaaagaatcgtgaaacattttggaagaaccgtttctattacgaaatgtttccagaaaagtttgtgggttattatctttgtactgaaaaaggattacttgtatctcctgatttacttatgggtgaatacatgatactctataatgagtactgggaacataaacgtaaagctcgtgatacggaatggcgacataagcgttcgtatatgtacaaacataaccactcccgatacaagcgtcctaagactcaacaagagcgtcgtatggcttgtgcagtactgaaggatgagggggaacctgaaatacgtggaagacgtaagatgcgttcattaccatcgtattgggacgatatcagaacaagacatagtactggctggaaatacagtactaaacgtaaacatcaatacaaagggagctaatgctccctaattttataggtgaactttatgaacaaaattgacgttactgtagtgattggttatattgaaattgaaccgtgtgacattgatacctttattgacactcttgataagtatcgtgctgaatataacggtcacattagtctttcaccagacagtggttacggcggttttcatggatacaatgtaatttggaccagagaagaaactgacgaagaatataatacacgaattgaagctgaatctaaaagatgtgaagaaattgaacgtcaagaaatgaaacacttaatgaacaagaaatcattaagtaccgaagagaaatctaaactgctaaaatacatcaaggattacatgtaatgaaaaatgtaactcaagaaaagattctgtaccttgcaaagtacaatggtggtttcaatatcattagccgtgagtacagtggtaatttggctaagttgattgacagtttgttagaatttgatttcattaaatgggaaactaatgaactttggtacgaatatgctggtcagaaatgggaaagtgattatgataatgcaatacattcatacactatcaccaaagcaggtgaagttcgattagccattatgcgttgtgcatatacttacaaaaatcataaaggtgaagaaaaacatattcgcagaaatgaagagctattacttctcatggaagcagcaaaagtcacaatgcatgatttgttccaccacccacgttggtatgaaactctaacaaaagcagagtacaaagctttacgttacattgatgaacaaaacaacaccccagttgaagttgatgatgttagtgatgatgaactaagcctcaaaaatgtatttgaaagtaccagtactgaaagtattacagacatttctgtacagatggcactaaaagcaatggaacttttcaagacacaatatgaaggacacagtgctgaagaagtagagcgtgagttcatcacacgcgtacagattgcattgttccaatcgaaaaagtaggatgatatgaaatatgaacatcagtgatgggttatcatataaagaagcaggtaaagatggtgtcaaaggtgaagctgtagatctttgcatttgtgcacttgacatgttcgctttgtaatgcgataatatgagttcagaagagatggaacgtgagttccttacttacatgaatgttaaactagccaaatggcgtaaatcaattcaataggtattttaaatgaaaactaaaattatttctgaacaaaaaattggcaatactacagtactgaatcttgaagttcaaggtcttagtaatgttcgttctcttacggtttgtactcagagagatgatttgactgatttctatagctcagaatacatgtcagaagaaccttgggatatgggatggttggacggtagtagttatatcagttcacgttatagttttggttctcatgaaaatattgaacaattaaaaaatgagtatattaaactcagtgatactattgaaatgaaagaagaagattgtgtagaacttttcatttttgaattcgatgccggaaatggtaattcattactagtaagtaatattgaagaacatttaatgtatcatgaaattgaagatgtagattttgaaagtattaaaaatgttgttcatatggttggtggtagtattactgatgattcagatatcggtcataatatttcactgtgcttaatttctcatccaaaaactcgtggttttaaagttccacaagatgaaacttacgtgtctgaaactgctgatgaaggaatttatccttggaatgattatgtagaatactatggtcatttctgttctgatacaaaagaactgaaaaaaggcgaacaatattttgatatgttccgtgctgcacagcgtttagtactgaataatactgaactatttcctgatcgcggcgaagaaaatatgattgatattatcttcaagaactatgattatgtacagaacattcctgataatgttcatttggaatatgttcacggttcttcaaacaaattctataatattgaattgaatgctccagtgtgtgaagtaattattgagtacggtgctattggtaaaaccagtactactgatggtgaagaattcgaaactattgaagaagcacgtaagttcttcgagaagaaagtaatttccaaaattaaaagtggttatagcccaaaatgaaaatcacacgctttggtaaaacctttgaactaaacattgtttctgtttataaaaaaggaaaatcaggaaagttaagcactgataatattagatttgttattagtgattattatgatatgtttaatcaggcatttgaagaaaataaatttggtttgattttatgtaaaccacaaaaaccggaattaggtattttggatttaagaactgataagtctgattttattggtaatcttgatattattgaatttaaagttgatatatcaaaagaacattttagagttaaaaactataattattacaaagttgatattaattctatcgaagtacaaaacgtacttgatgaacttatcagtaataattcgtgttttactaaatgagaaaaaaatatcatgaaaaatatattcattacattaacaatatttgtatccattattctctgtggttgtgctcctaaagttgatgagatggatgctgaaatcatccgtcaaggtttaacaaaactaaatcaccaaggaacactatacgcatgtcatactatgcgtcatgggcaagatcttaatctcatgtgcaggaagattgtgaatcgcaaacgtcttaatactgttccgaaggatgcacaatgaaagaagtaattgactacaaatgtaaaaattgtggcaaagataagggtaagcattcagtacaagggatggcttgcccgaatccaggtcgtggtaatttcagcgggttcagtactgaaaagtcttacgaaccggatcataccaaacctgtaatgggttataaattatgagtgattatgtagcatttcttcatcgctttggagaagctaaagaaaaacatattatccgtatgccattatatggtgaaaaagactggtacaaaagtactgtcagtgtaggtgcatttcgtgaccgtgaagctggattctttctgggtaagaaacatgaacgagaggtactttgctcactgtggcgtttggatgaatgggatagtgagaacgtaagaactgctgaatcaatgctggctattgttggtattgcgaactatcagcacccatatgacctattacctacatttgaacatgcttctttgtttgacttttacaaagcagtagggtatgattataaaaagaaacgttacatttaatatcagtactgtcataatggcagtactttttaattggagattactatgactacatcggaaaagtactggtggattttggctcatcctaaattcataaacaaagatatggttccagctaggattgatatagaacctcatgatgtgtgtccaatgacaaatcgaattgaagatttcaaagcattgaatacaaagactcaattttgggtagaatttctttcaccaatgtatattgagcaagacgacgaatgggtacaagcacatgattatcaattggattgtggtggtgatacgtatgaagaggcgattgataaattatacaaaaatgtgctaaacacatatggtgattacacccaacaagaagcagataacacatttaataagatccatgcattcaaatctactccatcaatttttaatcccactaaaactgtttgggaggaacgacacagttggagttcatgtgtaatcgatgaagaaaccaaagaaaaaatcatcgatgatataaaaaatttaaaaaatacgatagaagccttgcgtgaattcataatgtcttgtacaatagaacaacagaaagaggcaaagatacatttggagagtgaagaatgtaaactttgggttctagagaaatctattgaaaagggtatagacttagacttatgaatagtaaattggagaaactaatcgaagaattacgccagatgccacctattgaacaagtaggaaattacaaacggtatcgtgttattgctcgtgcacttgataaaaaaggtagagtactggcaactcgcacaaattcttatacacagactcacccagtacagaagggtttcgccattcgtgctgggcgaccgcaaggtgagtttcttcatgctgaaatttcatgtttactggctgctcgtgctgatgttcatactttactgattgcacggataagtaaagatggaattcctgttccggctaaaccatgtgaaatttgctcattagcaataaaagaatatggggtgaaagagattatccacacatgaaaattgaaagatatgttaagcatactgttgggtgtataaatgatatattctattattatatttttgcacctgaactacgttttcaaatcacaacatacaatgatggcagatttaaagatacaaacttcctcataaccgacttagcaaagtatgcgaatacagaacattttaatcatttagtatttgtgtactgtataccaaacccaaataaaaagtaggagattaaaaatggctaaaacaatttctttaaaaaatgaaaatgtaggacaacgcaaagatggtttctttggtttttcttggacaacattattctttggaccgttccctgcattgtttcgtggtgactttattacgttcatcggtgcattcgtaatttacttcatcctcaacgcagtgtcattttggattgtgggtacaattgcaatggttgtatgggcatttctttataataagtactacaccgtgaatctcatcaagaatgggtataaattcaatggcacacatgaagaaaatgctgaagctgcaatggctttgcaaattgatttgaataaaaacaacacagttgataaaaataaagatcctgaataaatggaaaaatacgagataatttacgattattatggtaaggcttatatgaagtgtgggcgttatgttgaactctctaatagagaatcaatagacccccacactcttataacaattcataattcgtactataaaaaagttacaatagctaattttgcaacatacgtaaataatcctttatttccttacattattcagtactactgtagagttatcaaataaggtaaaaagaaatgttagctgatgaatttatgtcactaagtatcaagatatttgatatactaggtgatgaaacagatttcaatctaagcgacaaagatattccattggaagatggtggatacttttttgcgattggaactacgtataatctggatctttcaaagcctatcagtgatgatagtgattataatgcaacaacatattttgatttccagcttgatggacataaagagcgtttactaacgtacagacgtaaaggtagtttcaatagaaccgagattacaataatggattttgaaaaacgcattgaactagctaagaaacatccattcatcagtactcatacatttaatagactaatcgatctattagataattatccatatacaatccgagggtcgttacgtttaaatgcagaatgaaatcttcaaaaaagaatacgatggtgaaagtctctatgatattcaaagagacgtacatgaagccttcgattcaagatttaacccattagctgaacaaatcccacaagatgagtttggttttcaggaaggcactttcacagtgactattacatggagtccagatgagactagctaaacttgtcataggttgtagtgcacttgctgcatatatgcttttttccgcaccaaccaatgtattactgttaatttgggcagttgttatattagcagtactttaaagcaccctagtggtgctttttctatttgtgcaaataaaaaccaatgtgacttttccttgatataggtcaagagaaataacctgttctgacgctataatgttgtctggtgatattaaatatcttcacccccagatgatttcaaaatacaaggaatgtacaatgcaattagataaattatatactgacgtaacgaatttcctcaatcagagcaatactgatcttaccaacgaaaatgcgaacaaagatgcgaaatgcgtcaatacacacagggatttacttgcaggtatcctatctaagcattattcacaagatgttattccaaatgagctaatgcagtggcataatgatggttatggtcatattcatgatttagactactatatcagcccattaaccaactgttgcttagttaactacccagatatgctaaaaaatggatttaccattggttgtgccaaaattgaagaaccaaagagttttagtgtagcatgtacagtactgacacagattgtacaagctgtagctagttcccaatacggcggtcaatcgttggctcacattgatgtcggtttagaaccttacgttcaaaagtcatgggataagctgttagaaaaacaaaagaaatataatctaagtgatgagttcattgaagaagaattacgaaaagaagtatacgatggatgtcaaacattactttaccagactaattcaatgattagcactaatggacaagctgcattcatttctcttagtttagggcttaatacttctaaatttggtaaattaatcactgaacagtacttaaaagttcatgagaatggtttaggtaaagataagattactccagtgtttcctaaagtaattttctttttacaagatggtataaacatgaataccaatgatagtaattatgaccttaaacagttagctatgcgttgtgcatcaaaacgaatctacccagactttgtttcagttccattaaatcacaaagtgacgggaagtagtagtactgctgtaacaccgatgggatgtcgttcattcttaggaaaatgggaagattcaaatggaaatgaacaatacaacggtcgtttcaatttaggtgtggtttctatcaatttacctctaattgctcttgagagtgattctgatggagagttttttgataagatagacgagcatatgaatattgcatatcgtgctcagatgaaccgtgtggagcgtttaaaaggcactaaagcgaagcagaatccaattttgttcatggaaggtgcattagcacgtttaggtgcagaagaaaccattgacaagctattttacaatggttatgctagtattagtattggttatgttggtcttgttgaatgttcagaaatcctcactggttctatcagtaaggagttttgtatgtcagtactgaattatatgaaagtaaaatgtgatgagttcaaaaaagaaagtaatattgcttttagtctatatggaactccagcagagtcgctttgttataaatttgcacgttgcattgaagcaaaatatccttcagtactaaaacgtgattacatcacaaattccttccatcaaccagtatgggtagaaagttctccatttgataaatggagttatgaagaagggtttgcttacctaagtaacggtggaaacatcagttatgttgaatctccaaacttagcaaacaacattcaagcacttgaaacattagttaactatgcgtacactaagataccatattttggtattaaccaaccagttgaccattgttatgaatgtggcttccagggtgagttcagtgtagataaacatggtttccactgtcctgtatgtgataatcgtaatgagaagacaatctcagtgattcgtcgtgtttctgggtacttgggtaatccttcttcgcgtggcttcaataaaggcaagcaacaagagtgttgtgagcgtattcagcacaaataaggtaaattatggatttaaagccaattgtggttaacaaatacaaagaaccgtatgatgtgtatattggacgtgggtctaaatggggaaacccatttacccatattaaagataaacaaaccaaagccgagttcattgttagtacaagagaagaatcaattgaaaaattcagagaatacattattgaacgtatttcttgtggagaagttaagattgatgaattacttgaactcgcagggaaacgccttggttgtttctgtaaaccaaaatcatgtcacggcgatgttcttgtcgaaatagtgagtgcaatattagatgaattaccagacgataatcaaggatgatttagtaaatggagagggcgttcgctgctctttatttgttagtgggtgttcgcacggatgtgatggttgcttcaatgaagaagcatgggattacagaagtggtcaattgttcagtactgaaacagttgagattatactacaggaactaaaaaaaccatatgttagtggtttgtcacttctaggcggcgatccattaatgaaaaagaatatagatgaagttttaaatctatgcaaagtagttaaagaaacttatcctagtaaaactatttggtgctggagtgggtatactttagatgagattatgaaaaatcatgctaaagatatacttcagtacttagatgtattagttgatggtaagtttattgagtccgaaaagaatttaaaattacctttccgtggttcaaataatcaaagaatactatataaaaataaagatttttagcataagcacccgttgggtgcttttttattatgtatataaatacattaactaatatctaatttataagggatatataatgtcaaagaaaatatatggtggcttagatgtcacacataatgtgacagttaatggtaaaagaacaattcaaggaataaatgaacaagtttttgattccaacggtaacttggaattagatacttattccagagatgaagtactagatatagtaagtatgatgccaatctcccattatggttcacaaaactatctacctgcgggtgtttctggggatttcaatggtgcatcagaaaaccagtcacaacgtagaaataaaattttattagaaaacgatggtacactagtacttttacgtagtgggacaaacggtagtgttgagggattattttattcatatttggctaacgcattatcagttgatgacatgagccgtacaattaacactagtcgtcaatacaagcctgggttttttggttcaaatagagttgcgattggtttatacaatactgatccaaatattttactcggtagatatattgatacttctaacagtactaatggtttgttcatatcaattaccaatggtacattagatgataaattgcatactggttttttcgttaaccaagcagatatatcacctgaaggtggtattgaatatgctatgatggcagaagatggttctatatatgtttttaacgtacttaatgaaaataaccaactacaattagttgttgtaaaagttgtttataatataagcaatggtacttatactgcaactcgaattactggatggactactaaaacattttataacacgacatattctgcacaaaataatatggttattactaatcaggtaacatcaacaaatattgctgataaaccttatgtgtatgttccacaaaatctacgtggtattgggatttacatgacatcaattgatttatatgttgcacagcagccaggaacgcagaatttccgctttagaatgaacggggacgcttggtttacaatggcaacatataatacacgtccacagcatagttacagttttgtgttcaatatgagtactaaacaatgtacattagatgcgggtaacgatattggttcatatcaagcaccattagttataactaatactggttcggcattagttcctactggtaacgttttaaataacgatccattgtataaccatgcaaatgcaagaaacatttatagttcatatttttatttgaattctggtgaagctttttgtactacatgtccaaacttagcagaaccattacttatgcaaaaagctaagtttcctattcaaatagtttatagtatgctgaatgtccgtgctgtactttctactgacttcaaaggtggtatagttcgcccgtcttttggttcagcggttggttcatttattaatggtgtagaattactaccagataacagtactaaacaatattcacgtgcatcaggtagtggtggatttagaccatcatatgcagttcataaaagtactcctaattttacatttaaatcattatctttaggaacaatacaaggttatgaacctacagttgaacgtgctaatgttgatgataatgcaaataatagaatttttattagtagtatttctgggtcaactgtcacaaccaatggtggtatttttatggttgggcaacgttattcacaatcattatcctatgataaaaacttaaatggcacaggaattataagcgttacacaatcagtactggacaattttagaaatactgaatatgccaaagttctaagtgattggaatttatcagcacaagcataccgtgatatgacactatttgttccacaacaaacagacattccagcttttgttatgttgagtacaattactaatgattatagaaactatattagaattgctgaagttaatgtcaatactagagttggtaatattacatctattacatttaagcgtttagtacttgagaatacgtatggtgataactttacaccaactgggaatggttcgattgcatcttcttctgttggtttgaccatatatgatggtggttcattctacttcattggtggttctgacccattatcacatccaacaataggtaatactgcaactcatcaatttagagcatatgtaactaaatcaactgcacaatttacaagttttataattactggatctcatgccagttatgaacaaggaagtcaaccagcagcattacctggtattggttttggaatttttgaaccaatggattactcaaataaaatgacattcaaaaaatatggaacaacgattgcagactataataactggactgcacaaggtagcccaattaacgtagtatcccaggacgttgctcaagggtttattgtatattttacagaggaaacaccagttattctttcaggtaagtcattttcactaccagtttcaaatattgatttgagaactattaagtctaatccagcaaatacaacattttatgtatatgttaaattggaacaaggattggcaaactattacataactactgatgttatttctgaaacagggacaactgcatataatattttttggataggtacaattcaaactaatgcaattcaaatcgaaacaattaatatacaaaaacgttcccgtttagatatatttggtgcttcacttgaatcagcaggttcatcgttcccagttagctacggtctaccatcacaaacaggaaccataaactggtaaaggattacataatggcatataaaataagagcagaccttaaggcaatgcaacaagttacagttcagggtaaaagtactggtcttggtgtattaggtaataatatgacttattacccaacaaattcaaatggggaatgtacattcccctctattaccaaagatgaagttaactttattgtcaatggattaccacttacacaatacggagaattgtatgatgacgctagtctaaatattacttcatcaggctatagtcttacatttaatagacagataccatcatttattggtggttatctttataaatttccagcagtttctatttttgcttcaactgtttcatctggaacacaaacacaatacgtatatgcaacgttagttctcggtgaaccaatttataaaatatcaccaacacaaatacaagaatctgaaattataatgtttattggaacactgaccgttggtacaagtggtattacaaatataaacattaataaagtatccagatttagtacatatagacctagtgttacacaaaaaggttcttcattcccagtcagtactggaaaaccatcagaaactggtacaattggttggtaaattaaggaaaagaaagatgtcatcaaaacgaattataggaagtgccgagatccttgggaacttggcaattggacaaaggtacgctatgcgtacttttaatggaacctcaccgaatgccaatactggaattgttcaatatccaatatataagcgttcagaagttcaaagtattttagatatgttgcctatatcacgtgtaggagaaatggattacttaccattaaacgtaagtgggtcgtatgaaggtgctacacctatgtcaagtgaccaagtagttcagccaacaattattgaagatgatggaaccgccgttgttctgcgtagcggaaccaatggtagtactaaaggtttttattattcatttatacgagaactccgaaatataactatgatttcacaagaaagtgttatttcaaccaattcaatgtataaaccttcaattatgagtagtactgaaaatattaagtattttattggctctaatggttatgagatgcttggatgtttaagtactgaagataattatatttttactataaccaatggcacatttaacgaaatatcacatattcatgctaaagtgccaagtacttcttttggtaatgatatgccaatatatacacatattgttgggacaaaggtttatatttggtgtaaagataaaagtgtttctaatttaggattagcactttcaatttatacagtagagctaagtgatgtgaaagcaagctcaatggcatcattaacaaaagttactgggttatcaggtcaaactgttcgaaacacaagttattctgcatctaataacataagagtgttcgataaattatatagtgttggtactagctcggattcattattcgaagttacatcaccagtatcacgtgtagaattttcagactatacagactttaacattcaagccaacgttagtcctgatttatcaaaaatacgtgtaactttatatccaacacatcgaatggttacacctttgtatatttcaacagtttatggtactggaataagttttgtttataatataaactcaaaatctatgtcactagatggtagtgctcgtgcacctgcaactgtttcatataataatggatttcaagtttctaacccatttgaaattaatatggtcaacttcacagggacaactgctgctggtgtattaggaaacgcaggtggtttatgtcaaactaaagatggtttggtatttgcatctaaatttagatggagttcaactgaattttatggtctacaacgatataaggttagtggtacaccgtttgattcatgggttgccagtactagaaccgcaagtaacgttataaatgcaaacgttttaccagtttttggtagtgctgttggtgcaaaccttttaggtgtacgtttcatcgataatagaaaaatattattagcatgttctggtacgtatgatgatgtaacatataattataataatactgttttttctgaaataggttcacaaccaacatatcaatataactcagttcaaaataatactacattaaatggttttgcaccacaatctaatcgtaaacaaataggcgatgattttacatacactgctatgatttctcttgttgataccgatggtagtgttagatgctatggaacatcattcattgaaggtgtatataaaacaagtggtggattattaaatccagatactttagaatttgatgaaacatatacaatagaaccaacggtattagaatcattaaaacaagatatttttgctaatataggaaactctggcattgttggtacactatctggacaaattgtattatattatgtacctgataatactttttctaaatccatcgcagtagtttcagcatataatcttaacaataaccaaggttatgcaatctatgccgaagttgatgttgtattatctggaactaacataacttcagctacattggtgagtactagatatgaaacactgagttctgttacaggaattattactgaagcatatatgaaacgttgtactggtctaacagttgcaaaatattcaggatttggttacattggtgttgatgctgttcatcaattttcacaaccaggtaatgcacaatttaagatgatgatagctaaaacagtagatggtgtcataacatcaaatcgttttttatcatctagttacatccaacttggtgcagcatatcaacatggtgttattcctggtgttggttttggatattacaattttcaagattctgactatcaaaccaaatctgtattcagcgtttttggtacaacatctgctgaaatggatggtttaattagcggaaatggtagcgttaaagaaaagattgtggtagtatcacaagacgttgcacaaggattctcagtgtactttacacgtgaagttccggtgtttttaggtggaattttcgacagactacctatacaaagtgttgatttaagtactgtaaaaagtaacccagctaatactacgttctatttgtatatacaaatgaacaggaatactaagaaagcgtcatatgttattagtactgaaacaattgatgaatctttaactagcacttacattggtaagatagttactggaacttcaggaataacttcaattgatacagaaaaagtaactcgttttttgacatatcgtccaagtacaacgaaacgtggttcagcgatacctgccagtactggtgtaccatcaggtccaggtacacgttggaaataaatttaaagctcgtctattgacgggcttttcttttatgtgtataattgaataaaaataggaggaaattatggtcaaaactttattaccaccaccaaaacgtcacaaaatcaaagaaatgaaagaacaacgtacattaaagatgtacaacaatttagttaagttactgtgtaaaagtccatcgctcaaagcagagtttaaaactgatgatgaccgtaaagcactaattgagatgaaatatatgctcagtaaaatgtccttttacaaatttgtaaaagaatacgcatctgacccatttagtcctcgttggagagccaaaccaagagagtatttttacggtggttcatatacagatcgcattcaagacacagtgatgggagttgaatttgaaatcgattatgagccgaatggtgaggaaatcttgcagattgagaaacgtttaccaagtgaagaagaaatttatgtttatgcaagaaaactttcaaattacagttcaagaattactctaggcaatttagattcattaattattttctatacacgtgttggtgtagataagatggtaactaaactcaatgaactttcattacaacaaaaacagattaatgcatacaaagacattactgatttatactaatgaggaatggatatgttttttggatcagttggaaaacaaaacagtactttaatttggcatgaaattatcttcaaaattatatctaaaagctactcactaaaggatattatcaccacagataatgatagacgtatcctgttagatgcaaaatataaattgagcaaacaccctttactttctttaatcattgattacgttaatgattatgaatctagtcgttggaagtgggaagacggcggtttatttcgtggaaaaacattctacggtgcggaacgatatgttttcagtgatgcatcaaatggcgttaagtttgttattagaaactttaactccaaagaaaatgattatcttgaaagtggagtgaaagtatatatcgataataatagcaatgtcctaacatatgacgaatcactaattatgttacaaataatgcgtggtgttgaaggtgtaagaaacaaccttactaaattgaaaatccagcaaaatgatatacataatagacagaaaattaagggtttatataaatgatttcatttttcaaaaagaaacaaaaagttgatgaaacaggattagaatcgtttctatggactcttatcatcaaaaaaagtccattgataaaagaatatgctatcaatgatgctaatagaaaaactatcattgaatacaaatacgaattatcaaaatgtgatccaatcgtttatcactttgcgaagtactgttcaaaaaatttatcggatatcacaatagaccatgagtcagttccaatgagctttccttatggtgattgggtagatacttttgatatttttgatgggtccaatggattcagtttcttttactcgtcaaataaagcaaatgttcgtattaaaacagagataggttgggcacagcatagctcaaataaagaagattataatttactagctgacgtataccgaagtgtgaagaattcaaaggatattgatgaaagaattaaaaagcaaaatcgtatttctttatcacttgaaacatacaagtcaaagtatggtggttaacgatgactacagttgatgatatctacagcactatacgcaatatgagtacagatagaaaagtatttggtgataaagaaaaatctaagtgttatggtattgattcttttgatataatttcttatgagtacaacacgagtggaaatagttcactgaatatcgtctgccctcgtgacccagaaaataattttatgtatgttgaaattaataatgatggaatattttttacaaaagtttttaaaggtggaattaattacgaaccaattgaatgtatgaatgaagaaactttctttcaagaagatacaattatcaatttaggttttagttttgatgattataaaacattagaacatgactttaatcgttattataacggtttcttaaaggagttaacaatttatctatgaataaccaatatgttgaacaaacaatagtgaaacacttggctgggtcacaagcctacggaaccagtacacctgaaagtgatactgattatcgtggtatttttcttgctaataaagaatttattcttacgccattctataaggtcaaagaagtagctgataaaaatgaagaagatactaaattctatgagttaaatcagtatttaaaattatacactgaagccaaccctaatatattggaatcactatgggtcgaaccagaacacattgtagaaagtactgagatttatgactatcttcgttcatttaaccaaaaacttcttagttctaagattgcattttcatatactggatatgcatataatcagattaagcgtatgacaaatcaccacggttggatggataaagagcgtattgctgaaaaacgtttaaatgagattttagaagaacacccagtcgatgaggttcttgcgtggatgtatgattcatttccacaatatcttgttgaacgtttagatacatcgaacttacatccatttaatgctaaaaagattgattttgaaaaatatatgcgtgatacgtcattgcagttagtttcgaaaaatccattaaagcaatatcattttgtaaaattagtgcataactacactactgacaaaattctagatcgtgatttcaatttattgaattttaataatggctatgaactaattcattacggagaaaacatttttgcgattattaaaaatccgaatgaaagcactatcaacggtgatggatcattgcgttatttttctaaagagcgtagtactgaagagttgaaaactaaaccagaactaattgtcaaatttaacgaaaaagaatatcaggaaaatagtgagaataggaaaagttatcataaatggaaagaaaatcgtaatgccaaacgtgctattttagaatcacaacacggatacgattgtaaacatgctatgcacacaatccgacttttgaatagtgcagaagaagcattacaaagtggaattattcaagttaaacgaccagatgcacaaatgttgatggatattcgtaatggtaaatggaagtatgaagaagtattagaatatttcgatgataaagtacaatacattcgtgatgttctatataagaaatcagtacttcctaaaaaaccaaacatcaagttagcatcaaaaattatcattgatattagagaaatgcaatggtataagtaacatatacaagtgtaatggtactaaaaatgccattacactcaataaatactcaatataaattaacacaaggattaagtatggcacaacaaattttcacagatatccacactaccggagttattaaatttcaaaataatttttcaggtgcaactggtgtagacattaaaaatgatggttttaacattgtcagtactcggatctattgatggtgaagatagttctcttagtgattctgtgattgcatcattcggaactaataaaaacagttcttttattatatctggatggactggaatgactgattctgaaaataatgttaagataaaagctaaatctactaacgagaatcatgaaacagaatgggtaacattatatgatagtgcaagtaataagttatataatgtactaagttctaataacattttaattaatccactgtcgggtaatgctgtttttaatattaatttatctgatagaaatactactatttcgattggtgcggctcctactgaagtttattcaattaccatcctattaacacaacaaacaggttcaaacctagttaattggggttctaatgttaaatggtcatataacagaccagttgttctttcttatgaaattggcgaaaaagatattatttcattagaaacatatgataaaggagttacatggtacggtgcattaattagagcaggagtatgatatgttaaacaataatattaataatattgtacaacttctttatgggcatcacaaatttattgaaagaaatactggtgatacaatagacccaacagtacaacattatgtggtgaataatcagggtgttttggcgaacaaccgtcattttattaactattctgcaatggaaggtcaaccaaacggtgacgggacaacagaaggtcaaagtctattaattttaggatacatttatgcgtatctggcaacaaatgatccaatgtttttagataaagccaaatggtactgggatgcatatcatcagtacttttatgctgggcgtgaattaccagacccaccaaccccactgcaatgtaactggatagttaatgccaaagaaccgattttggctaactggcctttagctgatgatggatggcctacacatggtggtttcaagggtgtagaatttacatttacaaatggacaatgtaaaataccacatggtgcaccttattatggtcagttcttggataaagtaacatttgcattcaaaggtgctttagcatggaaccaaataaatgcgtcagtaaaagcattattaccagatggtagtgttgattgggatacaccaggtgaacaatatgatgttgactggattatcgatttcatgggtagaaaaatcgactgggatggtaatattttagcagaaggttttgacgaatctgaaaaaggaactgttcaattaaagaatacaacaattaatggtgtatataaattaaattttgcaaatcgtcaaccagtagaatatggtggtgtgataattcaacgaaatgaaatgcaacacaaccgccctcttcatgttccaattgatttggaatttgctgataacgcatcagatgcagaattatggtttagtgatgcttcttatttgttatataaaataacaaaagaaagaaaacattatttgggttggaaatgttcactactaacgtgttatgcttatggtgatattgactccagagataaatttttcagacaaagtacaattgtaaccacaccattcactgatggtatttcctatgaatatttttatcctagtgatgctattgctaagtttggtagaaattctctaggatatattactatcaggcaagaccaaagtgcacaaagtacaatggaacaacaagctatttggttcagggtcaatgctgattctaaattacttgtagactatggtggtgtatgtgatgatggtaagccgttatcatttaaaccagtactggaattgtcaaaaacaaaaaatgaccatgatgttgttcgttatcgttgtggcttaccggaaagtaaagaccaaaatatcacacattcattaacacctttaagtgcatttgttagagaaaagaaagcagatggttccccttatataattgctgataatagaattgttgttccttatggtgcagcaacgtccgaaatgatatatagtactgatatattagttacacgccgcgataccattaatcagttagtttgtggtgaagatgatggtgctgttattggattttggctattagcaacaaataagtctgaagttaaatcttttacctatcgttcatatgaagatgattacaatataagaattgtagatgataatggttggagatggtggtggatgattcctgcaacacacggggaatggactacaatcacactaagttccgatacattacgtttatctgggtatcagccaaatcatccaagttctgacccaagaccagatgcaccagtttatagtgaactagaagatattactattttacctgatacaaccccagtagatggtgttgctgcaataattgattggtattgtattaatgacattccagaattatacacggatgctgacggtgatgactatactatgacattttcaataacaattgcaggtgaatcaccatatactgcacagttaggggattgtgtaatcaaggattatttgttaaactcattgcattacacaccaggaacaataccattttctaacatcactgacccgtatgcgaaccagtattcaggatggcgtggtttaccgtatccaggttatcaatatcctgtgatatattgttttaaagaccagccagtagataacacacgcttaggaaacatgttaagctttatgaaagattcccaaacatggtttactcaacaattcggtactgttggtccgtgtgcacaagcatatgtttggaaccgctgggataacttaaaatatggtgaaccagatacatttactatgctacattggggtgatcaagcatggagtgggtatgaaccacgtgcgttctttggggctgccagagcatggcaagaactcgcagagagaggaattgaaccaccagcagatcttgttgaattttgtgagaattggattcactttttaattcaatttcaaaaagataatgatggtcgttcaccaacaatcttcaataaagatggcacagttgaaggtccagattgggactttacaggtcatatgtgtgggttgtggttagctggggcttgtgctgctggattggctggatgtaaaatagaaggtctaacaacactcgctgataacttagttctcgaacttcaaaagaattatgttattgtaaatccaggttcaccaatgaatggttcatggagtccagcagttagagaaggtactgataatggtatgttttttggtttctgggcaggtgagattatgcgtggattgggattatactcaatgtaccgcttaaacacaccaaatcgtttccgtgatttataacttgacatagaaaaagtaattatgtataatcagagaacttcatatggagttctctttttttataaggtgataaaatgttaaatgaacgtattaaaaatgcactacatgtattgaaccaagaagtaaattctattgataaaagtactgaccgttataaagtaatgcatgaaatcaaacaagaattggaatctattaataagggagaatggtggtatcttcagcccgaatatcaaactcgtgaattaaacgatgttgaaaaagaaattgtcaaattcatcactactcgttactgtgatacatcagagaatgaggtatcagcgaacttcaatcttactaaattggaagtcgaagaaaaattcaattttgattggcttgattggattgaaatggtcatggaactagaagaaaaattcaatgttgaagttgatgaaaagttcgagaataatgaaacgaagctgtatgaactagtagaacatattcaaaaaatgttgtaaaactatacaattgtatactctaaataatatcatcaactataggagatattattatgagtatgttagaaataattgtttcaaaaattcttattccattttggaaaccaatttcttttgtattattaattggcggttcagcttatgctggttgggaagctaatacttattacagtggatatcaacaaagcatagagcaacaaatagctaaaaaagttgataccgccttggataaaatgcaacaagaaaatgcaaaaaattaccttgaaactaaaaaaatcatggaagataatgctaaagttattgaaacaaaggttccttttattgtagaacgtgaagtttataagaatgtatgtttagatgaagatggtgtaaaagtactgaatgaactaaaacaaaattctcaagcagcgaggaataaattcaaatgaaaaaattattagttccaatgatttcttttttaattataagtgggtgtgccgagcaagtaaaactacaatcccccgcaccaattaaacaagaaattctgttagaaagatgtgatgatgatacacctctaccacaaaaaattatgattgacaaaaatggttttaaaggttatgatggtgcagaaattcttaaagtacttactcgttgggatgcagtatacaatgaatgtgctttaaaacatgacgcattgattaaaactattcgtgatttacaaggtaaagatattaaaatcaatatcaaggaataaaatgaacaaatatcatgtttactatacgacaaaattatcacttcttgaagaattaaatcaacgaagtactaagatgaaacgctacactttaaatggtattacttttcgatatttcccacaaaaagttcttacttttgttaagaatccaaaatgcgtggcatgtgggattgaagctactgaagtacgcattgaacgttcattatgttctgatccagtatatggtaaaccacatttaaatgtatatgctgtatgtggtctttatgaagttttaatgacagttgaccataatcatctggcatctaagggtggacctgatttagagtcaaactttaatactatgtgctccagatgtaatcaactacgttcgaataaaactgaaacagttgatgagtttcttgagaaagttaaaggtcgtaatcttctccaagaacatatgaataatttctttaatgtacaaaaaaaagaaaaataacattgacaagtcaaaactactagaagaacgtaggttacgtcaagaattatgggaaactgatcatctatggcatgttcgagagtttggtcgtcatatgaaagctttgaaaaaagaacagaagaaattgaataaacatgattgatatgatattatagggacttgagtattcaagtcctttttttttggagaaaataaatgaaatctaaaatctttttaccacaattaatgtggcatctagcagagttagatgaaaatgatgaatatactgactatggtgcatgggatgacagtactgaaacttttaaaccagatgtaaaatataaaatcatctgcaatgaaagcaaaggacacagaaggtggactgaagaatttgatctcgtatttcttgacatgagcacaaataagttttatcattgtacttatgaacgaggtttaacagaagatagaccagtacaaccattcagtactgaaactgatggtgttaagtgcaatgaagtttctgttaccagagaagaaattatcacttatcgaactttgtggaaatatttgtaaaatgcttaaagaattagatttttcaaacttagaaattatcagtgctgtaaaaaacatttccgatatgggagatgagaaagcagttcttgttactattacttttgtaaaagaaaaagatagctatagccatttaactggcattgaagaactaattcataaaaccaatcttgagaatgatggtaaactcatcaagcttcaggcttcctatacgcaaaaaacgtcaaattttatagacctaaataatgtagtcaaggtggtatacaatcatcctgaacacacatataggaacacgacaagaaatgaaaatgttgctaacgattcgaatattatcgaagatgttgaattcataaacacaatttttgatcgttgttctaaggatttaaaaaaagtatacatgtaatgggacattatatgttccaatgatataatgtatatagaaaatgacaacggacattgaaaaatggacactgagaacctacttctcttgaaaatgtaaaggatagatgagctttaccgttgtagcgaacagcagaagaaacctgttagagtactggcattcaaacaaacacgatgtaagaccacgaatcacggcgacacggctgtataaagaactccgataagcatacagagagttcctagatagatgtataaggttcgcaccttaccagatttgctaagggagttcaagaatagcggacgcaatttttacaagaaagttgcgtccaaaatttgagaacaagtactactttgatcgaatagagttagtactgagtgctgttgatgaaaagaccagcgaccgttgcatatgactgcgatagagagaaaccgagcaacccgctttcgctctctaaattttggtacaagaaagatccgtccaaaatttgagaaattcgcaattcgataatatccgatgccatcatcgtcaagagagacttaattgtctcttttttattaccttcattcccctgcggggggatgtaatagtcctcaacaaatcccgtcaagtttttaaagtacattatcattttcagaaggaactagtttacgaagtaaacgcagtgacttcttgagttacgagagaacgaagtgaatgagtaacacaacgaaaatatccgataaatccgaattaacacaaatgttattcaaagaatattttgagtttcagataaaagacgaacatcaattaccacagcaatatttgaaaagaattaaagatccgtcagtaattactaaagaaactaatttttataatagtattttggatttcgttaaatcagttcatacaacaagacctattgtagttttgttttttgataaatctattcctttagtagttcctgaaaatgtattttttatttcagaaactgatttaaataatcaaagtactgtaagtagattaagaaattgcttacttgtagtatgtgattcttctttgtataataacagaatactatgggatagaagtaaacgcaatgcagtttcggaaatgaatcctgaaattacctttattattaactaaataataagagaataactctaaggagagatattatggaagatattaatgatttacgacacgtaatggactttatcggaagtactgaagaagataattcatatgatgaagtactattaacttttattgaaaatagtttgtttttaagttctgctgcacataactggcacttacaatgtcatttttatacaaagcatttacaattagatgaactatataaagaattaccagaatatgtagacgcatttgttgaaggtatcatgaataatcgtggtgctttgcaagttgggactggtaatagttatcgttttacaccaattgaagattgtgtaccaattcttgaagaatatgttgagcaatgcagagcaattcatgatatgcttgaagaatcgggtgattacggcagtgtaaacacattagaagatattatgagttttgttgaaggaacactttacaaacttaaagttttacaataaactatatggagagtcgctatgactctccttttcttttggagaaataatatgaaatcgcatgagttagcaaaattactactatctcaaccaaatctagaaatttatcattatgatgcagagagtgacttgcattatcagaattttgataatagattaatggttacaccatctggtattttcacaacggtaaaacctacatcagtttctgaaaatgtacttacaccatacgaaacccccctcttgggtcatgtgcaaattttctttaaggatggtactattactccaaaattggagggttcacatattcaaactgttcttagcttagaatatgggttggtatttaacattccttatgaaaagccaattgttttattaggtaaaaataaatcaacacaattctctaatcaacatgctgtttgttatacatctgatgatattgatttcatttcagtactgacagaatatgatcctaatacttggcatgaaacatgggaaaatatgtcatatgatgaagcaattgaatgtggtaaaaatttagccaaaatgttatttccaccgaaaaaagaactttcacaagaacaaaatgaatcattttctaaagattttcctgattctgaattcaatgtaaaagtatcaccttctatgattgataaaattgaaaaataaaagaggttgaacatgagtgattaccgcgtaacatctggactaatggcacgtcttattgaagcagttcctgaagatgattatgaagctatttcagatcgtctttttgacgcagattctaaactccatattacatatgatggtgcattgatttacagtactgatattgatatgtctagttatgaatttgagatttcttttggtaacaaactaactactgaagaattcgctcgaaaatgtgagcgtgaagggttctgtattgatattagttcagttcagccatatacatcactgtggtatgatggtgctgatagtccaatgtctactacatctttacaggattttctaaatgcaaatcaaaaagattaaattccaccagcattgttctatacatgaatgtgatgattgtggtatacaaatgagtgacatttatacagtttcctgtaaaggtttcaaattcactcacggtgaacctgcttattgttatggtacagaagaaggtgatatcgaagtagtactgaaagaattgttccagtacttgcaaagtgtaggccatgatgttacaatacccacatattatgaagatgattatgatgcacatgtagaagaaaatacatattataatcaattcgtttatggtaatggttttatcacatatctacatgagaatggtattgaggtaaaaactaagtacaccagtgatgattatgatgatgataattctatggagattgaagattgaaagcaaaagacttagcagcactgttgttgcagaatcctgaaatggaagtgtatcatgagcacatgcacattgatgacatgtgtgacgcttactattcaccagaaaatgtgtctggtattgaaattacccctagtggcgtattcatcagtactgaacgtattgattataattcccagcaagaaatcaaaactccacataataaacctcgcattggtgctattgacctagtatttcatcaggaccgtttggtagaatatgatgaagaagatggtactacccgaactgatgttgagaatgtagtttttcgtttttataatgcatacgaagacccaactactggagaagatttcttccgtgagctattagaggatggagaagtttatggtcaggatggtacggtttttgtactggaccctaactatgagccagatcacaatacatggcaattctatacaccagaagatgtaatggaagttaaagtacttactgatcttgacgataaatggaatcctatgtatacttcaatgacatatgaagaagccaaagaatacttcgtttctaaactaaacattacaaaataataaggattcacaaatttatgaaaattgttgcaagtgcatggatgaaactaccagatggtacaactgcttttgaagaatatggctttgttgaaagtgtcgatgaattaaagcgtttcaagagtgaaaatgatgatgatgtttttgatattgtatttgtatatcatcatattcctaatgatactgattatgaacattattattatcatcctgatttgttggaaacacttgtatgcgacaactatcatgaaattgatgaaaatacagctttactaatgttgagtaccgtatctccggtataaggagtaatatgtataatcttataattatccgcgaaccatatgaatctgacaacagttcaactgatggtgaggttttagtatatcaaagttatgaacaaagtggcattgaacatgaattaaaagattatttacgtcaacatatatatctatatcgtacagaaccacgtgaacagtatggagatataatgtttatcgtaactcataatggtgcagtaattgaacatgtaaatatgacaaataacatgtattttcataattacactgacacgtctaaagaattaggaaacgatttcaagtctgttttcgatgcattgcgtatcaatttttttaaaaatgacaaattctgtactgatattagattagaagaagcaaatacaaaaaagaaactttctcgaaaatacgagagtgatagaaaaaaagaacaagagattcagcgtttacacgaattgatgaaaaaataccctaatgaggtacaacatggctcttagaggttcaaatcaatataaatgtattgcagagatcaggaagaaagatggaacacttgtagaccgagcattgaagcaagaatataaagaattacgtgatgtggtacataatgatagttatggtgggatgcgtcgtcaaaaaatttatgaatatctaaagaaaggtttagaaattcaggttaatggtcttcattgcattcaaacaaaaaacgatcctgatattctacgtttgttgaaagaagataagattgaaatgtttaatgttcctatttcattctatggtaataaactaaaatgtaagcatactttcttgaggattaaaaatggttgattcatttatgaaaaaaatctttaaaaaattactatctggatttgaaaaagcagtaagtcttattttcagttcagttgtaatggttattacagtactggcgttttcactagtactgcattttgtaccattctggttaatctttattgtacttattgctctgctaggtgcacatgtttattatgtttaccgtgacgcattggatgatgataacgattaaatgtatttgacctcactatgtggggtcttttttaaggaaaattatatgcttatagaaacagaaacatttaagcgttttattggcgtatgtcgtgatacgtgtttttgttatctttcatcacaagaacagttcgatgcaatgagtgatgtgttaggatatcgtcgttcggtattgatgaattttgatggtcctttgattgaagttcatgatgatgtgtattccctacaatatgtatcaattaacaatgcgttcatttttattgctgactcgtactcaattgtagttgaggaacgtggtaaagatataccaacaacacactatattgattgtcaaagaactgattgtgtttatagttctggactaatacaaacaccaattccatatcctagcatttatataaacacactccatcaagaaattattgagtactgtaatagtatttctgatacagatacacagtattttcctattgtattattgaaaggagttagaacatgagatggcgtaaacgacatgtaaaaagatttgataaaataatcaaaaaatattactcacataagttagatccaatcatacttcaactaagaagtagtatgtttgatagacgttatccgcagtgtttcgaatcgtacagtcgtaaacgttacaagaatgaatacctggtatatcgttatgatttgccagaattctttttgaatactcgtgtatcagtaccaatcaagctgtactcaagggtaaaacgaagtagggttcaagatattacatatggatatcttatgattgaaatcgacgacctcaatgaaaaaactggcagaaattacagtactttatgtctggaaaatcatgattcaataaaaagaatcatagaagagttgggaaagtgagatttttagtgctataattggagatgagtatgaaatacatcgataaaggtacagtggagacacagtactggaatatccatattgctggtgatattcaaacagcaagagagtacacaagaaagtttgcgtttaagcatggcttttgtgtacaattaattccctgtgaatatatctacactggcggtcttgaaagtgggatgtgtgctcgtattattcagtacccacgctttccaaaagaagaagtatatctcaaccgagatgtattaaactatgcaaagggtttagctgaagagttgtgtcaaaagagctttactatagagcgaaataatgatacaatttattatgaaagtgatgaacctttacacaagaaataaaaggaaaatatatgaatggactaaagaaatttggtaaagattttctaaaatgtatacgctatacatatgatgcaaacccagaaatgactgctattgtgggtgtgtttattacactcgttgtattaagctttattgtggtgtaacatatgattgaaattaatgctgatatatattgtagtgcatctcccaattacttcatttatgcactaagtacatttggtgaaactgaaggtgaaacttttgttttagtagagaatactacatggttcaaaacaagtaataaaattccgaaagatgttttggaaacatatgttcgtattgaaaataaaaacatatatgtaattttataggtaaaatatgattgaaatggaaggaactctggtgtatgatccagaccgtggcactatgaaaaagaagaaggacttctggttagtactgcaacttccattacagttggttagatactaccagtacttcatcagaactgatttacatattgacgttaaagatcctcaatggggagcacatgttagtatagtgcgtggtgaagtaccaccacatgaagagttctggaaaaagtacgatggaatgaaagtaaagataaagttcaatccttgtattgagatagtaaaagataaaaagaatccaggttcattctttatcattgaatttgaagatgatttcatcacacacattagaaacgaactaggactaccaaccaagtactttaaatatcacataactgtaggtagaacctactacgattaatgtggtttttacagtaaatatgtcttgtaataaaataaaaatatgctatactacttaaacatttgaaaagaacgtttttgtactgtagaaagtccgatgaggcttttgcaaatggcctctttgccatctttgtgattgcccatcttaacaatcaacaaaggaggcgttttgaaacaagcgaaaaaagcactgaaaactaagactacttatggtgttctagtttgcacagtacttgtcgctgcgattggattttatggtttttctcaaaatgatcgtgtatcatcatcggacgaaagtcaggtacacaatttaaaaccacaagttacgcaaattcaaaagcaggaattaccaaaggtagaaatatcaaaggatgttccacgcggcgagaagcattatacggttcaacctggtgatagttattattctattgctaaaaagtttaaacctaaaaatgtacaacttgaagagtatgttattttgttgaaaaatatcaatttaaatgctactcttcatacttctcagggtatctttatcccaacaaaagaggatttgaagaacgtattgttaccagatgtgactgtacagtttgattataatgatccagaaattgtcaatcacatcaaagaagctgaaggttcaattgaatttcagtccaagaacaaacgccgtttacttggtgggaaagtcggagttcctttccacaattctaaatttcatccttacaaggatatgaaaggtaattatacaatcggttatgggcattatttgggaagaaaagaatctgatgctatcaagtacagaaacggtattaccaaagctcaagccaacaaacttttaatgcaagatatgaaaagaacatatgatgactttttattattgatgcagaaaaaacaagcagtaaatctgaccaaagaacaacaacgtattctttttgaaatgtgctatacaatgggagtagataagttagcttcgtttaataaactttggaacagtgtaaaaaatgataaccctaagaaatttaaaaaagaaataatgaattccttatggtatcgtcaagttacaaaccgagcagatttgttgttaagttcactctaaaaaaggtaggtaaattatgctaaaattaaatattcaaggtaatgttgattttactacagcaattcaagatgcaatttacgatggtgctaaatgtcttgaaaagttccgtacttcaactgtaatggatattgaagttcatgtgaagaaagagcataagtctcaatactctgtgactctaacatcaggtagtaaatcagttactgccgatgcagcagatttatacaaagcaattggtgattcatttgaaaaaatggaaactgtattcagtaaagacaaaagcattaaattacaccgccgaaaccatccagaacacccagttcttgatgatttgacagaaaacgaagagtaatatatactaaagggacagattaattctgtcccttttcttatggagttttaattatgaattattcctggatggaaattgtaaaatctataatatcaacacatgatatggacttacctgaacacctagttattaatagatggtactatccatatccagataaccgttgtgttgggattggattttttattaatgaaaaatctcaatatattggattaattgaagattatacaaaaaccaacattgcgttctctattgagttgaatgtagatcacataaaatactacactaataaaatggacgaagacgatggtgatgttataattccagcagaaatagacgaagcttcattttttcagttatcattaattcatgatgtatctgatattacttatgataatgtgaaagacctttttatattgtacaataaactgtataattactttttataatggagataaatgtatggaatatacaatatgtatagttatatgtatcatatccttactagtcggggttggtgtgatgatttattgtgatgcagaacccagtactgaagtaggaacaacaataacacttaaacctggtgttaaagttaatgataattattgctatgatccaaacactaatcgatatgagatttgtctatgaaaaagtttgatattaaacctattattgatgctatcgaaattaaattaaaaaatactaaaaagccagatagtacaggtttgttctttagtttagataaaatgtattatgaaacacacgtgtcaagttatgatagaacaggaaatctcttcatccgtacatataacatattttatagtgaagatgtttttatgatagatataaatctggatgaaggtatagtgttgatgtatattgaggatgttcaatccacagaacaacgaaacgggactcttcctattgctgctacagaggaagagtttttgcaatatcagttcattgaggatacctttggtattgactttgatacatatcagagtataatgagggtatacgaactttatgaggattatgtgattggacgttactaaaattccaaaatttaatgaaacgttaaagtactttgctgaacacgaaatcattactgaaagacgtggtttgatttcatacaatcatcatcgtgttatgtacactaataatttccagggtacagttcgtattaaatttcgtaatgcactcgacgacaatgatgaattgttaattttactacgaaaaagtaagatagaattgacatacgcaactcaccatattgaaagtgagttgatgtggcacacactatcaaaaaaagaagggacattaccagttgatgataatggaccagaaacacttgatcagtacatgttcattgatgatacatttggtattgactattctgcatatcagtgtatactagctatacacaaaaaatattacgaccgtctacgtgatagattaatttaattggaggcattatgattgctatgttagaagaagattggggtgtttccgagcaaggcacagatgaatatgaatacccagaataccaaccaaaaggcttctgggaacgtctacgtgattggttgatgggggaataacatgaaaaagtatttggttggcggttacgtccgtgaccgtttaatgggtcttcgtgcaaaagacaaagattatgtcattgttggtgcatccgaatctgatcttaagtacttgcaaagtattggctataagcaagtaggtaaggatttcccagtatatctaagtccagaaggtaatgaacacgcattagcccgtactgagcgtaaaactggtactggatatggtggctttgaagtggatacaaaaggcgtaacactagaacaagatttgtatcgccgtgaccttacaattaatgcaattgcgtatgatccagtactacaaattcacatcgatccatacggtggtaaagctgatatcaagaacaaggtactacgtcatgtttctgaccattttaaagaagatccattacgtgtgttacgtcttgctcgatttgctactcgttattcagactttactatccatgaaagcactgagaaactcgctattgaaatggtcaatagtggtgagctaaatcatcttgttcctgaccgtgtttttgtggaattcgaaaaatcattttctgaagaaaagccttcaaagttccttaagacgctaagtaaatttggttattacgaaaaggtgtttaatacatctttgaccaaaaagaatttagaccttattgattatatttcagataactgtactgatgtatataaaccatattttctgtggtctattcttcttgaaaatgaagaagtaaataatgattcagtacttaacggtgctattaaagttccagttaagtatgttaaatttagtaattatatcaaacgtttccgtgatgatatcaaaacattccgtaaaaagaccccaattgaaatgggtaatattttattggatatgaatattaaaaataacggaggtgaagaattcctttataaagttttggaatacttcattttgcgaaaagaaattgatttagaacttgaagatctaattattaaagtttatgatcgttatactgatgttgaattgccagatattcagcaaatggttaaagatggtgaacttgaaacgtcagaaattcgtgattttgtttgtgaacttcgttacgaagcaatcaaacaaatgttctaaaaatagtgggacaaaaaaccaataactgatataattattagtatctgaacatcgattgatgacaaagagataagatatgcgttatagttgtggtataatattttatcgtgatggtcagatacttatcggacatacaacacggacagaatcattgggatttacctaaagggaaagctgagggtaatgaaactttcaaagaagctgctgtacgtgaatgtttcgaagagacaggatacgaaatcgatgaagatgatcttctgtttcttggtgatgtatcctatagaaagggaaaaaggttagtacttttcttttatactgccaaagacaaaccaataccagatgaattagtttgtaaaagtacttacactaatagatatggtaagagtcatccagaattggataagttcatgtacattgatgtacgagaatgtcaaaagtatttgactgaacgaatgtgtaacagtattattaaagctgttaaagcttttcaaagaaatagaaggaaataacatgaaagttaaaatttatggtcgcaagactggttgtaaattttgcgacactgcaaaagctgtatgtgaacaaaataaatttgaaatggagtttgtagatattgttgctgaaggtatcgatggttcaaaactgtctgaaatttgtggtgaaccagttcgtcaagttcctcaaattttcgtaaatgacatttatgtaccaggtggttgtactggatttattgaaggtcttaaagaaggtcgttggaactaatggatattgaaaaagtatcatctcgtgcaaaacaactagctgatacgttgggagtagagttcaaaattcctgatatttcaatagctaaagaaaaagcccagattaaaattaacaaaatgaaagaatatctatctaaacaagaacagtatgattcggctgtcgaatttattgtaaaatcttttagtaaagatgatattttggcatttatcaaatatgtgaaggtttctggcaaccctaaataaatgtgaagaacaaaaagttcttcttaacaatttgggagatactattatgctcagttttcgtgaacaattagcaaaaggtcaatttcaggctaaagctcaaactaatattcctaaaaaatctgcatttttaggaacaattacggaagatggattttgtgattatgatgcaccagaagattcatggtacattacaaaagacacaaaacgcagtaatagacttcacaaaagtacaatagctagaaagcatcgaaaagaattaaagaaaatccgtttcggtgaagaagaataatttaaaataaggactctgaccacagagtcctttcttttcggagaatataatgattcatgaacaccgaggtaatctgtttgaattattcagtactgttaccgatgatcaaaatgcattacatattattgctcacggatgtaatgctcaaggtaagatgggttctggtttcgcaaaggaactaaggaatcgctacccaatggcatatgatgattataaagcatatgaaaaggaaatgggatttcttagaattggacaaattgcatattcagcaattaacgataatttgattattgcaaactgtattacccaaaaaatgtacggtaatgacggtgctaaatatgtcagttatgatgcaattgacgatgtgttcaaacatctaaattatttttgtaaagttgatcgagatgttcatgtacatttcccgaaaattggagccgatttgggcggcggtaactggaacgttatcaaagaaatcattgatcaccgtctggtcaatgcagaaaaacacttatacattctaaaataaacaaaaggacttgacaaaaatgactatgaccgttaaactactaaacatcaataacattggcccagtactagcagttcttcaaaccgattctgctgaagctgttgtagttaactacccagcacaactagggactgacgaaaatggtgaaatcattcttcgtgattatctagagtttgttagtatggagaaaaatgttattttttataaatccaacattattagtgttagtgatgcaaaccctgcattagttgatgcttatgttgatgctattaaagcaatcgaaaacactccaaaagttttcgttcctgagaataaaatcattctataatagaggtatataatggctgctaatgacgttaaagtaaaaactatccaagctatcgtagtactgaaagattctacaccatcccctaaagaattagtaatggctgggatgactatgttacatcaatacaaccctgaatcacctaactatgttcaagaatacgaagctaagaagtttaaagaacattggcagtcatggattaaagataatgaaatggagcaggtagtatatgctgctgatgacattttcgaactggaacaaattgaatatctagctggtcaacaatcagtaccattgagcattttcggtaatggtgaagaagttctggtattgggaccattcactgctgatgatatcattcacttactgagtaattgtaagaaaattgaataaaaattcaaaactatcaggttaccgtaacaacacgttgaagtacaatgatattaagtactgggttgatccttacttaaataaatcattgttaatgtacagagataaatcacgagatctatatggaatatatgttactcagttaatatatataatagattccgaacattttactccattggtatacctgtactgcttgtataattcaaaataactattagcacctctaaataatgtatataaacattaatgaggtgcttttttatgtcttacgattatatgggtggaaaccctgatgctcctaactttgaccatcgtgaaaaactgaaagatgttatcactcaaatgttgggtgctggggccgttgaggtagaaattactgatggtcaattagaaattgcaattgataatgcggtatcgaattacagagcgtggagttctgcttctaaagaagaagcatttttaaatatgaaattttatgattcacaatctgtatatatgctaccaactgaagttgaaattgttaaaaagatttatcgttatggtaatggttacttaagttctggtagtgggaactcagtagacccgttttctctagcattcaccaacacttacttattgacttcagcacgaaatgctggtggatatgatctaactacatatgattttagttttcagttccaagaactggtaggtcgtatgtttggtcgtgatattatatttcaatttaacccaatgaccaaaaaattaattatagatcgtgatattcgtggtactgaagaagtactattacacgtctatcataatattcctgaaccattgttgttccaaaggcagcaaagttatccttggttgcgtgattgggctttatccgaagcaatgattatgttgggtcgtaaccgtgctaaatttgcatcgcttcctggaccacagggaacgttttctatggatggtgataccttacgcaatgaaggtttacagcttcaagaacagcttaaagagcgtttgaaacgttatcaagatggtgctgaaccactcggtatgattattggttaaattaaaaggactcctatatggggtcttttttcatattatgtgatataatgataatattaatctaaaggaacttgtcatgaataataacataaatgtaacgtataacagatatcgttgtggtagaccaacgcttgattatgaatcaactgaaaagtactggaaatttatcaaagattcaatcattgatgttatcggtagagatcgaataaatgcatgggcgagtatatatcgtgatgatgatggggaaacattttttattacttatgtttctatatattatggtaatgagtcaattcttggattacttgaaagtttagtaggaaaggatttaatagaaattatataaaatacatggagtagtataatgggaagacaaataattgcaattaacggaactattggaagtggtaaagatacatttggtgaatcttttattaataatggttacacacgaatgtcattcgcaaccaatctaaaagattcagttgctgctatctttggatgggaccgtgaaatgcttgaggggtcaactaaggaaagtcgtaagattcgtgaagaaccggatcagtactggtgtgataagttaggtcgtaatgatgtatcccctcgatgggtattgcagaattatggtactaatattttgcgtaagtattttcataatgatatttgggtattcagtttagaaaaatcaatgcaagacatagatggaaatatcatcatcactgattgccgttttccaaatgaattaaaaatgattagatcaaataatgggactattattgaagttcaacgtgttctaccacattggtatggtttggctgcctcttataataaaggggatattaatattaaaccagttgaactagaatcagtacacgaatctgagtgggcttggattggaataaacaatcctgatataattgtacagaataacagtactattgatgatttacataaaaaagcaatggacattatttattctaatacataaattataaacaataaggactggacaattaaatccttcaataaataagactatacgaatatatttcgaataaccaattatttttggaggatttaatatggcaggagatctactctcacctggcgtttccatttcagtaactgatgaaagtatgagtaccgctgctgctcctggcactgtaccactatttgtaatcgctactgctgaagacaaacttgtcccaggaagcagtgcaatagctgcgggaactactaaagcaaacgctggaaaactacagcttctaacatcacaaaaaagctcacttgatacctatggtacaccaatttttcaaatgaataacggttctgttgttcaaggtgatgaactaaacgaatatggcctacatgcagtatattcttatctaggcattactaaccgtgcatatgtaattcgtgctgatatcgatctagcacaactagcaccaagtgctgaagcaccaactggcccagtatccaatggtactttgtggtttgataccgcacaatcacaagtagaagcgtatgtagcgaagaaagatagtccaagcagtttttatgattggcaacttaagccagtaactattgtaagtgctgaagaagttgaagatgtaagtctagtaggtttaaatgttgatgatttagttctacgttacaaaccaagcaatggtcagatgctaatgtataaacgttctgcttctgggctagtgcaaatggaaacttatctatcaccaattaacaaagttccagttggctcaactgtagaaaaaggtaacatttggattcgtgatggttacacccaaaatggttcaaactattttggtactcgttttgttattaaacgttatgcatccctaactcaagtttggaatattgtaccagcatatactggtaattcattccaagaaattgaagcgaaaagtggtgtactaaacaatagttatatcgcatctcgttttgatgaagatagtaagagtttctctttctatattcaaagtgcaaaactaacaacaattagtgctcctgctttgccacttggtgaaactattattgaacaagcaggtgctgatagttatatgacttttgtttatttgaataaatcagttaaagtactagcagttccacaaggcggtgttattaatacccaaactatcatcaataatctaaatgcaaatgctgaaattattaacgatggttttaaatttaaacgtgaaactaatggtggtttagttgtttccaatacaaaaggttacagtttcaaaatcacacaaagtggtgatgatatttttgctgaacctgaactacaaaaactaactgtagatagtaacaactactctctaattaacgttaataacttccgtgttagttattcagtaccacgtagtgtagcaaaagaaggaactctctggtatgatttcgggaactccgataatctaactgtaactatgtatgttgctgatgttgctaatgatcaatgggatctagtacaagaagaaaacaaatatgtacaagttgatgaaccagcggctgaccgtttaatttgggtttgtcctttgtctcaaggcattgatggttatgatttctatcgtaacgttgatggtgaatgggttaaacttgacagtactgatcaaagtacactaaatggtatgattttccaagactttaatttcccaagccaagttcctgctgcggcattgtatcaaaatggtatgcttgcagttgacctaggtaacactgaaggtgttgttaagaaaatggttaatggtcaatgggaagttgttagtggtgtaagtcttgatggtgctggcctatttggtcgtgctgcacaacgtcaactagtagttgaagcactagctgctgttattattggtaatgatgacattcgttctgaatttattgattttaacctaatttgtgtacctggttacgttgaaacacttgatgaatgtgtaactttaaacactgatcgtaaagaaactgcatttattgttactgacgttccagcacgtttgaatccaaccggaaacggtagtgctgtacaacaatgggctactaatgctaacaatgcaccaagcaacggttcagttggtcgtacaactgcttatgattatgctgctcagtatatgggttggtgtctaagtactaacgttgatggtgaagaagttgcagttcctggtagtactattgcaatgcgtacatatgcatacagtgatagtgttagttatgtatggtatccacctgctggtacaactcgtggtgttgtaacaaacgctgcaagtactggttttatcaacagcgaaggtgaatatcaaccagtagtatacaaccaaggtcaacgtgacgttatgtatactaacaacattaacccaattgcaatgcgtcctaaccgtggattgcttgtttatggagataaaactctatctgctaatcaaacttctgcactaagtcgtgttaacgttgctcgtttagttgtttatattcgtcgtcaactagaaattatttccgaaccattcctattccgtttgaatactccaagtactcgtcaggaatttagtggtgtagttaatagcttcttggctgaaattgttcaacaacagggtctttataacttcgcagtggtttgtgatgaaagtaacaacaccgcagagcgtattgaccgtaatgaactttggatggatattgcaattcaaccaactaagagtattaacttcatttacgtaccaatccgtatcgagaaaactcaataaaacactaagggaaccaaaaggttcccttttttattgattaaaattaaatacctttatattgatgttataaaggaacattatggatatggaagaaatactaaaaaaaacaatacaagatgtcagtaaaatagttttaactcagttggaatcagtacacatactaaatatatttttaaaaaatttggaagattgtcggtataattgaaaaatacgaagtatacacaaatggaaaatggtctatatcagtaaactatattgaccacactaaacgaaaaagatacttatattgtgttaatattaattggttccctgttgatgacactttagttaattaaaaatatacttccagatagataaataatataaagatgtcattccataataggagaatataaatggctacaatgcttgatcgatatggcgtaccgctcgctggcggtggtcgtatctctatgaaacaaccaaaagcaaaatacaaatttcgtgttattttctttggttttggtactaatgatgatggtaatatgattacactagacaccaatacagttggggcagtatctgtatcacatgaaaacgtcactgttcatagttacaacagttctgcacactacaaagggaaatacacttgggatacaattgatgttgctttccgtgactctgtaggtaatgcttctgctaaagcactatacaaccaaatgcgtaaagaatttaactactacagtcaagaatctcgcatgacagattcacaatttaaatttgaaatgtggattcaagagcttgatggttctaatagtgaaaatacaacaaacttgtttgaaggaacattgagtacttgggtatgtcaaggttgctttattgaatccagtaactttggtgattgggattattcctcaagtgaagcacaagttatttcaatgactgttcaaccagatggttgtgctaaattgggtccaaatggcgaagcgttcggtgatgaagttagtggcttcggtaatccatcaactgctacctctatttctggtgcacaaactaatattagtagtactactctaccagatagtaacttctacgaaaattaattttatttaaacttaatatatagcctcgaatctattcggggctttttttatgctaaataaagtataatgccttataaaataaaaaagaggttgctatggcaaataacatgattaataaatatggcgttcctttaccatcggggcgtaatcgttcaatgctacaaccgaaagcaaaatacaagtttcgtgttattgtgtataatttcggtactgatatagatgaacgtgatcacatcgcattagatgttgataaaattgatagacctactgtaacatttagtactcataaactatatcaatttactactaatacttcctatataggtagtcatgattgggaaccaattacaatatctatccgtgattcagttggtaatgcatcagcaaaagcattatcacgccaattacaaaaacaacttgactttcaacgcagaataacttcaagaagtgaccaagattatggttcttataaatttggtttggttatacagatgttgagtggacgtaactcagatgatacactaggaaatctaggaagagatactctagtagatgctgcaactgctgcaacaaataattctggcttagtaaatgcagtagatcaatttattggtggttcttcatataacagtgctggtgttatggaatactttgttttaaccggatgtgttattcaaaacatatcatacgattcattagattatagctcaagttctccagttgaaatggtagtgactatcaaaccagataattgtatacaatttgataatattgaagaaatgtatagtaccagaattaattcacttttacctgaaaatgtcaatcaaggtttagatatcattgatcgtgtttttggtagtgtaggattttaaggagataatgaatgagtgatttttttgattcatttgtcagtactggtacaagtattgtaaatggcgttattgataatataaacattgttcgtgaacctgcttttcagaactataatgctgcacaacgtgtgtttggtacagcaggtgaaatggggttttcattttataatttaccaaaattcaaaaatagttttatcatagaatttgttttaacaccttttgcaaaaaactttattaaaactcaattaccagatacacatacagattttgatgttaataatgtatcatgttttgttaaagatgtaactttaccaagtttttcatttaatattgaaacagtaaaccaatataacaaaaaacgactagttactggtgacattgtttacaaaccaagtaatgtcgttttttatgataccgttgatggtgctggttacttactaatggatgcatatagaaagttttattatggtgatttctttgataaaaatccacagtcatatcgaaatgatgttctaagtacacctgaaaactttaatggtttaggtggtaactggggacgttcagtaatgaacaatggaaactacgataatcagtactttttcaaatcaattaacatatatgagattgataatgaaacatatactgtacataacatgataaatgtattcattgaagacgtacaattagaaaccaaatctatggaaagtgaagcagacccttcattaatatcgttaactatgcgatatgaagcatgtaacaacttcggaccagaaggatatttgagcattggtgtaccaactatggaaatagcacaactaataacagacacagaaggtcttggtgttagtgggttttttaagtattttggtgaattagacgacaaaaccaaaggaattttaacaattggtaaaattatccgagcaggtacgtcagttagtgatataataagtagtgctggtgatatattgcgtggtgacattactcctgacacaattcgaaacataggttctgctgtaaccagaggtgctaacgccatagggtttggtagtttggtttctgaagcaagttcaaaattcggattaggtaacattttaggagatttttaatggctttcaatcaacaatttaacccagcaaagataacaaatactaagcaagctcaaggtatctttcctataaaaaacattaaaaagtataaaagtaataatcaaccaatataccgtagttcgtgggaaaaggacataatgatttcattggataataatccagcagtcattgaatggagtattgagccgtttagtattccttatgttagtccaatagatggacaagtccaccagtactggcctgatttttatgtactgtatattggtgctgatggtaagcaacatgctcaagtactagaagtcaagccatacaaacaatgccacatggagttggctaaatccaaaaaagaaaaaattgcagttgctataaatcaatccaaatgggcttatgcaatggaattttgtaaaaataaccggattggagtttaaaattataacagaaaggaatctatacaaaaaatgaaatctaaaccacaaatagacgaagcactgggattacctagtgctcaacaatggattgaaatgactggtcaagaaccagaagaagatacagaaatgaatttgtatcaggatgaagacaaaactgaaactgaaatatcattggaagatgcaaagattgcaatggaaaagctcaaagcaatgcgtgtacagttgagggaattacctgatattactgcaagaaaaacccaattggatcgtttagcacaaatggcagaacgaaagtttgaggatatttttgatagagcatttaattgtgaagatcgttttgcagcagagatgattaatgctgcaaactctatgctaaaaatagctcttgatgctcatgcaaaaataattgattcagatgttaaattagttgatctccaacttaaaaaagacaaaatggaaattgaactaaatttgaaaccaaaaaaagaacttgagtctgttggtgacccagatgcaattgaagggcaaaccgtagttcacaaaacccgcaatgaaatgcttgcatcaatgaacagaaataaataacttaaacgaccttatggagttattaaaatgaatagattacaacaaatcctaactgaaaagaaaccagtttatgaataccgagttaagtttgcagttgaaccaacacctgaacaacttagtaaagtaacacagcgactaatggatcgctatgatgcgtttgaaattggagcactaaagaaaacaatttttatggaaaaaccattagatttctatgaattagattgtggtgaaatttggatgtttgactttaaatgtcatcgtggcgttcaatcaaatgtactaatgtatgaaattggcaatttactaagcatgacagaagcattgattcgtgttcgtagtaaagatgaacctcgtcaaattgaaatgactgatttggaagatgatatcgattttgatgatgttgatgaaccagttattggagtggattttggcaaaccagaagacagttatgacttagctggacaacaacgtgcagacactgccgttgatgatgcaattgaagcatcgaaaaaagacaataaatactctcaatatatgagtgctggttttggtaaaaaggattaacacatgagtatacttaatgaaatgttagattatgaagacaatgagttaaatgaagctcgtccttatagtcgttcacaaagtgcagttgatagtgcaaaaggaaaagtaaaaggcttttttggtagtggacagattgaacaaggtgcacaagaagttggtgctgaagccaaccgcttatgggcagagtttaaacgttatgttggacgtaaatatggtaaagctcaaccatcagtaccttacgctgatgtggcacagttttttaaaggtaacaatcttgatattaaacatttagggaacaatcctcgtcgttcttttacaccaaaagatgtaggtactgctctattaaatgctgctcgtgatataatgaatgactaccgtgaccaacaaggtggcgaagaaagttcagaattacaaccatcacaatcgacctcaactgagcaaccagcacaacaagaacaaccaaaagcacaaggttccagtatccctgatgctctacaaaaattaagtccagagcaacgcgaccaactgttacgtatgctttcttaaggagaatcaacacatggataattttttcagtactgaaactaccacagttcctaatggatatgtatatacgtcacatactggtgcaaaatatgtatttcttgaaggattctggttcaatgacaataatatgttaatggtagaccctagaaaatacccatccatgtacgcaagtgctcgacaacagattgtcgagcacaatctagcttcaaatgaatataagattggtaacaaatatattgttgaaggtaaagagtgtacatttattggtgaaaaccgtttcaattcaaaagatggaattctattaactgaaagtgaattcatcactgaattaatggcagatgatcatcgagtatataatgtttctaaagaaacactacaaaaagaatggaatgcattaaaattttacattcttccaccatatgctgatgatatatcaattccagcaggtatggaagtaagtggttttaaatttgttccaaagaatcaccgttttgttgatatgaaatcaggccgagcagttgatccagcaatgacccgtaaactatcagatgaaggtatgcgtattgctcgtcagttagcttctaaaaataaactaattccaatcaaatcaaccttagtacaaggcaatacacgttgtgagtggaatggtaaagaattttgtgataatgatggtaatgtagtaattccagaacaaaatgcacatgcaattattaatgcatatcagcaatttgttaagaataacccaagtgattttccaacattaacgggtgaacaagaacatagtgagcaacgttttggttcaggtgaaaagccacaacaagcttcacaacctgctaaacagccagtatttgcaactaaagaatcaattaatgaagcagatgaagaaattgaagaatttgaaagcattactgttcctgacggttatagaatgacttcttctaaaggaaaaacatacgctaagaaaaataacttgtggtatgatatcgaaagtaaaaagcaacttaacacaagtgcttctaaaagtgttgaacgagcagcacagcgtgatattttccgtcataacaattccggtgctatgaaaatcggtacaaaagttaaatccaaacaaggcaaagaatattcgtatgttggtggtgacagattcattagtgctgatggtaagtttataccaaaagcaactgctgctaaattacttgccaaatatgaacaagataaagaagttaaaagtgatgaaacacctgaagtagactctggtactgagcaaattcaatcaaaagaagaacctaagaaagaaccagaatctgaacaaaaaccagacgaagtttctgaaccagaaactaaatctgaaacaattgctggtgatgatgtacaatcattagcttctaaaattaaagagtcaccttatgctaaaaaaatcacagtactactaactcgtggtgatgaggtttctctacttgctgctgacattttactttcaggtaaaaaggatgaaacagtgcaaattttaaaatcattaaataataatgattgataactaaaaggatttatttaaaatggctaaaaaaattaatgaagcacaagttaaaatcgatatcgcaggtttagaatctgatgatttggaaactctatcacgtatgttagctcttgctggtcaagctgaacgtcaagacccagtagttgctgctccagtaccatctatggggtctatgactccatctcttccacctattgctccactagatctcgattctattggtgctgaagaagaaattggtggaattgaaacttcagttgaagacccactagcagcggcagttgatgatctttccgctgatgttggtgattttggtgctgacacagatgaagttagtatggatgctgaattttcagaaccaggtgtagaaggtgaagaagatttttctcttgaccttagtggtcaacctcaactagaatcagttgaagaagacgatgaggaagaagaaattattgaagaagaattcgattttagtcgtatgctatctcttgctggtattaacgaagaagaagacgaagatttttcagtagagggtaatcctgctaccgataaagaaatgaaagatacccaatttctaccagatctaagtatctctgaagatgaagaaccatctaacagtactgattatggtccatatgaaaccgaagctgatgccgttcgtgatgggcaactaaagactaatggtgttgaaggtgaccattttgttgtaattgcaaaaggcaatcaattttattggagacgtgttgtagatgaagatcttgacaatcgtccagaacctgagtattatgataatgaagggaacgaaaatcgtgttcataaatttgaaccaaaattcccaggcactgcattaggagataacccactaaatgttaatgaaagtgaagaagatgattcacctgaaggtaacattgacttggaagatgattctgatgaagaagtagaagatatttttgaaagtctccaagaaaaatacaagaaatttttaggagacaaataatatgcaatataattatcgtgaactagttgaagcgttagacgaaattaccggaagagatgaagacgaaagtttttcagttgaagttgaatccgatgttgtagcagttgatgttcttaaggatattaccaaatgtcttattgatattgttgataagattaaatctggtgaagaccaaaaagaaattgtagataaactacaaaaagcctgtgacattttgtctgacattcgatataatgatgaaagtactgaagttgctgatgaagaagtgttggaagccattgcaggttgttttggaactgaaggtatgggaccaacaattgacaaagaaggcgtacaacactataatgagcctggtgcaccatcttatgctgcacgtcaaggttttgttggagactaatatatgtttccagaaccatcacataacagtactgaatatcaaaataatgtactttccaaagttagggaagtacatgaatcagattcagaaataacagaccgtatgcttctgatgtcaatttttgaaaatttcagaactggcggtggtttacgtcttagcaagtttgggtatggaatttgtaaagaaaataatctttatgaatttaccaaaatccccttgcaaagagaatttaaaagttctataatgtttacatcacttgacagaatatgtacttcaccttattatgttgaaggtcagtacatatatctgacagatgcaatgataataactgaattaacattgtgttgtgatgattttaaacagttattttctattcatatgtaagaaaaatgaattaaaaataaatgttgacaagatagaatgatgtgatacaataagcatcagacataaagttttcaagcgacacaagatgtgagtttgaaaaaaaagaaaaaaagtgattgacaagttgaaacgatgtgatataatgttcacatcaagacagcaaagagatttaccttttaaacacacggatgattcatgaagtaacaaaggaactgataagttaaattattttaacacagttcctttacttttgcccacggattggctataatagaaacttaaacgattttatccaacaaaaggaaatatatacatgactactcaaaacgatatcctgaacgttaaactgactccaaagaaagctaaagaagcaatggcactagctgacatgattcaagatagcctgatgatttggggtagcccaggtatcggtaagtctgcaatcgctcgtcaatacgctgatgaaaattacccactgcgtaaagataacgtagctaaaatcgagttcatgaaacaacaaatcgaagctgaccctgaaaatgctgatcagctacgccgtgaactggctgcatttgaagcaaaactaatcgaccaagatactaactttatcgatttccgtttgtctcaaatcgaaccaagtgaccttcgcggtattccagtaccagagaagcttttccgtaaaactgacggttctcttctgaaagaatctgagcttgccgaagcaaaagattatgtagctgaaactgcggtagtatgggctgcacctaaagttctgaaattgtccgaagattggaaaggtgttattctgtttgacgaaattaactctgcaatgcctattgttcaggcagcgtcttatcagctaatcctcgaccgttgtgttggtgagatgaagctacctaagactgcactgattcttgcagcaggtaaccgtgaaactgatggcggtgtaactttctctcttgctacaccactgcgtgaccgtatgactcacattgagatgattccttatcatcaagattggattaacgattatgcgattgcaaaacgtttgaacccagcaactgttgcgttcatcaacaacactggttctaagtactttaacacacttagtccacaagatccttctcacagtggtggtacttctccacgttcatgggaagcagtagcacgctacgaagatctcaagaaaactaagacaattgataaagaagtgttccgtgcaatgattgctggtcgtgttggtgaaggtgttgcaactgaatacattgagtacgttgagaacgttgctaaattaccagatactatgtctattctgtctggtgaaatcaaagaaatcgacgcaacgctggatatttctgcgaactactttatcactctgaacttggtttataaaattatcgacctgttcaatgagaagcaagaacaacgtctaccagtggaagaatggggtaaactgtgtaacaacttcatcaccttcctagaccataacttctctgcaactcaagcagaactggcagtactggcaattcgtaccatcacgcttcataaggttgcgatttccattaaagatgtaccagcgtttaaagatttcatcgctaagtactctgatcttgtacgtaaagcacgctctcttggctaattaacaaagagttgttgacaagaaggatgcctaatggtatccttcttttatcttaactaaacgaggaaatatacatgtcagataacaaatctacttcaagattcaatgaagtatctccggcactccagaaagaatgtcaagaacgtctggttctggctcgtacatctttgatgttaactgcaccattctttggtgtactcgcttcacgtttacgtccagttcctaataatacatggtgtcgtactctagcagtggatggtaaacatctattctacaacgtagaatttgtaatgggcattcaagacccatctaaaaagaaagaatatgaagaagctattcgtgaaaagcaccctgaagttacagacgaacaattaaaagaaatgactgaaggtttgactgatgaaaaccttgttgctgtaatttgtcatgaaattctacactgtgcttacgatcacttccttcgtcgtggtatgcgtgatccacaacgttataaccgtgcagcggattatgccattaaccaaatcatcgttcgtgagaaaattgggaaaatccaaagttcatggttgtatgataaaaaatatgaaggcatgaccgcagaagagatttacattcttcttgaagaagaagaacaaaaagaagatggtgaaggtgaaggtcaaccacaaagtggcggcggtgaaggtgaaggtaaaaatcgcggtacttttggcgatattaaagatggtaagggtaaaccaaaaggtactaccattgaccagcatgacgttccacaagaaggtcaagagggtggttcaagtgaacagcaaaaacgtgattacatggatgatttcaaaacagcaatgatgaatgctgctcgtgcaggtggtacaccagcagaaatcgctcgtatgattaacaactttaaagaaccaaagattgactggcgttcaaaacttcaacgtacacttcgtagttggttgaagtctgatgcaacatatcaaaatccgaatcgtcgttcttggggtgcaggttttggttctaatggctcattctatggtaatccaatttacccagggatgaaaccagatgatgatattgatattgcgattgcactagatgcttctgggtctatttctgaagatatgcttcgtgatttcattagtgaagttcttggcatcactaaacaattcaaacagtttaagattcgtatcatgacttttgatactgaagtttatactgtaaaggattacaaaactggcgaagaacgtaagattctggaatatccagtaaaaggtggtggtggtactgactttgaagcagtatgggttcatatgaagaacgacaactacaagcctaaacagcttgtaatgtttactgatggtgaaccgtggcagtcatggggtgatccaaactactgtaaaacactgttcgtgattcacagtaacccaaataaagttgcaccatttggtgagactgtacactacgaatatgaagctgataaaaagcgtcaacgtagttaagtactaaataatgagaacggaaaattccgttctcttcttttataagtgggacaacttataaaaatatgatataatagttaatgtaccaatatacatggagagtattaaaatggaacaagaaaataatcaaattcaactaacccttctagacctaatcaatgctgcaaaaatcatggaagctgctgttgcacgaaacacctttaaagttgaagaacttgttgaggttgctccagttgtatctaaatttgtttcttttgcaaatgtagctcttgaagatattaaagcacaagaagatgcagctaaagaagaagctgaatcacaagatagtgaaactcaagaagataaaggagaataattatggcagctattcgtcatgttggtgtaatgcgtaatacaggttctcgtgtttttgttgtttggcgttcactaccagatgatcctgaacactgccttatcgtttatcgtgattcactaccagaagcatatgtacacgcagtaactgatattgttatgggtcatggtcaatctaatattgatttgtgggaagtaatgcataaaattggttatctcgatggacgcaaaatgctagatgttctacacaacatgcagcatctacgtcgcgttcgtacttgtgacattgatatgcacactggtggtaataataaaatttctcttgatgttctaaacaaagcattagatgaaaatcaagcgaaagtacaagaagatggtaaagtaaaagactttaacccattcaatccacaagaagcggacactaaagtagaagaagctactattgtagaacaacttctcactgatgcacaaaaatatgaaaaactggctaaagaacattatgaacgtgcatacaatttagagccaagcttgcgtccgcaaacacaagttgttgaacaaccgaaagatagtaaaacaatttatctagaaattccagaaggtatttcacagactaaagctattgagaaagtaaaacaactatttgcagaacgtaaagcaaaataaaatatgaaaaagaatgaattagatgaagcaattaaaggtttatctaatgtatgttttagtggcggggcagcaggtgctgaccgccttttttctatctatgcaaaaaataatggatttgaagttattaatttttcattcaaaggtcatgagcatagtgtagatgaaagtactatattagaaataccatccaatattctatctgatatttctatattaaatcaactaaacattgcatgttactcgttgcagcgaaaagtaccaaaacctggttcttatgtttacaacttacttgcaaggaatagttatcagatacttaatacagaaagaatatattgtattgcaaatatcacatcaccaactaaggtaagtggtggtactgcatgggcagtacagatgtatatggattcagttgaaaatcctgaaatttattgttatgatatgaattcacgttcagtattttatttcgatacagtactgaaagagttcacacaaacattcgtcgttccagcaccacatggtaactggactggtattggttcacgcaatgccaccgaaaaacatatggaacattttattacatttttcaaggaagaataatgaaacaactacaagaactatatcaaaaaattctagatgaaggcgtagaaagcgttgaccgtactggtgttggaacaatcaaacttatcggtcaacaaatgcgttttgaccttaaagatggtttcccagcagtgacgacaaaacgtctagcttggaaagcaatgacttcagaattactatggtttattgaaggttcccatgatgagcgtcgcctttgtgaaattttgcatggaactcgtgatacagaaaagaaaactatttggacagataattacctaaatcaaggcgttgctcttggttatactgatggtgagttaggtccagtgtatggtaagcaatggcgtgaatgggaagattataaatttagttccagtactgaagaaattcaagaattaaaagataaaggatacaaagttatcgattatactggttcacatggtgttgttatgaaacgtacaactgaccaattacaagaactaatcaaaggtataaagtccgatccatatggccgtcgccacattctaagtgcatggaacgttggtgagcttgatgatatgacgttaccaccttgtcatagctttgtgcaattttgtgtagtgcaaggaaaactaagctgtattctgcatcaacgctccgctgatctatttttaggagttccatttaatatcagtagttactcactactaactcatatgattgcacaaattactggtttagatgttagtgaatttatttggaatggtggtgattgtcacatttataaaaaccacgttgaacaagtaaaagaacaactacagcgaaaacctcgtgaattacctgaattgtggcttgatcctacaattactaatattgaagatttcactatggattcttttaaattagtgaattacaacccaatgccaacaattaaagcacctatggctgtataaacgaaaagggagaacatcagttctcccttttttattatctaattgttaccaatgttcttccgtcgaaacgtacatcaggagttgaaggtatactaaacactacgttagtgccgttaaacgtaacgctatcgacctcaacacgagtatagacaccaggactaacctgttcctgtatctctgctgtgacgatgtttgaggctgttacagtaagggtgtagtagttaccacttaatacccaagatgaaattgtaaaagcatcggttctcactgaacctgaaccaattggaacccattgaccttgaactttttgcattgaagtacgctcggtattggagtatgcaatcataccatcaacgccaacagagttatcaatagtagctagtactggtaattggataccatatctattaaaacgtgttcttatagttccattatcatagatacttacatcagcataattacccattgatagttttaaatcagaactaactaattggattgtactttgattagtagtactttctaatgtaattataccattagctaatagatttatatttttaaatttattagttgttccattgaaattagtgtttgctgtaaacgtactaactccattaactgtaattgtatcagatgcagcatcgcctaatgtagtattaccttgaatgttcaaattaccactagcagtgatattactagctgatgtatcaccagtcaatgtacttgtaccatcaaccacaatattaccatgaaacgcactttcaccatttttaaattcaacttgtactttattcattgaactaaatgaaataatattactactagcacttagtccaacattagtattggttgcattatcaaatcttagtactggggttgatgctggggttgaagttgtttggtataatgttaatgttgaattattaattctaatacgttcagttccagcagtactgaaaccaattgcatcatctgctggatgaaacataccagtattagcgtctgaccattttgcaggatcattacctgggttattggttggatcaaatggattgttattaaatgtcaatgctggtgctgctgcactaccatagaccacaccaaaacgccctgagccgcttgttccatcattatacatggaatcaccagttctacgtaaacactcaatcacaacgttatctatggatgtttgaacggtccctgcgtttgtcctaaattgacgatgatttgcaatcattacagtattgtcatataatactgaagcagcggaaatgcttgttcttgactggcgtagacgtatgtttttatcttcagttataataatccaatcaccatctgatagtgcggtttggttcattggaacacctgaagcaaatggtttggttaagtcagcatctgttgctaaatttttaagaccatcatgaccagtactaggaatagatgcaggaataattctagcgaaagcgtatgttactagtttagcaccagatatatttggattagagtcaacataatataaaatttcaatccaattaccttgtccagttggatttgtaggtgtaaatgtaacaggacttgtttgtggattatttgcttcataatgggcttgtgcggcatccataataccacgaacaacataataatcaccatttagtgatgctgctggtgctggtagtggtgtttgtgctaaaggtggatcaatatcatctgggataggattgtatgtaccaacaaactgtaaaccactagttactgaatctggtaattgggaagtaagaagtttaccatttgcatctaagtttgcaaagcggcgatatgccatagtaccatcttcaaaatccagaacaccttcaaatgatttccattccttattgtatctaatcatccctgatcttattacatcagcggtttcttttgatggtgctttcggtaactctaaaaaagatttactatcaataattacaccaccatcacctctaattcgatttatactcatttaaatatttcctcagaatagatttatatgatgtatttattttagttaaaagaaaaggccaagcataggcttgaccttaaaaaattaacgtatacgttcaggaatatcaacaccttcatatacccaagttgcagcttgttgtgccttataaattgcatcaggatctaaatcatcaactgcatcaattgctgcacactgattgtcacattctgtaaacaattgctcaatcatagcaaaggctccagtgtatagttgtgtcatttcagtagcagataattttacaattgcgtcatcaagaaaaatagaaacactttcagaacctgaagtgacttgtgtatagtaattaagaagcatttgacgaccagacatatcagtactgtaacgatgaccattgaacatataaccagaattcatacgatttgtacgttctgatatagttcttgcttttaaatcaactttaacatctgctattggcatatcaatataatgatatgttttaagaacagttagtgctttatattcttcggtagcgtcttctaaaaattcaacaataggttgattttcatcttttaatttaataaactccaacggttgttcaatagcattaacatttccaacatttttatacactaaccaccaaaaaccttcttcttttctaacagcatcattaggttctactggggaaccatctttacttgaaataccataaagagttctaatatcactataaagataacgataggtttgtggatcttctggtgttgcaccaggacgttctttaagtccttttacaccaattggattggaaataatgtttcccaattcataattttcttttgaatttcctttcacatatgtgaacatataactacctcacttgttatgatggtgtcacccaaaatgagtgacacctttattattataattattaagcagtacgttgtgcaataaacatatctgttactggactcaccccgtcataaatgacttggtagatagttacagagtttgcagttttgtttagagttccatcaacaaccgcataagtaccatcagtagtaaagtttctattacctgttgcatcttgttttacataaatgtatactgaagatgctttaccaccaccgattagaccagtgattggtgctagagttgtatcttgatctagagtgataaagtatacgttgctagtaccgtctggggtccaagtgccagttggtgcaataacagaagaagttacttgattaggaataacatcatattttttagtagttactgttgtagtagtcaagtcagcattagtagttgttaattgaccagttacagttacatctttatcaaatactgcattttctttgaaagaagatgttgcattgacagttaatgtatcagcagccgcgtcacctaaaacaacactaccatttgcagtcattaatccagtaacagttaaagtaccaccgattgttgctgctccagtaacagatgcactagcaagtgttgctgcaccagaagtagtaatagtagttactgaagttgctgctagggttgcagtacctgttgcagaaatatcaccaccaacagttaggttaccagaagtaatcccaacggttccagtaatgttagcaccacttgacattgttactgcaccaccaaatgaaccagtagtagttacttcaagggtgttcccttttagcagaccagttgcagtaatacttgtacctgcggtaatgctagtaccagcagcaacactgttggttgcagttaatgatttaacagctacatcagagtttgcttggtttagtgttgcgtttagaacaccagttactgtaaagttaccgttgttaactacgttaccattgattgttaagttgttgttttgtgaaccaacatcaccaatagttgctgatttagaaatcaactctgcaccagaagtaatattacccgctgcactaatagtgtcagccgcaacaactgcataaggttcgattgtttgaccactaacatcaatatcagcgttgataccaccatctacacgcaaggaaccagcaatgtaagtgttagggaaaatctgaactgtttctggttgttcaccgatcttagtaccaataataacattagaaccagttttcacagcaccagaagttgttagtgaacctaaagttgctgcaccagttacacctaatgtaccaccaattgttgcattgttagtaactgctaatgcagttccttcaccattaagagtgattgatggagcagttgctgcaccagttacacctaatgtaccaccaattgttgcattaccatctgaatgtagtgtggttgcaacagaaagactgtttgcaactacatcagtactagataaatccaatgcacctggcgttaatgtaccagtaatgttaacattattaccaaaggttgctgcaccagttacatctattgtagtactaaatgtaccagaagttgcagataccgcacctgaatctagtgaaccgacagttgcctttccagttacacctagtgtaccaccaattgttgcattgttagtaactgctaatgcagttccttcaccattaagagcgattgatggagcagttgctgcaccagttacacctagtgtaccaccgattgttgcattgccgtttgaatgtagggttgttgcaacagaaagactgttagcatctacatcagtactagataaatccaatgcacctggggttaacgtgccagtaatattaacattgttaccaaatgttgctgcacctgttacacctagtgtagtactaaatgtaccagaagttgcagatattgcacctgaatctagtgaaccgactgttgcctttccagttacatctaaagtaccaccaactgttccatttgtggttactgccaatgtaccagtacttaattcttgtgcagttaccttaccggatgcagtaacagttgaagtggaaacaccaccagttagagtacttgcaccagtaacacttaatgtggttgcagcagttacgctattcacgttaagatcagcaccggataggtccaaaccaccttcaggaataaatgcacccttaacagttagtttttgtacagtactgtcaccagttacatctagagtagatgctgtaaggccaccattcatactagctgcaccagtaacaccaagggtagtagttacagttgcactattaagggtagagtcaccagaaatattagcacttggtgcggtaatagttcctgcatcaacttgaataccaccatcaactacttgaataccaccagtattaactgttagtttaccaccagttgacaatgtgtttgaaactgtagttgcaccagttaacgttgtggttccagtaacacccaagttaccagaaatagatggactacctgtaatgttacctgtagttagaatcaaatcagtacctacagtggtagagccagtactttctagtgttacaccgacgatgtttgcagaacttaggtcaatagaaccatcaacagttaagttaccttgaacggttgcatcacctagagaagttaatgtcttcacagacacatcagttgtgctaagatcaataacacccgcagttagtgttccagatactgctaaattaccagtaatcgcggtatttttagtaatggatacattttctgccgctgaagtaatagaaccaacagtaagtacaccaccaacagttgcgttattagttacatttagagcagttccaacaccagatagtgttgctgacccaccagtaattgcacctgagattgaagctgttgctgctgaaacatcaccagaaactactgcatttgttgcatttagagcagacactgtaacttcagtactttgaactttaggtagaacgttgataccttctgcactactaactgtaataataccagtacttgttagagatttaacagatacatcagaaccacttaaatcaactgtaccagaaacaacaagatctccaccaatatttgctccagcggtagtagtaatggattttgcacttacatcagttgtgctcaaatcaattgcacctggtgttactgtaccagaaactgttaggtcaccagtaatagatgtattattggaaatagatacaccatcaacgttactaattgttggggtttctacagaaactgctttaactttacctgaagaagttacgtcagctacggtagatgcaccagtaacattcaaattagtaatatttgcagttgttgaaccaagggttgcaatagttgcatcagtactttgaagtttaggtagaacactactaattgtagattcattactaacaattgcaccagtactagttaaagatttgacagtaacatcagcagtagtaagatctactgtaccattaacagttaggttaccaccaatagttgcaccagcagtagtagtaatggatttagcattaacatcagttgttgctagatcgatagagcctggaataactgcaccagtaacggttaggtcaccagttacatttgtattattggaaatagtgacaccacttgcatttgaaatggttggggtaaccaacgatgcagttgtagtttcaccagttacagttaaagttgacccaactagaacagatgagcttgagtaaattgtacccaaattagcagatccggtaacagttatatcatcagcattaacagtagttgccgttatggtagtactattaagtacaggaagtacgttagcattaacaaggtcattacttttaacaataccagaagaagttagtgatttaacgttaatgtctgctgctgataaatcaaaagaaccttgaaccacaagatctccaccaatatttgcaccagcggtagtagtgattgatttcgcactaacatcagtagtactcaaatcaattgtacctggggttactgtaccagtaactgttagatttccagtaatatcaacattttctgtgaagttagtattaccactaatagttggtgcagtcagagttgttgcactaatattagtaccgttaattgtttgtccacttacagttccactcgcagtgatagtaggagccgttacttcagtagatgcactaattgttggtgcagatacagaagttgtaccagtaatagaaccagaacttactgaaccagcggataatgcaccagaaagagttgcagttgtaccagcaatatcaccagtaacagttagtttagcacccacggtagtgttatcagtactttcaagggttgcacctttaatatttgtcgcagcaacaactgagtttggtgttagatcctgaccacttacatcaacagttaacccagttacggtgccagtaaaatcgacatcattaagaattgctttaccaccaacttgtaggaatggtgtactagggtcttgtgttgcgttacctgtaatggttaggtaatctaatttgtttaggccattaccagtaataccatacgtagaaagtgcagcattaccaaaagttgccgtttttagaacgttcagtgttgaaggagaaactaattctgattgaacttcgttaggtaaaatcacggttggacgttgacttggtgcagtatatccaaatccaagttttacagcagaatcttgactactttggcctaagctgatagctttaaatgatgcagtactgttataaccagtaatattagaaccaagagtaacaccaccaactaatgaagttgcaccagtaacgttcaaagatgctgcattaatatcgtctaattggaatgttccaccaagaacaccagaaatattaatattattaaaattagcagttccagtactttcaatatttggtatagttgcagttccggtgacttcaaagtcagcaactttggtttttcctttttgaacttctaatagtggtgtatctggagcttgtgtttcgttaccagaaactgttagataatctaatttgtttaggccattaccagtaatgccataagacgataatgacgcattaccaaaagttgcagttttaagaacgttcaatgtagaaggagaaactacttctgattgaacttcattaggtagaataactgttgggcgttgaccgggtgcagtatatccaaaacctagtttcactgctgcatcttgactattttgacctaagctaatagctttaaaggtagcagtactattataaccagtaatattagaaccaagagtaacaccaccaactaacgaagtggccccagtaacgttcaatgttactgcattaatatcatctagttggaatgttccaccaagaacaccagaaatattaatattattaaaattagcagttccagtactttcaatatttggtatagttgcggttcctgtaacttcaaaatcggcaactttggtttttcctttttgaacttctaatagtggggtgtctggtgattgtgtattgttaccagaaactgttagataatctaatttgtttagaccattaccagtaataccataagaagataatgacgcattaccaaaagaagcagatgtcaaaactgttaagtttgcaggtgacattaactcggactgaatttcgttttgtagaataacagttgggcgtttaccaggagcagtgtaagggaagcttaatctgaaggtttgtgattcagagttagaaccaatacgaatgtctttaaaagtagcagtactgttaataccagttacgttagcaccgaaagttactgcaccttgttggttagatgcaccagtaacgttcaatgttactgcatttaagtcagatagattaaactcaccaccaagtgtaccactaattgtcacatctttaaatgtagcagtaccagtactactaatatctgttgtacttacattagtaatttctgcggtattagcagtaattttatcaaatgcagcagtagtcccaacatcagcagtaatattacctttaaatgctgttgtttcagcaacttctaagtttttaactttagttgcttgtagagtggttgtaccagcagtttgtgtaaaatcagaaccaactgatacagtaccgttaaaggtagcgtttgaattaattgttgctgtatcagacccgaccactgcactaccgattgtagtattaccctcaacaccaagaccaccagaaagtgttgctttgccacctacatctaaagtagatgtaatattggcagttgatgattcaatggcagtaaaagttgcatttgcaaaagttacagtaccatttacagttaggttattgttgaaaacagcatttcctttgactaaaagatccttaccaaccgtaccagcaccagtaatatctaagtcagtttttattgagtacatttataccctccattataaccttgttaatatgtatatatttagttttattatgctgttatccaacaattaatatgttatttgacaaaagcaaatataataaaaaaccagacttatttaggacaagtctggttaattttttttacttaccagagatgacaatcttaccactgaaagaaatatcagaagtgaagattacatcaccagtactactaatttgtgtatcagtcactaccaattcaaatggagatgacgcaacactcccaggtgttttatttgcataaattgaaatatacaaattatctggtgtttgattgtgttcagatgcaggaatagtgattgtaaaatcaccagcactagaaacccaatctgcttggtttaccaatttactataaggtactgtcattgttgttgctcctataatgtttactttaacacttgcataatctgtgatttgaccaatcacatcaattgttatatccccaataccactaactgttactgtggtttggaatactgattccaatgcaacattacctgggtcaccttgtagttggatcataatatcagaacctctaccatgaactgattctggtagtgtgtaagtataatgatcagtagtatctggtactaatgtaaatgcagaaacaggaactatttcagtagttacatatgagctatcagtcccaggtgagctacctttaaatggtttccaaatgccaagatctttaatataaatttgaagaacattagtactatcaaccaaaaagtaaacgtcaccatctagaccgatcgaatcggatggtgctgttgttccacgtaagataccagaactaccaccaccactgtgtgcgtttaaatatcccaatgtaaccaagtgtgtgtttgcagttggttcacctgctgaaattggaagaagttgtgttcctgagtagttttgaatttgcacaacactaccatttgtggtaatctgtgcaccattcttcccaagaatgaaggacttcttcatggttccttctaaattagaaaaaactgccattttaatataatctcctttatggtagggttatgtaagttacgggttgggcagcttttaatgctgcaccagcggcagttgctgttatgataggatctgcaatatcaattctatatacgttgtttacaacatacactgcacgagttatatacgttctcaaatcaccaccattttcaccagcaccggatataatgatctcagtaccagcagcttttgcatattggttttcaccccatgacacacccaatgcttctatgtatgtttgtcctgctaccgtttgtctaattgtgtcatattttccgaaaaaagaaccaccaacagttacaatatattttccacccgattgtttatgaataatcgtgccttcagagaaatagcgtcccccaggaaaagtatcgtatggaatataatattgctcaactacaggtatcagtactgggccacggtgacctgtaccatcgattgcagttgtaactttaaagttattagatgattggtctattctgtctacatacattttagaaaaactatattttgaaacattacaatcatcttgaacaacacagttagtccaattagtataagtatatttagagcgagtatagataccaccaccttcgccttcggtagagaggtgttgaccaattacatctaattctttagttctaatatcactaaatttagatgatgatggcaaaccacgccaaaggattttagaacaagtgatattgctcaattctgtattatttaaccaattatcagaaccggaagtataaacaagtatagaagactctggaatatagagattagaaattttaaagtttctaggtggtccagcaaaacgaccagaagttacaccccagtttattgaaaccattctatttgtgatagaaggatcattaagcaaatgaccagtcaacccatcaataatgaattctttcgaaccataagttataacaccagcagtggttaatccagtaccaacagaaactaaagatgatggataaacttcattattaagtattttaaagtccattcctaattcaacgtgtatacattgtctaacattatatagtctgttatttttaataacaaagtttctgacatattgtgtatctggtgcatctaaaccataaggaccagaaccagcaacgccaataccaatgccccagtttgaaagtgggattggagcgttagaaccatcaacgttttcaattacgtttccttcaatcacaaaaccatcaggataatgtgagttaattacgtttagttcaattgcatcaccatagatatcatgaatatggttatatgaatatctaccaaccttcattttctcaccagtaccttgttgaagaacaccatacttacattgggtcatttcattaaagcaaaaatctattgttcctggttgtgtcataccttgcattaaaaatgcagcagtacttgtgatgtttataaatttattaaaataaaacttaccatcgccaccgaagaattttaaataacatccagtaagtgttgcaaattgtatttgggaattaataacagataccatagtaccaccgttaccagtaatagttcccccaaaccaagttacatcttctaggtatattgcagttttgatacggtaattaccaccagcctgaatttggattttattttctttagcataagcagcacataaatttacagcagcagtgtcatcagtttcgccatcacctttagcaccaaattcttctggtgttatataaaactgggcctgttgaactgtacctccagtaataagtccgatgaaatcgccaccatttttactggatagaacttttttattaatgtataatgattttacccatgtaccattactttttgcaaaaatatcaacaataccatcttcatcaatttgaaaatacgtattattgttctttcctacatcatcggtagggggtacaacaccaaataatgcattagggttatcttcaagatattttacgttaactgctgaattagggtcagatgaagttcctaccttcagtggtaggaactgttctcctagataatcttttatagaaactgaatcattgataaaatttattgaagcaccttttttccccaatatgaatttgggctgcatagttccttcaaaattagaaaatactgccattatgacatcctcccttaaatattatcttgaatcggttggataggagcttgccatgaaagagtacaaataatttccatttttccataaggactgttgttaacagaatcgttgaatacacatgaaataatttcatcaacatcggatgctgcatgattagtttcattaacaataaaacgcatctgacgattgatatcaaagtaggaagttggtgcaattaccgtcccgccaatatcttcttgtgcttcaccaccaaaacgtacaaacatatcagttactggaagagaataaggttgtataacgtttacatcaatattagaaactacatatccagcaggacatgtaccaataactaatagtgcgttagtccatgagctatctatggtatttctaatagaaattgtatctttacctggtgcacctggttcgccttgtataccttgaataccttgctggccttctttaccacggaatagaataccctcactccactcttttgaaggaggggtagttgtagttacttcatcaacataatatagttttccatcagtgttgttataaaaacaataatcaactggaagattttcaatacttggaaattgatcaccactgctatcaatatggaaacgaccacgcggaccttgttcaccacggaaaggtataccatcactccaagtagcagttacactttgatagaaataaagtttaccatcttgagtattataaaatgtatagttattaaaaagaccagttgttgggaaagtagttccagcactatcaatgtggaacggcttacccgcttcacccgtatcacctttaccaaactcaacactaatccatgtacttgtcggatcttgtgcatcatttgatttaaagtatagagtactggtattgttagccaagcttaagtagcaccacccaagtggttcaccaactttaaattgttcggaaggaatttcaaaaccaatctcattaggataaaagtttttaccattctcgccattctgtcctacaacaagacctaaatcttgaattgtgttatctgcataggttacaattaaatgcccagcaccattaataactagacttttgatgccggagttattacatgaaccattaaatgaaattgtcataatatttcccttgtatgagttaatgtcatataccaatatttatcagtacaaaatacatttcgttatcattaataaataaatgaaagttcactactaaaagggcttaaacaatggcattaagatcaaaagactttctcttcagaagaaaaacaaaagatggttcatggcaagattttcctgaatctgatagctggtatccagctaacttggattatcactggaatgaacaaacgttaccactcgcaagtggtggctactatggctgtactacaggtttacatactatttcatttacactacgtaattttattggtagaatttatgtgttagctacattagctagtaatcctactgatgatgattggtttccaattaaattcactgaaagttgtaattattatcttgaatttactgatatggttattttaaatccaaatggtggggatttaattagacaacaaggaactaccggaacatttgctgaaacagtaactggtaattttacttaccttaaagttggtatagaccgtgattatattagtaagtatccatcagatgtccaaaaaagtttagctgggaagttagaacaaattttaattaactactaaggattagaaatgaaattagaaacagaacaaccaaaactatttgttaaaggtcatgtcctaattactgacgttactgatccatcaaatcaaaaaatcgttttagataaatctaacgctattcaccctgaaaatatgagtactgccattgctaatgcgttagcatataatcaagacagtactggtattcctattggttctattagcgagatgcgttttggtaatggtggtacagtagttttaagtactggtcgtgttacttataaaaaaccacgtgttacatcattcggtggtttgtattcacaaacatatttgaaaaaaatcaacccacgaattacggcaggtattgattcacaatacaataatattacaactgtacatataccaggacagtcctatactgatattgtatgtatttgtactctagggttaggtgaaccatccgaccaaggtgtaagctcagggacaagcatggatggaacttatgtatttgatgaattgggattgtacacggatggcgatagtggtattcctttaacccatatcatttttcacccagttgagaaaagtgcaaaccgtgtcttacaaattaaatacacagttcgtgtacaattacaataatggggacatataatgagtgttaattatacaatttatagaagtaatggtagtgtttatgctaccattccaaataatgttattttaggaccaaaccagcccggaagtaacccagttccgttaaatttagttggtagaaataaagtaagttacggtcaagcatggaatgaaaactttttacatttagttgaaaatttcagttcagcatctgcaccacgtggcaacgtcaatggtcaactttggtatagaaacactggtagtactggtgagttattgatatcattagttgataatgctagacaacctgctgatatggtaagtgaagctgaatgggcgtctatccctatgattactgtttttaacacagtacctgatggtgaaaatagtgttatgggtcgtatggtattaactagtaacggtgattctcttcgtgtgttaatgaaaaacaaagaatggcgtgaaattcaaacatctagaccagaaaacaaagagtattcatcattattagatattaactatgataatggtaaaaaatatatagagttcacacaaagtaatagtactaaaccgattgcgtattttaacttaggtggtacttcacaagtagatacaaataactggacaacattaactaatggtacaggtgtctttgaatttggtagcaactatttctatgaattaaaaattatgattagagaagtaaatgattcttctggtgagatagtttctcttccatacaattccaaaaccttttttataaaagggcaattttatgtagataatcaaggaacttttgttcctggttcggtgggggcaagtcaaatgccagacccacgtaggattacacaattagaatccattaaagatgttattaccagtagtcgcccaaactgggacgtaaatattgttattaatggtgtagatccatctatcccaaatcctaatggaacatctaaagctgattatgaaaattgggttatcaattctctaaactcaaataaaaatttaggttttcgagttgatggtagcattagtaatctaactgctggtgaatccgttaaactacaagcatccgtgttgttaaatattacaggtattccgattattggagtataaaaaaaggagccacacggctcctttttgttttaatatctatatggtaaactgttgacaaactgtgtaccttcacgtatactttcccatagtgagtaaaaatctttcattaagtttgtgttaagtaaagtatttttagcaccagggtgtaatggtttaggccaagaaccaattctaacccaagcataaccagagctttcatgatttaaagttggtacaaattcattctcaactacaataacaaatgaataatatttaaatttaccattttttgtacaaaatacatcaaacggtataatatcaataatgttaggtattgagttgcccaactcttctttaatttctcgcatcagaccttgtagtggtgtttcgttatgttcaagctttccaccaacaaatgcccagttgttagaataggtacttctttcagaacgcaagtttaacatcatatgtccagtactttttgataaaaatatagcaccaaccgcttcattcataacaacacctcctttatttgtcagtgaaagttattttccaatatccctgacgatacacaggcatgatacttttatgccatttaaatttgtcattatatctataataaccattgtcttctttattataaatgtaatttcgtacagtagatggatcaattaattgtgcaccgtcatttgtaattttaaacaaataatttgatgggatttcggtttctttataaatgatgttatgtatactgttatttacataatattgttcaggtaatgcacttgaaagtactgaatctttctgcacaaacccatgtatagtgtaatcaacagtataattggtattatcaagctgtactataattttgttggcatcttcattttcaccatacgacgctatatgaccttttagtgggttgtcttcttcaatagattgttgaaatttaatccctacttttttgtcatcaaaatttggttctagatatttaagatatttttcccatgaatatattccaccgttgggggaaaccgccgatagcgattggctaaccaaggtaagttggtatgtatcaggtaaattatacttggaattagtaatttcttcaactttaatgcataaattcttgggtgtaaaaacatctgttattatatctgaataatttcccatttcaaaatcaaattcgtcacgagcacctttaatatttgtagtaatctgttggattaatttgggtttttcaacaatagctggtaaagaaaaccatattgtcgtttcaaatgttaacaccattatatccaaatctgggtcagttccttgtggaaaaccacgagtagaaaactgacaatctattagttcaacatcactaagcgatgtccaatctaacgggttatcagataattgaagttgtatactaggtgcaaacaaagttgagatttgttcgaataattccattttagtttgagtttgagttacccaaatattcaaatcaaacgtaaaagtccaaggtactgggttatgtcttacaattttgtattgtgtgtcaagatcttttgtgtactcattaatagcaggggacttgttagaccccattactatagtttcgttggcattagaacgaatatttttacgatccaactttagttgattaacacttatggtcattataggtgctgatgggagaacattttcactattcccatttataattgctgctgccattcttgaaatatcggcatagcgacatggaacctttttgtattttgggtttccattagcatcaataccattttgtacttgaaattcaccaaaaactctgataagatgtttcagtactctgcgaaattgaccgtcataataataatctattttcattctgtgtccttatgtatgcgataaacagtattaggtttaactgcgtcatgtaatggaactttgttatcactatttacaaactgtgtaagtgctaagtctgcaccttcccacggttttcttccaccataatcaaaaataacccatgaattcttagttgcattgaattcccataacgtaactggagtataatcggtgcgatagaaatagtcaccatctactgcatcagttgggaacatatttccttcagggactgtacctcgtgctggtggaattttaggacgataatcttgttgcgaatcaatattaccatatacacaattggacgtgaatggttcattgacataagttacctttggttccccccacttgtcatcattatactgataaatgtgtggttctttataaaaaatacaaaaatcttccacatcttctggtggaacatcactggtagtatattctacatcacaatttaaccattttttagcacttttatcatattgatacaacgtataacctgtcacatctgcgtcattttctttaaagaagaagtcaccatccattggttttctgggaaagatggttccacgcttgacttccacagaaatccatgtatcattaacaaactctttgagtactgggtatgtttttttcaaaaaatacattccatcggcaggttcttctggaaaatcataaccgttaagcatatattttgataaatctactgtatcaggtcgatcatcatacaaatgttcatttgtataatgaatatagggtacttcatcatcagcttgcatgatgatacggttcatgatatccatttcattgccatagttactgttttccgacgaaccatcatcggtatttccattaccattattagggtcatctggattatcaggataattattgttaccgagtaaatcggagtactcaggtgagtcggttagcggtttaactctaagtttataaatgtgatgttgccacgtaaccgagtatccctcagatgtacgaaatgcatcttggacgacatagaagcggtttagacctgtatctttacccaatacatcaaaatcacgtaaatttggtagttctatcacatcccctggcatgatttttctacctaaacgctgcatcattgtattataatggattgtgatgtccatagtgttgaaattaaagaacaatcctgggattttcaagtctggagttgcttcttgaacttgatagacacaactaagtgtgatagcttcaaggttgtagtttctgtttggtgtgtcaccaaaaattaaatcgccaatacttgacacaactgatcctgaagatgtataatcacctccataggataagtcagtgttgtcagcaacttgttttggaccgacatatgcataaagccacatgtcaactccaccaatgttgtattgttcagcaatggcagaatcaatgaacttgtaatcattggttctaccttttttccacattctatatgtcatgattgtctccaaaataaatcgggtatatctttatttaccttgtagacaaaccgtaagaatgtgatataatgtttattaattagagtgacgtgaatcacataggagaatacatgaatcttactcaattgttcaaaaaaagcgacgaactggcaacatctctaggtcatacattcttgactattgaccacgtaagtgccacagtactgactattgatagcatcaagaacgtatttgaagatatgaacattgatgcagacaaactgcacaaccgcctgatgaactatcttaaaaatacaacagttccacatgcaccaaaaagtgttaaagatgaagacgcgaatcgcacttcacttctagtgaatcgcgttgtacatgagctttctaaaaaatcagttattgaacaactaaaaagtgatgatttttcgattgatgcatattttgttctattcgaatgtctgtctttccctaacacagcactagaagctgcgttaaaagaagaaggtgttagctgtactgaagctgcacgtgcattacagaaacacgttgagtcacttgataagggtatcaacttacaaagtattaatgacgaaccgattggagataaaaaagtggcccaacagcagcaatcatctaaacaaaaaggtttggaagactatacaacgaatctaactgctcttgcaaaagaaggcaaactagatcctatgattggtcgccagaaagaattgtctgcattgattgagactcttgctcgcaaaaccaaaaagaatgctattctcactggtgaagctggtgtaggtaaaacccaaatcatcgacgggcttgcacaagctattgctgatggtaacgtacctgaacacttgaaagacgttgaaattctttcactaaatgttggtgcattgactgctggtactaagtatcgtggtgagtttgaagaacgcatcgacaatttgctaaaagaactaaagaaacgtgaaaatactattgttttcattgatgaaattcatattatggttggggctggttccgcaagtaatggttctatggacatgagcaatatgcttaagccagcactttcacgtggtgagattcgtgtaattggtgcaacaacatatgatgaatatcgtaaaaatatcgagaaagatagtgcattaactcgtcgttttatgaaaattgacgtagttgagccgacaattgatgaaactcgtgcaattgttaatggtttgaaaccaacgtatgaaaaattccataatgttgagttcacatctgatgcaatggatgctgtaatttctctcagtgataaattcctgaagaataagcacttcccagataaagcaattgatctaatggatgctgctgcggctaaagttcgttcacgtgacaacaatagtaagcttattactgccaatttgattcaagaagttgttgctggtattgccaatttggatatcaacgtggttgcatgtactgaaagtgatcgtatgcgtaatctaccagatgcactacgctcacgtgtatacggtcaagaggaagctattcaaaaattagttgataacgtgatggtagctcgtgcaggactgcgtgacaaatctagtgttcagggtgcatttatgtttgttggaccatctggtactggtaaaacagaaattaccaaagcattagcagacgcaactggtgcggaactcattcgctttgatatgtcagaattttctcaagaacatactgtttctaaactaattggttcacctccaggttatgttggtcatgattctggtaacggtttactgttggataaaattgagcagttccctaatgcagtactgttacttgatgaaattgaaaaagcagatcgtaaagtactactaaccttcctacaggttttggatgaaggtcgtctgactggttctcaaggtaaaactgtatattttaataacgtaactgttattatgactacaaaccttggtgcggctgattcaacaaagcgtagcattggtatgagcggtagtgacactgcacaggacaaggcaattaaagcattcttgccaccagagtttattaaccgtattgatagtatcgttacgtttaaagacctaagcagtgaagctattgacagcatcattgataagttcatgggtggtttgaatgaacaagtcaaagaccgtaatgttaaagttacattgacaaaagctgcacgtgaatggcttgcgaaaaatggggtaaaagttggtatgggtgcacgtccaatgaaacgtaccattgaacaaaacattcgtgtaccactagctaaagaaatgttgtgtggttcacttgtgaatggtggtaacattacatttgatgttattgatggtaaaatcggtattaagccgaaacgtaccaaagctgtagataaagcactagtataaaaaaagaaaaggagagcattatgctctccttttttattacttaactaataatatatttttaatatcattaccactaacttgtagactatcagtgtatactgaaagatctatagtgtaactattttgtgtgtaacgttttaacatatcataattacctaaattaattccattgaaagaatatgtggtattaagtttaaaatcatgttctgcactatacattacaccacggagtaaattatttgcatttctaacttcaactttttcatatccaatcgatataatatcattcatgttcgcggctgaaccggataaaacattatttctaatactataaggacttattgatttaggttgagaaacataggttgtattttcttcactaatggttgtgatgttagtaacagtaccaccaacaacaccgatatacataccgtcaaccattgggaatccataaacccatatcccttcattatttctaaacggttgaataacacttgaatcatattcgataacgttgatttctaaactatcagtcattttagttcttgccaattcactaagaactcccgcacccgtaattggtaagttataaccgttatcgatagtaattccatcaacatcaaatatttcattggagattatccaaacgtcaacgtcatctggtgttattccgtcattgtacttaccaccatttaaagtagtatcgtagaaaacatcataattaattacatcaatggtgtaatttctattttgttcatacaatttaataccattcttgacaaattcagggtcagcaaatgttctaacacgaacaatgttcaatgctagaggctgtactggctcattttgttgtgcaagagtgatgttatcataacggagaactgcaccagtactctcatcaatcaattcaatcgtttccttacctgtatttcttacagtgaataggatcggagttgtattgtttttgatgttagatacacgcaagattgtttcccatgtgtgattttgatatctcacaaaatcttcaccatcaggagtgaaaatcatcaccttatcaccatcagataggtcattgtcaactatttctgcttcagttaagctattaatagatctcacacgatagaaatatttttcatcaaacttcgatgttgttttattaatatcattttcaatcttagcatatgaaggaatacttacaattgcttctgtatgtttatatggattgataattgccataccttcagtttgatatctgctgttatcacgtaattgtacaagagatacattgtcaaacccatatccatcaactgtaaatctaatttgtccaacatcacgcccagaagggtttatgtcagatatatccacaatataaggatcaacttcatcatctttaacttcccattttattgaagaagtttgagattccaatgctaggttatcaaatgcattcatatcattgaagtacttagcttcagtaatactatcaagtatatattgataatcagaatacattggattattttgatctagtggtaaatcatcaagatttatttcagctagttcaaccatttcaccatttgtgataaaataatcttccatgaaatcatcaatactttgttcatcaggtatactttgatatacaccgttaacatttaagtaaacatattttcgtggaatcattgtaattgcatagatatcaattggggtcttactaagaatctcttcagctttttcgtacttatcagtagcgtctttgtcgaataaccctctcatacctgctaatacgtgaatagcatcagtatagaaacgggtatcaccacctacttcatcataacgataaacatatacaccatactcaacttcaagtttaacttttacttcatagtctgatgcgtcaggatttttatctttaattaatgaaatgtatttttgatacaattcactgcttatttcaaaatatccatagttataatcattactagaagaaaagcctaatggaagtctagtactaggattgtcattataagtaagtccactaaatccacatccaacttcatcgtgaattttctcatcacttatatctttataaagtttcaaacggtttgccaatgtgttatactgaacatattgtctaaggtcagtaaacatatcgttatgcgttgattctttataaacacgttccaatgtagcagtgaattcatcagttgcttctaaatcttccgcatggtctttataccactggttaacgccatatgctgttcctagtgttacatccaattctggatagtagatttgcatttgataagcaataagaagatcgaaagtttcttcactatattctgggaaagaatatatattacgttgtaattcatagttactaacagcatccttttcattggattgatatttgttattaacacttactaattcatttatgcttgccaaatcttcatttggtttacactgaatattatcataatgcataataatatcaatttcttggaatcttctatttggtgtaacgaaatcacttggtagtgaacctacctgttcccatttttgggtaatttcattaaattgagcgtactcataatcccaaatatctttttcagttttgatccaagaaccgtcaacgaaaatatatccattaggatctaaatcattacatagaccttttattaaatcatcatcagatgtcttttgctctatttgtgaacgaattttagttctataaggtttaacttcttcaaaatattcaacaatttgattaatcaaattatcgtttgaatagttttgaactaatgattgttccaaaccaacaatatagatatatgatgttttaaatacccaatccacaacactttgttcaacatgtacatatttgaccatatcaaaaacaatttcgctttgatgtaaatcgaaagaatttttgagtaaagctagtgctttacgaacgttgatttcacgattgcttagtgaaccattatcattatgaacactataatctgcgtaaagcatatcattgagttcaactgtactgttttcacgaccaatcgctttccaataaattgaatcgcgtgattgtgatttaatatacaatgtccaaatgttttcactatcggtaactctgataatatcgccaacttggtagtttttagtattagcatcttctaagcttgactcttgagtataagtcgtgttactatcatatccaacatcataccaatcagcatatgaccagtactgagtcatgtctaatgaggttcctagtgattcaacataatcagattgtttaatcattttatgttgtccctcacctttgttttctaacgttatagtaacaacactacccgcgtttgctggactattcattaactgaatatatccattttcgtcgaagtgaataaaataaacagcactagaagttaatggatttggtagatatccactagtacttaaaataacagcgtcattttctttaaatttatcactttcaactgcaataactaattcattattgtaagacaatacacggaaagaaacttcattagggttaacttcagtggttttaacattaaacacatcttccataacaacactattagtggttatgttttgtgacctataataattattagcactttctacaaagtttctacgagcttctataacattttggaaccaagttttgtttgatcctaaaccgttatcaacatctggatataataaattaatcacagaacctgattcagttgtttcttgaccaattagtgagttccacattgaatcccaaattagtgggttaaagttatagctgtcaccttctttacatagttgatactggtcatgtttaacaacttcagtactatccatgtaataagaaacagttaaaatactggtatcatcattcactttaaattgcatattactaagaataaacgagttttcatttattggagcgaaccaaggaatgtttagctgtgttggatctttaataatacgagcaatgtcagtacatgatttcgttctggtatgtagtggtggtacataaattgtatcacgtacccagaaatagtattttgttacataactatcagttgaactatcatattccaaaaatgtactataattatcttcaagtgcagttccacttggtagatacatagtattatttttgtttttcttagcaacatctttacagtatttgtcccagttatatggctcaactggtgaacaaacccactctaacacatcaatggtactatgtggtaacaaacggccccagttgtaacgtttgtattcattggttgcatcaatatcaacattaccgtctgcgtcataaattgcacgagtataatccaaataaaatgcagtgctagtgttccaccatacttgaccaactttatcagcaccccaagcctggattaactctccattactattatactgtgcaggatcaactggtgaagtatatgttacgttttgcatagccgcacctggaataacaccattaattgggtcataaacgtttagatatagctcagtaatgttagtacgttcatcatatgtcgttggacgatcaaataaagtactttgtggtgctttaaaactatatttcttgtcaatgtaagcttgacgttcatcagtactggcaaaacgtgatacataacgatacaaacgtggacgtgtatctggatcagtaaattcaatatcaatagaagtgtcaaatggaactaccataactttaggatcagaaccagcagtataatattgactttctactgttaaagtatctggcataaagttagtttcatcaacaaaataataataatcaccatcttcaagtggtacattatcagttaaagttactttacaaaattgttcagcatacacatcggtattttcaataggtgttatagaaaccatttgtacattagtatcaaccaattcaaaaatgttccacaaaccattaccgtctttaaacatccacacagattcaggattttcacctttaccattagtataagttatgcggtcattatatgcagtactgaaatcttttgttgtgtacgatacttcatccaatgttactggaccaatatctggaagttggatgttttcacttcttccactacgcattgggaatgagaacttaccatttggacgtgtaatccaacgaggatctttaccttgctcaccgaagtatacaatatgattaccattaccatttgaagttgcatttacatcaaaagaaaccatttgaggttgttgtttaaattggtcattgattagtttaaattgaaggtttttcttaccatcaatattaccatatgtaccaattttaaatgcccattcttgtaatgctttatattcatcagtgtcatatgatttagaaacacgaagtacacgttctaaaacttggttagtacctttatcgtgaatgaatcctttatagaaatcaacacgactaacatcactactaatcatacgctgtagataatcacgagattgataaccaatcaaatggtttgacaactcttgtaattgtacatcacttactggagtttcactatcataataatgttggaaatccgacactaatttttcaaatgatggtagtgttccagcttccaagataataaatccaggagcttgtaggcgaccagtccatgaaccagtaatatatccatacattttaattagttcttgaatagaaccatatgttggctgataaatgtaatcaccaaaaatagttttatcatcaaaaataacagcatgttcatatgaacacaaacttaaacgaatcaatgcaatgcgtttattagattctaaagttctaacagtgaagatatttccaatacgagaagtttcaatttcatattggcgaataccttggttattatcatcaagtaatgaccatacaccaccattgttttgcgtaatagattgtactgaaccaaagtctgccccaaatttagcgtttgcagaacttggggtacaagaaataaattcaccagttactagagaattctgactccagatcacgaaatctttagcaatagtgttccaatcttgttgagcaccactatcatttacatcttcaaaaatccaaccatgttctttaagatattcaccatatccacaaataaaagtataaacttcttggtaactattgaaaactttaccatattcaattgaagcttcagacttccattcattataatgaacaacattacggttttccaatttaagagttacttttctaccattttttacgggaagtttatatttaaatttagcaccaactagatcatatccatcaatctgatatgcactaccattccaagtaattttgatcgcactcatttgctcatcacggatattattagaacgaacaagaccaatggtttggttttcttgtgaaataagaccgaaagatttagcattgaatgttagctgatctgctttagtaaatcctccaattttatgaccaacatttatataagaagaacgaactacatccccatacttggtggtaatatttttattttgatacatcaaatggtcacttacaaacatttgataaccaatggttcttgtgctattttcaccatgaactactgtatttttatcaaaattaatacgcttacgtgtatcaccataaaggaattgtgaaccatcagtgaatacttcttttaagttatcattgcgggtatcccagaaatagttagcaaattgtgctggtttagctttatacaaaagcatcatttggtcatatgcaaacaatgtagtgttcatgtatgtaaattccatgtcacccatatcaccatatgtccaaggttctgctctatgatttaaagatccagacactaaacctaaaatttcaggtgcaatatattcaaccacacaaatatcaataccagaagatgttttatttccagtttttgtaattttgaatggctgtacaccaaatcttttatatttgtcatattgaccacgacgatcaccaaataaaatagttccagtactgctatcgccaatagttccgtcaatatcccaaagaccactaggaactaaatcaccttgctcattcataacaagtgcttcatatacatatacaacatcactatcacgttcaccaacttgaacagccgttggttcgtattcttggttccaccaagttggacgttgtgtaaagccaaacatttcccacggatgggtagctgggcgatatgtaccatattggtcagtgtaaatggcacgccatgaaccacgtgcaggaatttcagtactttgaccattaactacataataagtgccagtatagttccaagttctccaattgttaggatcataatcatgtgtactattactgataccattagttgcggtgaagttaatgtatccacgtagtaataatgtttgtttctcttcagcactatattcagttttagtgaaatatggtgtagggaaaaggtcatcactattcaatactggtacgtaatcaacatctttgaatttattatcaatactattaaaaattctattttctaattcatatacaacatcatccattttatcaacaccattgataacacggtatgctttggaaataataccagtatgactgatgttataacagcttggtttactaccagcagtgaggaatgtcgctttttctggtacatatgcttgaagaatacctaagaactgtggtgttggtggtataaatgcacgaatgaatccagaagtacttccaacattatcataatagaatgggaatgaactatcacgtcccatattaatagtagttaaaattgcatcaacaatgtttgcagcactattttgtaaaaagtctgatggattttcatcatacatacgaagcatttgtgtattaaatttattaatgaatctaaaatattcagattgcataaacatagttgcttcaaacaaatcaatatcttcatttgcagtatgtgccatcaatggaagcatagatgcttcattttggataattttagtacctacgccattattaaccaatcctttagccaaacgttcttcatagtcattgaaatcatcagaagaaccacgtgtaatgttcttttgaataatatcctgaaaatgtaaagtgtagtcaccttggttaatgtatataatattagaattatatgggttattttgtaggttgattggaacttcatatgcacctaattctttattaggagttacagtactgctataagttctgatttgaataacagaatcttcatccaaatctacagtactatctagagtgatgctttgtacttgaccttttgaaacatttttggtatatttggacacatcaacaccatcaaccacaacttcaataatatcagaatcattatctaaaactttttgtgccaattcgaatgtatggtcatattttacaatctgaacaccatcaccagtaattggatgccaatctagataagtttctcggtcagctttatagtactgatatgttctatcaacttcaataacatatgcatacataccatcaactggttctttaaaaacttccatatcataaacagtactgaatacacgatacatatcagtacgttggacttgtggagtttgttttacaaattgtttagagtactcttctgaacgaacccaatcggtttgaagattcatttcattattttcatcaataatgttataatagtataaaccatcaatttcaacttcttttccaagatggtcataggtataacgttgggattgtaaaaagttttcataaatgtaataattataatcaccaagttcaatgttatatccatatacactatcagttgcatagttgtaatttattttaaaaccaaacaactctgaacctttaaagttacttgatggatatgtagtactgttgtcaagtttgataccattacgatcataaagttggaatttagggaatacgttaacactagtttttgattgtgcacgaacccacaaagatccattccagtacatagaactattaccatactcattacctttagtgattagaacaacatcaccatcttgaggttcaccacttgggcgtgattcggtttcttcttctggatctagtgctaaaccataaacacgagtaccatcttgcatttttttcacatatacattataaattctattgttttcaccattgttaccaatactggtgaatagaatacgcattccatcttgcggaataataccatcaatacgtataccactattaatatctttttgaacgatatcttcaggtttaataatatcagagaacagatcaacagttccacggaattttgtaccgtagttaattagctcaatatttttattatattcaataattggtgcacgtgcacgaataaaacgtgaatcttgcattaattcttcagttaatattgagccatcttctaatgtttcacctaaagtataccaaaagttttgtagtgaccatgtattaccattaagtgctccacgttccattacaatgtaatcaggtgaagtaatattataagagtttttagtatcccaaagatatgagctaaaattgttcattttatttgggttaatagctggagtccatgcataaaacttaccgttgaacaaacggctttcattatcggttagtgctccataatgattcatgtatccaactagatcatcataaaattgaattgaacgaattgtcgaatcatcattttttgagacgtaagcagtggacaactgataaagttgacgtgctacagtactttcatgtaagaagatattaccagcagcggcaggagaacccatatcaccaatatagccgtcaactaattcgttttcagccggattaaaccattgttgaataacatcatcactgactttttgaatatcttctaagccttgcatccactcaggcaatcttttaataaaaagcttcttctgtactgcttcagccatctgtgtaggttgaaacttaaaattattagtcatttttggactccatataattcgttcattcatttgatttatttatgatataaaaaaggcgttccgaagaacgcccgttatattaagaaccgatattaatattacttttagctagtgagttaacaatttgaacattttcaacagatgcagtactcaaaaatatttggtctgaacgtgaagggatttcaaatagagagccaaattttgaatttggattttgtgcaactataacaatggtactaatatgtctacctaactgtgagtgtatgtaagtacacaaatcagtataatagaaactttcaccgaaatcccagttgtcaacattgaagtattcattagttaatgctataacattttgacgaatttcatcgtcactcattgtgctgtttggtaatttcactactttaaaatcagctttgtaatcttcagcagcactgttgccaaataaaggtaagtactcagcactatgccaaataatactatcactaatgactattttttgttcaacatctttgaacatatctttcaattcaaccgatgtaggtggtttaggaatactaccaacagcattatttttcaaccaaacgtcaacttcagttttatatgaattggttaatacatacatatcaattaagtttgttctactaggatcaatgcgattgtcgtcaggtgcatagtgtttccaatggaagtctatactagtacgtgcattagttttaacagtgtactgtgaagtaacatctttgtatccataataatctagcttctgattctcgtcagcattagttcccatgttattaattgcacgataaaaagccaattcaggactaacagtgccagtatcatcggaataagttaaattactaattagctgtcctaaacgatcattgttattaccaactgtttgttcaataaaataatatttaccatcatagttaaaaccaactaaaaatccagaacctttactatataatccactcaatgtggttgaacgaattgcgttatttctaacaaattcagttcttttatatgcattcggctctgccaaggcttgttccattgtataagaccacgatgaatcaagaagtgtgaaggtatcatttggtaacgacagtactgatatagtgaaatcactattttcctgaaataccaaaataccaccatattttaatgcatcggttccagtccaagtaggaacaatttctttaaattggtttggttccaatggtataccattactatctactttcctagatgtaacaataacacgagaaccatctagatagccattctcttgttgaattgtgtcataaatttgaaaatctatattacttgtcaatcctgaattactactactagtagtgttagatgataaaatttcaatcttatcactttgaactgtaccagtactaatatcagtaatttttttagatgatacaaagtaaaatcttactttttctccacccacaaaaatatattcaataccgttagcatcaaattcccaagtttctgctgtatattttacattaattataattaaaacttcattgccattatatacaatagtatcatcattggtacttacttcaataggaacccatgatgtcgtttctttgtcatgtacaataacaaaatcagtttttttatctagcatagcagaaattgcttgaacttcaaccgagttaaatctagttctatatggtaaaatgtactctatggcttgcattccacttggaaccgatgtactcagtacataaaatccattatccaatacactaactacactagcccatatagtagttccagaattagaaaatttaattagagtaccaacctgatatgaaccataaactgtaccagatgaacccaaaattctaccatatgtgttagttgtataatttgaattgtataccggagtccatgcttgttgtatttcaataccaattgtatttgatggaaacgcttggtaacgttgtattaccgcattttcaccaatcaatggttgaatattgtcaataacaatactagcatttgtttttgtagttggtagtaataatgacctattaaattgtgtgttttcttgatataatgcaccatcatcactaaaaacatcggtattttgatacttaccagtaggatcattaatatcaataaatcttgattgtccactataaattctattaatagctttagatttaagtacagtattgcctaaactaagtggtgcaatattataatcttcaccattgacaaaacggttttgtgtatagtacatttgtggtgcacgtgctttaatctgctcaatagtctctgcactttgtgcacggtcggactcatattgtaatgaaaaacgtatatccaatgtactagattcataacttgactgtgtttttgtacgatatgtatattttacgcttttattttgaatttcagaagttttaatgttatatgttttaccattactaacacgataccatacacggaacgtcccacggggaacaacaccacttcttgagtctggatacttaattgttatttgatctttatcacgagtagtaacagcaaaaattgtttttaattgacgattaacagtgttatatgcaatactttccattgatggaacttttgtccatttggtacgaacaataccatcttcatttatttcttgaacccatacatcagtttcgttgatattatcaacgttaatatcttgtatacggttctcttcacggatagcatattgataatcttgatatgtcaatgtaccttgtacgaaatatacaaaaaaaccagtatttggtgagctaaatccattaccatcattttgataaacaatatatttttgctcttgtggttctggatgtcgttcttcaacaccaacagacgtaatatcaggattcactacttcaaatgtcatagattcaccattgacagttgcaataaatggaatactgggtgctgtcattgggatggtgttcattcgatatagttgacgggagacaccattaacatcaatacgcttgactggattaccaaattggttagtactgacaaatgaactgttcattactagaatgaagttttcataccagttagcatccatcgggtcattccaacgaatgattttatcttttaatgattcattaaaactattacgaacatcttggtttgttttaatttcggttaatttagcaactgcacgacctggatatgagcggcgtggtgagtaagaaatcattttagctagttttagtactgatgcacgacgagttgcagtatctaaaaagttttcacgtgtgttcaaatccatacgaaatgccaagttctgccctagcatagaaatcgtatctaaaataaaaataaactggtcgttttcgatccagtcgttgaatgagtctgggtaagttgcacgtagataatcaatcatactctgacggatagtatcgaaatcataagctgttagattgattttataaaaactttcatatacttgagtccaatcctcaccagcgtataaatttgattgccttttttgttgtgacataatttattcctttaaatcagtaaagtactagttcagtactgggaattatatatagaaatatttattcaaaaagaaaagcactccgaagagtgcttttgtaattataaagacgatactgaatatgttgccattctgttattacttcttgcatcgaatacaatagtaagttcttctaatgtatccaatactacgtactgtaatacaatattcatttggtatccatattctattcttgaaatttgcaatttcttaagatttaagcgtggatctaagctaattattctacgggcatctgcttccaaaaggttgatagtattataaccttccaattcaaacagcaaatcccatgcaataaaaccatagtcagcatcaaatgctctttcgcctttttttgtattgaaatgattcattaaatcttggcgaaccaattcactatcatacaatgtttcagttctacccactactggggtagaaaaacctttaaaaacaactgccattgactatttcctttattatacggattcaacaatacgtgccatcttttccgctcttgaagtggtttgtttataccatgtactatcacgcaattccttaccagcagttttataatcagccttacctaatgcggtcattgcttttttaaattttaaaactttggttttgcccatctggaataccatcaaccataatacacgttgaacctgtacaggtgcggtcataccaaattgttcataaattgattttgcatcattgtacgcagtttgagcatctttaagaagaagttggtcagcttgtgcttctgttaaaccattcttgaaattttcaccaggtaaaactaggtgaccatagccaatagtatcaagacctaagctgtctttatatacccaaaacttatcatttttaaaataaccaagttttttctgataagcaatagttccttcaaattctttaatttccttaaaaaattgctcatctgtatttttaatttcccatttactcataaagatatcctcgttttatttatagtactaaaatatttattgacatgcctctaaacgacgagccattaactcagcacggcgagtagtttggcgataccaagctgaattacgtatttgagcagcagcttgtttataattacctttagctaattcagacaacatagttttaaatttaagtaccccacctttacccatctggaataccatttggcatagtacttgttgagccaaataaggtgttttcatgttgtatgaagcataaattgatttagcatcatatatagctttactactatcacgaactaacatatcgttggcttgctgttcagttattccatctgaaaagttttcaccactaataatcaagtgaccataaccaatagttggatacccacgactatccaaataacgccagaatttaccattacgataatatccttttgcttgttggtattgtaatgtaccttcatattcttttaattcagaaataaactgtgcatcacccggaacaactttccaatcgattgcagttttatcaacatttccaatattataggtaggttgctccaccggagttgttgaagctccacttctctgtgttcttctcctacgaggcacatgacgagaaccacgttgagaatatccagtacctatcgttttgatttttgttgtaactaccaattcatcactatcaactgaaggttgtacaactgcttttggagcagattgattagttgcttgaccaccaattaatgttttattcgccgcatcagaccctgttcctgtttgtgaagcataaaataatcctgggtcaacagaaccactgaatccaagaacatttgctgatgtaacacgaatttcaaactgtatgacaccatttgcttttccaacaacttgacctttttgaacaacatctttgtttaataaatcagattgaatattataaaaaatagatttatatccagacttatgttgtattaaaagagcaccattagtaattactaccacgccaccatctggtgcaactacatcacctttacattgtatttcccaacctgaacggtctgcctttcctccactttgtgttggaacacctttcccccagtaaccatattgtcgaatagtaccgctacatggcattaacatatgtaaaccttcatatgtaatactatatccagtcatcccaggatcagatgtcatcaaatcttgtgattgaacttgttcagtttctgatgtatagttaacaaactgaacagcttcagtgtcttgtgctacgggtaattctggtgatacatcatttgctggttgtggttgtactggtgattcactagaaccacttccaccaccttgtcttggtggttcaacataactaccatgattttcagcgttaacccatgcagcaatatcatgaatgtgttcattaagaccagcagatggtgttctaaagtttggtgcagtaaattcagcagtaccgctattaccaccactattaactgttaatgtttgaccaccaccactaataattgctgatgatgatccaattaggtttgcagatgttgcggcagaaatagaagcatttgaaccagccgtaatatcagtactgctaccactttgcatacgtaatgatgcagcagtaactaaacgaaggtctgccccagaattaacaacaacttgtccaccaacttttgcatcaagagcaccaattagatctaatttagtatttgcaccaactcgtgcattgaaatcttgtccggtttcaatattatatgaacgtccagcagtaatattaatatcttgaccagcacgaatattaatattcttatcacagtgcatgtcaatatcaccttcaccagtgaattttatacgtgcagtgccatcacggttaattaaaagaacatcaccagtagcttctgataaaagaagttgtgcaccactacgtgtttttattacgacaccttcatttttacgagaaccaacacgtgtatcgtttactgggttattaaattgtgtatcttgatatccatctgggtcttgatcccacgttggtgctgttaattcctcttcagtatatccatcatcaataataaaactattaccacgtggcgaagacataccatatacagtactggtggtttgtcgagtactactacgattcgccaacccagcttcttcgtcatataaaaggttttgctttttaagacctgcgataattggaacgttagcatatttgtcttgcatatcggtagtgatagtgttacgatcatagtcagtaacaggaagtggcatatcagttccaccataattacttacttcagttgccatacctggaaccatagtattcatacgctggtcatatacacaaccaatccaatatgcttggaatgtacgggcttgtgcaaaaattacaacaactgtacaccctacgtctggtggtactgcccaaaaaccgtatccttttggatattgaccatatgcatcagcacttggaatacctggtgttttaccagcaaaaggagacatgtaagatgcttctatccatgattcttttgagtttttatcactttgagaaccttgtatccaaactttcagttttcctgatttagttggatctctgttatccataacagttgctaactgcggataagatgggtcaaaacgacccaactgctgttgtgcatactttttacttgtatctgccataatattttattccttaatcaactatactatcgtgacgtttgagtgcacgaattacaattgcagcttgaatttgttgtgtaaaagaaccacctgcaccaaaatcatgaacaattttattaacacgataaattgtttggttaaatgtggttggtgtattaatatccaaaacaccagtgttatcatttattgatattactggttgtaattttagtaatagatacgcttcagatgttatataatttgctacatgataatcatctgggttaatttccatatcttcaccattaattacttgttctagatattgtaagtaagagtaatcactccaccctaaccagtacgggtcgcctactacacgcatatcgagtttacacaaaaaaggtctattgtaatagttgtcacgtattttacgtctatccatttcatatgtgctgctgttatcgtttaacgaagcggataaagttgtttcattgttagttgcttcggttggcattgtgaacacttcaccataacggtgaccaacaccatcagtgccaccatcgttttcttcataagtggttacataatcttcaatatattgaggtaaaacattgacttgatagttattataacggtcttgttcttctgcgttaccaacctgcatttgattttttgctaaagtttcaacttcagttaacaattgttgttgggcttgtgttaacatccctcctaaatcacgagttacacgtaaatcacttgtttttgcccatgcgtctggtatactattgtattgtacaccttgaatattgagttcttgggatgtatgtgtacctgcatggttcgctacatcttgtatcggaccagggttacgtgtagtggctacgaaaaattgctgatcaaatttcaaatccaaatcaagtatctcactattaagtccactaaattgataattataagttttcatgtttatttttggtttttgatcattaggatctacgtatttttctgcgttctcaaaaaagtactcaaatgtgaaattttcaggttgtaaatccgattcatgaacaatatcacctattttaaatctaacaatataaaaaattactttataaacagaagtattacgataattatcaaaaccaacgtattgtttaactggtataatgtttacaaattgacgcacactagtactatcatcggcttgtacagtacatgtatcaataacgtcatcaataattcgagatataggagtacttgggttccatgaaaagtttttagaaccttgtgcaccacttttagttgttccggcctctgccatttgtttagaatcatagtttataaacaaatcttgcaaatcaggtgctactttaaattcgaaaaatttaccttcggacaattcaccaaatttatatctaagataaccatattgttggtcagccatctgatttaatttatcttctaaatcaaaacagaagtcaccaaagttttcagcagtacaattgaatggttcttttaaggtccattcaatgttatcaactaaagctgctctattatgaactaagttcatagtatacatcatagtactaccactttgtgaagcacttgcagtaacactattaattttaactgaccagcgtcttgttgtttctgggataatttcaggtattccatttttattaaagccaataaactttaattccaagatcaatggcaagtccataaatttatgatatctaagtttgttacttaacgaaattaattcatcatatagactcatactattattttcagacatattaagtactgctgtattaaaacaatagtttgttgtcattcctggtgttgaaggtccagcttgtgtcatttgtacactagtgatattatatttgccagtaacaccactttctgatatcacatgtcgttgcacttctgcatctgggtaaagccaaaagtttttaaaatcatctttatctaaggcaaataaacaaaagtgccaagttgggttatcatatttcaataatttattgtcatacggtattacaaactgacttaaatcgagatcttcataaacttgatcaacactagcactttgttttggtaatgatactacattacttacatttgctttgtaattattttttgtaatagtttttacatcattttgtaatgtatttgctgtagctttcaaactatcaagtgcattagatgtggtggttttagccttaccagtaatacttgtaatatcattttgaaaattatcaactgtacttcgtaaatctgccatacgttactccattagcctatgtttcgagtaccattaagataattctgtactctttgatttgctggtattctaattgttactccacttttaaaattatatataggatcttctcctagtatgtctggatttaacaatgcgaaaatataatataagcgttcattaccatacatttcgtatgctaaacgccaaggttgatattcatatttcaatgggatctcataaaaatcatcagtatcagccggaacaatatcacgtggtaaattatacccaagataccatgtttgtttcaccttagcgtaaggtgagtattgactatagttggacattaaatgaatcctcctttacgtaatagttcaccacgtttgaatgcattgaggttgaacgttttagtcatataatccgatgttggttgttcttcaagttgtaacataactgagattttttgtggaacccaaacttcatcttgtgggttcatatatccagtacttctaagttgttcgaagaattttctactatccatgtcggataaattaaaagtactatcgctactattcaacggaacttgaatataagaaacatcatttgggtaagtaaaattataagattttaaaataacaggaatatcattatatgtataacgaccatatccacttagaagtaagattggtggtggtgcacctgcaattgcgagttcggggttattagccgaagcagcttgtctaccaaaatccatcaacgaaacagaacgtataaaatgaacacatgccaacgcatacatagcttctgctgcggtattcgcataaaattcaccctgaatcgtgaaaactgtattagtagtgttcttatagttgttatagttactgttagtatgtataggggactgtgtttcatactgaattgacctttgttcagtaattgttggtgttacagtccaaaccaacccattagttggacgcagaaacgaaagtagagttggttcggagctatctccaaaatcaccatatacatagttagcacctgcggctttaggtcgtaatcgaattctacgatcaatcatctttttgattctccataataagggaacatttgatgtatttatacgtgggacaaactgctttttggtgctataataacattgatggtacaaggattgtacctattggatttaaacatggagagtaaaatacaatgacaaatagaccaaagcgtaaaaagtatctcaataatgctgatttacttcgtgaaatacaaaaaagtaaaatttcatattgctggttattagacaaatcatatagtatgtatgattatattgtttttcatgagtcagaaattactgctgagttactagaaaaagctaaggcagcacgaattaaacgactgaacaatgaaatgcttgatagtattcgtgaaaaggaaaatatgagtgctaaaaaagctaaagaatatgcagatgaacacaatttagttatcactgacgttccaattgatgaagttgttattcgtgttattacagatgaacatattccaccagatactagagttaactttgaaccattcaagcattatattgtagataatgaaggtattctctatgaagtttgtcgttctcactggaaaggcgaccttgaaactggtgaattcagtactgttcatggtaaaattacaaatgaacttgggaagatgttcattaaacttgcagaggaaatctcacacaaatctaattacagaaactatacatacttagatgaaatgatgggtgatgcaagaatacaattagttaaaaacgcacttctctttaaagagagcattctttataaaaaagataaaccagcagttcagctaaatcctttctcttactatacatcattcgtaaacaatagttttcgttctatattgaatagtgagaaaaatgttcgaaatatacgtgatgatttacttgaaatgcatggctttacgccatcacatacacgtcaaattgaaattgaattgaacatgattgaaaggaaaaatgaagatggctctgtttgataaagcaattacattcactgatattcatttaggtttaaagaataacagcaagcaacacaatgaagattgtttaaacttcattaaattcatgattgaggtagctaaaaaaaataatatcaaagtttgtgtttttatgggagattattttcataatagaagtaatatcaatatccaaacactaaactatggtttacaaattcttcaattattaaatgataattttgaaaaagtatattttttagtaggcaaccatgatatgtatcataaaaacaaacgtgatataacaagtatcaatatggctcaagtttatgaaaatatagaattcattaatgaaattacaacatttgatgattgtactttcattccatttatgattgaagatgaatataagttgttacctcaactaaaaagtaagtatgtttttggtcacttagagttaccaggttacttgcttaacaagatggtagaaatgcctgatcatggaaaagaaacagaaggttcttttggcggttgtgagtatgtttttagtggacattttcataaaaggcagtcaaaaacaacttcaaaaggaactcgtgtagtttatactggtaattgttttccacataatttttccgatacatgggatgatgcaagaggtgtaatgatccttgaacatggtaaagaacctattttcaaatcatgggaacatgcaccaaaatatagaacatttacactttcagaattgttaactgatcctggttattatcttcaagataatacaatatcaaaagttcaagttgatatatcaataacaacagatgagattagttttattcgtgatacatttactaaactttacaacattagagagtttaatgttgtaacgagcaagcaaagtatcgcagaattaattgaagatggtgttagttttgaaagtactgaatcagttgatgagattgtgttgcagcaaattatggaaattgactcacccatgtttgataaaaatcttctaatccaaatttacagatcgttataagggactatatgctaaacattacacgtatatctatgaggaacttcttttcatttggtaatgcaccacaatcaattgaattgaatggttctgacatttcattagtactgggtcaaaataatgatgcagttattgaaggtggtgacagtaccggacgtcgaaatggtgtagggaaaagtgctattattcaaggattagtttttggattatttggtaaaagtattggtaatgatattaaaattccgaacctagtcaataaaactaatggcaaaaattgtgaagtagttgtagagtttgaaaaagatggtgtacaatatctggttgaacgtgggagaagtcccacgtatttcaattttgttactttagggaaagataataaaattgaagatgaatcaaggggagaaaagaaagacacacaagaagatttgaatgaaattcttggtatatctcaattattatttgaacatattgtagtactgaatgctaacgttgaacctttcttagctttatccacacaaaaacaacgtgatatgatagaagaacttcttggaataacacagttgacggaaaaagctgaaatgctaaaggagatgtataaggatactaaacgtttagccgaacaagaaaagttcaaaaatgaaactgtagctgcaagtaatgaacgtattcaaaaaagtattgagacactacaagaacaggcaaaccagtttgaaattgataaaaataatagagtatctaagttaaatgaagagttgaatatatataaaactttagactttaatgacctctatgaagctgctgatataaaagagaaagctcttattcataacgcaaagcgtggggaaatcgaacgccgtgtacaagagttggctttaaaatttgatgcatatgaccgtgaacttgaaagatctaaaagagcattaaatctaagcattgataagctaaaaactattgatattagtgcagaattggaaaatcataatgagttggagatatggaaacagttagagggtattctaaaagagaataataaccaaaaacgtttcaaagaacaaaaactaaactcactaaaaatagctttaaaaggatatgaatgttcaattaatgctgaaattgacaaattatcaacagttgaaaacagcaaatgtccactttgtatgtctgaattagaacataacgaacatacttcttcaattaaagacaaaatccaaagtactattaatgatcttcaagctaaaattgatagttcttcttctgaaattgaaacattacttcaagaaattgatagtattgagatttttgatatgccacctaagcccgtgacatattataatacactttcagaagcacaaatgcatgaacataagcttcaagaattggtcagaaagagtgaagaagaacaaataaacatctatgcaaatgaacttatgtcatcatatgatgaacttaactcatatgaactaatggaagttccagatacattaaacaaatatgaagttaaagagttagaaatgactgtaaattcattatcacagcaattagatcgtgaattgaagactactaacacatttattagccaaattaataccctgaagactgattctttagtaccaatcgattatagcgactataataatcttgataaaatgtcaaatcaccaagatttcttggttaaattacttttaaacaaggattcttatgtccgtaaacgtattattgagcaaaatatctcatatttgaatacacgacttcagtactatatcgatatgtgcggttctgagcataatgttgtgtttttgaatgatttgagtgttgaaattgagaagagtggacagtactttgactataaacagcttagtagaggtgagcgtacaagggtaaacatcgcattatcttgtgctttccgtgatacatatgagtcattataccaaagtattaatattcttatcattgatgagatgattgaccaaggtcttgactcaagtggtgttctacgtgtgtggtctatcttccaagatatggctgctgtacgtggtaagaacgtttatgctatttcccacagagaagagttactatctaagactgaaaaaatcctcaaagttgttaaagaggacggtttcagtactgttgaatatgcaacccttgacgatgttttctaattaaagataaagggagccttagctccctttttttatatcaaccatatttaatttaccgtccttaatcaactttctagcttgctttacacgagcagtagtgttactaccagggacaactcctaacccttccagaatcgcgttttgctgtgttgctggaagccttttaaacttattaacatccacagttagtgcagtgtgatgtataacttgttcatcgtcaggaatgctgttattacgctctaagtaatcagcaagatttctgagtacctcatataatggtttatcagttaagtgcttcatatatcgattgaagctgttttgtacctttccttcccaagcattgacttcattttgaagaacttgtctacaatgttggttaccatagtggtagtgatccagtactggtttagttattggttctttaattataggatctattccattttgtttctttagcaattcgtttcgatagtttgcagcatccttactatcttttaatctttttttcataattcctcaccaaactatttgttatcaaaatatttatagattagttatttgcaatattttaagtacttaatgaatatttttataaaaatagtgagacaactttaaagtttgtgctataatgtttgttgtagtaatgacaatcctgttgaatgcagaaatgcatataaattagaacctgatcctatcgaaaatgtagatggcagatgagcagttcaacagtgcgatgagcaaaagaaacccgttagatgtgggcatagtttgaacccctcacggcaatgcggctcaataaagaactccgataagcatac

SEQ ID NO: 8 - DNA, 164948 bp, Unknown
  Myoviridae; Tevenvirinae; T4virus
atgaaatcatacagagtaaatttagaactttttgataaagcagttcatcgagaatacagaatcattcaacgctttttcgatatgggagaagccgaagagtttaaaaaccgctttaaggatattagagataaaattcaatccgacactgcaactaaagatgaattacttgaagttgctgaagttattaagcgtaatatgaattaatgaggaaattatgattatcaccactgaaaaagaaacaattctgggtaatggttctaaatcaaaagcatttagcatcacagcatctcctaaagtatttaaaattctgtcgtctgatttgtatacaaacaagattcgcgcagtagtccgtgaattaattactaacatgattgatgctcatgcactcaatggaaatcctgaaaaatttatcatacaagttcctggacgattagatccgcgatttgtttgccgagactttggtccgggcatgagcgattttgatattcagggtgatgataattctcctggtctgtataattcatacttcagttcatctaaagctgaatctaacgatttcattggcggatttggtttaggttctaaatctccgtttagttatactgatacatttagtattacttcgtatcataaaggcgaaattcgtggttatgtagcttatatggatggcgatggtccacaaattaaacctacattcgtaaaagaaatgggtccagatgataaaactggtattgaaatcgtagttccagttgaagaaaaagactttagaaactttgcttatgaagtttcttatatcatgcggccgttcaaagatttggctatcatcaatggtcttgaccgtgaaattgattattttccggattttgatgactactatggcgtaaatccagaaagatattggcctgatcgtggcggattgtatgctatctatggcggtattgtttatcctattgatggtgttattagagaacgtaactggctaagcattcgcaatgaagtgaattacattaagtttccaatgggttcacttgatattgctccatctcgcgaggctctttcactggatgatcgtactcgtaaaaatattattgaacgagttaaagaacttagtgagcaagcatttaatgaagatgtaaaacgatttaaagaatctacatctcctcgtcacacatatcgtgaattgatgaagatggggtattctgctcgagattatatgattagtaattcagtcaaattcacgactaaaaatctgtcatataagaagatgcagagcatgtttgaacctgatagtaagttatgtaatgcaggggttgtgtatgaagtaaatcttgaccctcgactgaaacgcattaagcaaagccatgaaacttcagccgttgcatcaagctatcgtctgttcggtattaatacaacaaaaattaatatcgttattgatgatattaaaaatcgtgttaatattgtccgtggattagcacatgcgttagatgatagtgaatttaataacactttaaatattcatcataatgagcgtcttctgtttattaatccagaagtagaatcacaaattgatttacttcctgatattatggctatgtttgaaagtgatgaagttaacattcattatttgtcagaaattgaagctttagttaaaagctatattccgaaggcagttaaaagtaaagctcctcgtcctaaagctgctacagcatttaagtttgaaattaaagatgggcgttgggaaaaagaagaactatttacgcttacgtcagaagcagatgaaattactggttatgtagcgtatatgcatcgttctgatattttctctatggatggtactacatctctttgtaatccatctatgaatattttgattcgtatggctaatcttattggcattaatgaattttatgttattcgtccgcttttacagaaaaaggtaaaagaacttggtcagtgccaatgtatttttgaaactgtgcgtgatttatatgtagatgcttttgatgatgtagattatgatgagtacgtaggttattcaagttcagctaaacgatatattgataaaatcatcaagtatcctgagttagattttatgatgaagtacttcagtacagatgaagtttctgaaaaatatacacgactcgctaatatggttagttcattacagggtgtatattttaacggtggaaaagataccatcggtcatgacatctggacagtaactaatctttttgataaattatcatataatgcttcaaaaaacagtgataaaatggttgctgagtttaccaagaaattccgtattgtttccgacttcatcggatatcgcaactctttaagtgatgatgaagtttcccaaatcgctaaaactatgaaggcccttgcggcctaataaggaaaattatgtacaatattaaatgcctgaccaaaaacgaacaagctgaaatcgttgaactgtattcaagtggtaattatactcagcaggaactggctgattggaagagtgtatcggttgacacaatccgtcgtgttttgaaaaatgctgaagaagctgaacgctctaaagttactattagtggtgacattacagttaaagttaatagcgatgtagctattgctccagttgctaaatctgacattatttggaatgcttctaaaaaattcatttcaattactgttgacggtgtaacttataacgcaactcctaacactcattcaaacttccaggaaattcttaatctgcttgtagcggataagttggaagaagcagcacaaaaaattaatgttcgtcgcgctgttgaaaaatatatttccggtgatgttcgaattgaaggtggaagcttgttttatcaaaatatcgaattgcggtctggtctagttgatcgtattcttgactcgatggaaaaaggcgaaaactttgaattctattttccgttcttggaaaatctgttggaaaacccgagccaaaaagcggtatctcgactctttgatttcttggtagcaaacgatattgaaattacagaagatggttacttctatgcttggaaagtagttcgcagcaattactttgactgtcactcaaatacctttgataacagtccgggtaaagtagttaaaatgccgcgtactcgtgtgaatgacgatgatacacaaacttgttctcgtggtctgcatgtgtgttctaaatcttatattcgtcacttcggtagttcaaccagccgagttgtaaaagttaaagtacatcctcgtgatgtagtatcaattccgattgattacaacgatgctaaaatgcgtacctgccaatacgaagtagttgaagacgttactgaacaatttaaataagggcttcggcccttatcatactaaggaaaattatgctaggttatcaagcacgagtaaaagaagaatacgaacaattgatgctcaaaattaatgcactgggcaaatttttagaaagcacgaagtttctaacagttaatgaagttgaacaagaattactgctttcacagtttatctcaatgaaatcttatgctgaatgtctagagaaaagaattgaacaatttaaataagggcttcggcccttttgttttaaggtgaattatgatttattgtatgaatatcggtgattccgacataaaagagattaaactacatggaaatcatcacgctaatattgtgtactgtaataaatttgagtttggtcacgaaaaacttgggtttctttactgcaatgatgttatagtcatggataaaaaggaactcgatgaacttgaccgcgagtctttagatgaaaacgatcgaatttactacggtactcttaaagtgtataacgcttatctcagcggtaaaaaggaaagtctaaatgcagaaaacgaatccggggttacagagactatttcagattccgacatttaccctatcgaacggtgacttgactagtgaaatgaaggtcaaaattgctgatactgcgagatattctttaaagcaaaatccaaatcaggataaggcagaagttatcgaaagatgccgtatcgcagtgtatgccgagtatgttgtagcagattggttaagtggatatgttaacaaaggtcaagaagatgtagatgacccgtatacatatgcatgggatgttttggcacatccaaaatactgtgggcttcgagtagaagtcaaaacacatcaaactgactctcgttggatttcggtaacaacaggatgcagcggagagtatccatacggttctggaataaatctagggcccattctgaatcatcaggtcgctgactgtataattatattcaacactaaagaaattcatccaggtgtcatccagtacactccgaagttcattggtgatagagaagaccttcgtaaggttgtaagaaaaagtaactacaacggatggtatctttccatttaaaaaatttcacaaaatggtttacataccacaaggactgtggtactatacaactatcaactgatacggatttggagaacaaaatgtttactacagctgaattaaaacgagcaaaagctaagaaaggtcaaggaaaatataaagctgaattagtcaaagaacttcagtttgccgaagctgaattgaattcaatgattattcgaaatgcgcctgaaactgaaattgctcttaaacgtattgcgaataaatgtcttcgtgatgcaatcgtcgatcttttagcggattattgaataaaatgaaatttaaattttattacgctaaacataaaacaactgatgagtttgtgtcagttgaatattctagcgatgatgaaggtatgatttatacccgcttaggattatcgcactgggagtctgatcagccttatttttcaactcctgaagaaattacacgcttagttaatggtcatatgaatgaccactggaatgtaattctttcggatagtcttaaagcggctattaatagtaatgaaatgaaaatcgctgagattgaactatgagttcgttatggtggtgttttgtttggttaattagtattccagtaatttgtttaacatttacttttgtgatgaggttattatgaaaattttgaattctgtacttattgcttgtgcatggtgggttgcgcaagtttcggcagtagtgattggtattcacatttattacgaatatttttaaaaagttgtttacaagactgttcctctgtggtactattaccctatcaactacggaggaacagaaaatgaaaaagattgttaaagctatatggaatataattataattttagttgttttgagtatattcccaatcgttttaatgattgatgtattaaacgtttactttggatttatgtgaggaaaatatgaaacgtaaacgcagtgcttttacatttatggaatggtttttcgataatatttttccggctttattcattttcatgctgatttttgcattaggttcagttgtagttggaatctatttgatggctgtagtcggaatggatattcatcagaatggtttaaaatccgtgattgaaacaatttggaatggtgtaaaatgatgaatttgctgagcggttggttttatattcttatgttttacattggcgcaaatttcccgtattggatgggatggtcaacaactgcatttggattttatactccttgaggtgaattatgaaaatctttaaagatgtaaaagttggtgaaattttctgtttagataatggtgatcagttaattcgtatttcacctcttaagagcactagcgagaaaccgacagttaatgctactttagcaaataacagtaatgaacgtttctgtattgaaaatgatactgaaacttatactgtagaagagttttgggaattgagcgtcgactgcgacgattaatttaatggccgtgtgtattcatgcggccttggagtagaaaataattagaggaaattaacatgaaatatatgactgttactgatttgaataatgcaggcgctactgttattggtacaatcaagggcggtgaatgggtttttggaactccgcataaagacattttgtctaaccctggattttactttttagtgagcaaatttggtggtccatttgatagtccgtgtgtatctgcacgattttatgtaggtaatcagcgttctaagcaaggatttagtgcagttctaagtcatattcgtcagcgtcggtctcagcttgcgcgtactattgcaaataacaatgttccatacgcagtattttatcttcctgcttctaagatgaaacctctgacgacaggatttggaaaaggtcagttagctttggcgtttactcgtaatcatcattctgagtatcaaacacttgaagaaatgaatcgtatgttggctgataactttaaatttgttttgcaggcatattaatgagtaatttccacaacgaacacgtgatgcagttctatcgtaataattttaaaaacttcggtattttaggttctaaaaacagttgaggagaatattatgaatatcgcaaaattattaggagttatttcatttatttgttggataatagtatgtgttttaactatctgtaccgatgccagtagcgtgttttcacaagctttagcccagggtatgtgtgcatatttaacatttgtgttgttatctactaatgattaagaaaatcttgggctattcattagcccttgctactttattggtagcactatattatggagtaatgttcggattaattcaagtcgtgcttttcatttctgatgttattatggcactacattcactagtatggtaaatttatgcaactgaataatcgcgatttaaaaagtatcattgataatgaagcattggcttatgctatgtacacggttgaaaatcgtgctatcccaaatatgattgatggatttaagccagttcaacgatttgttattgctcgagctcttgatttggcacgaggaaataaagataagtttcataaactcgcttctattgcaggtggtgtagctgaccttggatatcatcatggcgaaaactctgcacaagatgcgggtgctttgatggctaacacatggaataataactttcctctgttagatggtcaaggaaactttggttctcgtaccgttcaaaaagcagcggcaagtcgttatatttttgctcgtgtaagtaaaaatttctatagtgtatataaagatactgaatatgctccggtacatcaagataaagaacacattccgcctgctttctatttgcctattattcctaccgttcttcttaatggtgtttccggtattgcaactggttatgcaacttacattcttcctcatagtgtttcttctgtcaagaaagctgtattgcaagctcttcaaggaaagaaagtaactaaaccgaaggtagaattcccagaatttcgtggtgaagtcgttgaaattgatgggcaatatgaaattcgcggaacatataagtttacttcacgaactcaaatgcatatcactgagattccgtataagtatgatcgtgaaacttatgtgagtaaaattttagacccgcttgaagataaaggcttcattacatgggatgatgcttgtggtgagcacggctttggcttcaaagttaaattccgtaaagaatattctttgagcgataatgaagaagaacgtcacgcaaaaattatgaaagacttcggattgattgaacgtcgttctcagaatattactgttattaatgagaaaggaaagcttcaagtttacgataacgtagtcgatttaattaaagactttgttgaagttcgtaaaacttatgtccaaaaacgaattgataacaaaattaaagaaactgagtcagcatttcgtttagcctttgccaaggcacatttcattaagaaagtaatttcaggtgaaattgttgtacagggtaaaactcgtaaagaactgaccgaagaactttctaaaattgatatgtattcttcttatgctgataaactagtcggaatgaatatttttcatatgacttccgatgaagcgaagaaacttgctgaagaagctaaagctaaaaaagaagagaacgaatattggaaaactactgatgtagttaccgaatacaccaaagatttagaggaaatcaaatgagtccattcattggtattacaagcgctgcattagtatctggtggcattttactgacgggtttaggtgttgttcctgccgtagcaggaggtcttcttgcgttcggaattcaacgtgttatcatgacagttatcacagtcatgcaataattttagggagagcctcggctctcccttttttatttcaaaaattttttcacaaaacggtttacaaccaaagcatactgtggtactatacaactatcaactatactgatacagaattacggagattagaaaatgtctaaagtaacttacatcatcaaagcttctaacgatgttctgaatgaaaaaactgctgcgattttaattactattgctaagaaagattttattacagctgcagaagttcgtgaggtgcatccagatttaggtaatgcagtagttaatagtaatattggggtattgattaaaaaaggcctggtggagaaatcaggtgatggattaatcattaccggtgaagctcaggatattatttcaaatgcagcaactttatacgcacaggaaaatgctccggaactgctgaaaaaacgagcaactcgtaaagctcgtgagattacttctgatatggaagaagataaagacttcatgttaaaacttttggatgaaaatggatttgttcttaaaaaggttgaaacttatcgtagtaattatcttgctattttggaaaaacgcactcacggaattcgtaattttgaaattaataataacggaaatatgcgaatttttggatacaaaatgatggaacatcatattcagaaatttactgatatcggaatgtcatgtaaaatcgctaaaaacggtaatgtgtatcttgacattaaacgctctgctgaaaacattgaagaagtaatcactgtagcatctgaactgtgaggaataaataatgaacaagttagaaattatcaatgaacttcgtcgctgtgcagaacctactcaagagggctgggacatttggtaccacggagcttatcttggaactattgtaaagattaagactggtaaatacatgattattcgtgaaagcaaagatgctccagtaggtattcgcaataattttatggcagcgataagttcatttacggatgcagcttacgaaatttaccttgctgattataaagaattccaggaatctcaaccagttattcgatcaattggtgtcaacaaagctcaacagaaaactttatggcaacgtattaaaggatggtttaaatgaacccatttatcaatcgtttaaaaatgctaaatgttcctttatctcgtgagactccagaaagccttgttgaaaaatttaaagcgcatggttataaatgcacagaagaagatattctgaaagaagttcctgaaatctgttggcagactgcatactgggatgaaaaccaaaagtatcaacgacgaattgtctgtgcagctaatcgttttaaattaaaagatggacgaactcttattattccaggtgctcgtcattattctaaagatatggcagaagttttagatgtagttaaacctcaattagttactcaacaagtttgcgatgatgaccaagggtttattgaccaatatagtaattattggacacgtgaagaagcaatgattattgcaacttacgctggacaagtacgtattgaacgcggtggtagtgaaaaagaactttactctgaggacctttactgatgaatattaaaaagtttcaaattgatggaattatgaatcaaatcaatgctctggaatatgctaataaaatgatgtcaactaattggggaatttataccaatgaaccggcatttcagttctgtaacatggaattcactaaaaagcttgtaggaaaagattatgtgtgtccatttagttctccagtaaatggaatgttaaaacccgctttacgcgatctttatattgcgatgaacgaagaaattataaaagaactaaaacgtcaactgaaggtgattcaacttggccagggaaattaattcaaaatctgactattttaattctctcaatgataaagataaaaatctaatacggcactttatcgttgagatgggatataccgatacacgtgatttaagagaacatatatttgaatgtggtgtagctaaaaagttttcattcacatgcaaatgtttgagagaggtaattcagcactatgaacaatttagtcgcaaaacataattttaataaagcttctgttcataaggataagaagaaagcgtttaaagaatctaatcgcaaacagaaacataaggggaaggtctatgattattgattctcaatctgtggttcaatacacaatcaaaattgatattctagaaaagctatataagtttctaccaaacctataccattcaattgttaatgaattagttgaagaattacatcttgagaataatgattttttgtttggaacttataaagaccactcgaaagcaggatatttctacgtaattccagctccaggcaaaaatattgatgatgtattaaaaactataatgatttatgtccatgattacgaaattgaagattatttcgaatgagtcataatcttgaaaaggtaatcgagcataatgtagctcaggaacgtaagtcgttcaaggaattcgtagaaaaaatttttgaagaaaataccacagaccagtttacaaatcaagcgtctgatgatattataacaaagtcaactaattgagtggtatagttaatgaataaaaatattgatacagttcgtgaaattattactgttgcgtctattttgattaaattttccagagaagatattgttgagaatcgtgctaattttattgcatttctaaatgagattggagtaacgcatgaaggtagaaagttaaaccagaattcattccgtaaaattgtttctgaattaactcaagaagataagaaaaccctcatcgacgaattcaacgagggttttgagggtgtatatcgatatttagagatgtatacgaacaaataattatttagcccttcctaatattctggccgcctgtgaacatattgattcaaggcggtcattacttatatgagcatttctataccagtacatggttattgttccagcatagatattatccaaattaaaatatggacaactgtacatgtagtttatttcgggagtaggctttttagttggtaaaaaagcaaattttgagtcagaataataatgacgtccatttaaatgaactgcatattcatccatagttttatcaacaggatatcctccaagtgatttttcgtttattgtagaaggtaattttccttcgtatgctataatatcgacaaaatagtttaagtttttagggcggaaagaatacaccgcactaaagtctgcctcagatgatatatgaactatctggagttgttccagggcgacagattcaaagcgtgcgtttctttccttttcaataatttcactgtatgtttcatactttgattgcttatagtactcaaagaaactatctcccctataccaaacaatcgccattataaacaaaagaattacgacagctacccgggaagcaagaactttcccggtagcgttatctttgaacaagcgatctagaacacccaacagaataccagagggcgaaagtgatattctaggtgctgccatagaccctccttttaagggtatttattcaaattatactcttggaccgtatattacaccaacattttgccacgttggagaggaccctataacggcatatccagcagctccacctgctccaacttttagaactttaccgccatcattccaggcattttgtccatttccacctgcatcgccgcctgcgccggagtgagcatttccgtattgataaccacctcctgggctatcgtatgaagctgcgccacctgagtaaccgccaccgccacccgggccaaacggtcttcctccaccgccaccgatatcttgccaatttgcgccagagtgaggacgataagcaataccgccgcctccgcctccgcctccacaaattactccaccattattaattcttaatcgtccaccaatgtcattttgaatacaatgcccgccctgttggccattaccatccccaccagaatgagtccatccaccttgtccacctctaccccacatatggacgccagcgccaatattcaactgaacatattcattcggtgtatctccgtacatgaagaataaaggaacatctctagaatatgataccatatttccagtaatattaaacactataggtgcactacctgcctcaaaacatctatctcggaaccattgaccattgaagttatggtctgctccaagcgtgtgaattacttcaacagatcgacctatcatattactcatccaaaatggaattcccattctcaatctctgggcagcaccacccatccaaggatctccagtctgtaccctcgcagaccatcctacccacggtccttcaactgccatataaacctccaaggggccgaagcccctcttattattttaacaatgatttaactaattttttaagctcttcaatctctgacttaagttctgcaatttctgcagtatgctcattgattgcagctgtatttaaaccaattacgccgttatagttcaaacgaagtaaagcttcaccatccgggtcgccttcaactaattctggtaaaatagcttgaacttcttgagcaattaaaccggcgttaggttcccatttctgattgccttcttcatctaagcctcgcttctgcatataagtgtaaccgttaattttggaaagcttctcagaagcattttcaaatttaacgaggtcctttttaacacgaatatcagaacggacataaacgtcacgtacatacgttgaataactatcatttgcctggacaagatggccgtgagaaacgatagctcttccggtttctgtccaaaaagcaccggttgaatcccaaagcccaggatgagattgatagcctgcgccccagtttgcaatatgaatcccgttagcaaccatattaattcggccgtcaccaccccatactaagccagtgtcattatcaccaataacaagacatggtccagtccataccgggtcaccaccgccagctgatagtcttgctccagttttaaccatattaggagcatacagaactccattgtggtggaattcatagatagcttgtgggtcatggccattttcctggttacctacacgaataataccttgcgcccaggtattagtaatgcgtcgcataccaaaatctacaccagatatgtatccttcattagtaataccggattttcctttaataataggataataactatcattaccaacattaccaaaatctacaaatacaggagcttctaagccccattggtcgccccaagcgccagattgatgggctgtccattggttggcttttatataaagtcggtctctgttaaaataaaaagtatccgacccttgaggagctaaaccaacttctccgctattatgaatactaacgcctgaattagtttggaaactataaaacgataaggtgttctcagcgccgccattaccaacataccagttattaacgcccgctttttgtcctttcacataacaagattcggttgcagcactgttaataacaatagcatccgagtttgcattaagagttaagcggcctgtcatcgtatcaccttctttggcaacacgagtagctattgcatcgcgaatattagttacatcacctgcagaagtaaacgttttccaaatatccgagaaaatattaccattacgagcaatagcagcttcaccaccaccgacttgaacgttatctgggaagttaacagtaccgtcttgattaaaacgagatgtatgtccttgagttccgtcttcttttaaatgatgaataacaaatgtgcctgaattaatttcagtgcctaaagaccaaacggctttaccatttaaaaacttctgtttaacaataggataatatttgcttacagcatcatcatcaatttcctggaaaataggagccgcttgagcatattgaatatcataaccgccggcacccgctccatgaccaacaaatttaatatatccattcgatgcgaacgtattgtagcttgattgtaaatctggaatagtaactttaccggtatctaaagccatactaaacgggcgaagtggaccgatatcaccgtgtttaccttcaccgtaagcagttggaataatatgaagacttccttctgaacgtctaaaaatggctccataatctgcgttccaaatacgaagagcattcactgctccagatgaaatttcgcctgttgtgtgaactcctctatttccagcagtaacaccagatgattcaaatgaaccattaacgttcatttctacttcaccagtagtaagtctttgaatatagctcatccagctagttgcatcagaaatttccatgacatttttacgggtaccttcactaggattagtaaaagtattaccccacacggaaattgtcatattatcaactgagctactaccagttgtgttacctctaaacatcagtatagaagcattattacggccatctatatttacagaaccgccaataacgtcaatattaccaggagtaaccaacaaaccgccatgagtattaatgtttgtggtacccttaccacgaaaatagtgatgataattaccaccttgataatatcccaaaagagtctgaccatctccaaacgcgttattatcgtgatatgtcacaacagtagcaagagcatagttttcagttggaggagtagttaaatcggttccattagtagaatatccagctacaaattttcttaggctagttgtttcgctaggactaaataaaaacgtttttgttccattattaacgctgaaataatatccgtcttgatgccatttaaacccggtatcattatccccaagaacaattgaggccgttcctaattcagaatatcctttggggccacctggggtgcctatagaaatagaatgacccgctttcaatccaccggaccacgtaaacgaccaaagataagtctccaacccgtcaccggcataccaggttatcccgtcattatctttaacttcatggaaaataccagaaccaactgcattgcgcataatacgaagatggttaatagcagtagtgctttctactaatggggtgttatttgctaatgaatagatgtcataatcaccggccttcttcccgtctgtaatgactttgtcagtcaaaatctgaggagttgacatagatttccatgctgatacttcaggtgaagtaaataggccattgcctgaaaatgcataggtgctttcgcttccagcagcataatcttgaactctgatattaagaacttgtgtagttaaaccatcattagctggggaataaataatgccacgttcgcgactattgctatcgaaaaaacgaacatgagatgtcccggaactttttgtaataagttccccgccttcagtcataatctgcccggcggcaataatatcacgagttactcgagcaataccagttaaattaaaattaccagtctgagtgaagacgccatttaaagtataatcgccagtttggttataattgcctttatgaataacattcccgtcaatgctaccgcctttagcaaaacctaaatcaataatatttccttggtcatctttagtaaaaagtacacggtcttttaagtttatagccaattcaccttcggctaatactgaagcagcaggacgtgctcccgcagttttgcttcttttaaattgtatttgttttaaagtagccataagtcctcttaataatagccgaaatcttgaacagaatccttgattacgatttggtcaaatcgcggaacatgtgagggttgagatgcaggattctgcgaaaaaaggtttggcgcagttaaatttcctgtcatagtgtctccagagcgtaatactctagagtttgcattttctgtaacaatatttattgctccatcaacataatctttgcgagttaagtgtgctggggcggtcggtcctgaagcattagaaataacttgtcggcccgaaacaatatcgctaactgtttcaattgtaccacgcctggcattaaaccagattgtgcgtccctggaccccatcagttgtacatgtgttccaaataccaatgccgtaccatgaacgtaaatccatgttagctttttctcttgaagctccatctccattgccagaatataatccattcaggtctgaaccgccagaaaacgttgcagaaatcctaacgccttctttaaattctacttctttttggaaaccttgagattttgtgccaccattagctttagaaacgaaatcgttatctgcagcttgtggtttattgtattctgaatatattttaaatgatttatagagtacatcgtcaccggctggattcaatggaaaatttccttgatgccaaatgacagagcctccggttgttgaacctacttttaaatcagccattgtaatgcccctttattttaatagtatttataaagaaaaagggaacccgaaggctccctcaatttatacttctctaaattcctgcccaaacactttaccagttttagacgatgcttgcgtaggaagtaccattatatccggaggtgaagcagattcacagatataattaacacgaataccattgatgccaaattcagcgggttttgaaattccgccatttcttgatacttcagaaaagcttaaatttcgcatacctccttgtcccgcttgagcagttctctgtgcatatatcgtaaatcctactgcattttcaggaacaactacataatcttcttttaattcccaagacccagcttgtccagtaaactcagcatgtgttgaggaaatatatccattcgactcatcataaaatctaatagatatattcgtagttccaagagcgagtaaatctgcatcagcatatagttgcgctttaagataaagcacatcaccaggaattaaattgtagtcagaaagtttacttatcgcggatgaagttggtaaacgcgcaatttcattattagttccaccaaccgctgacataaattgctcagcgctttcatacgttcttcttggaaacccggtagctccgacgtcttctaaactgtcaaatacaacatctaaaatagtttgataatcatctgtgctttttctgttgctcagtttaacatgctctaatgcgatagctcttttagaagaagtgtaaaaagcagcatatgatacgtcaaatcttgacaatacagagtcagatggaaaagcagacgttcctgtggctcttagccaagatactacctcaggaggaaaattaacctttccgctagttaatatagcaacaagtctattattcgtcaaagagttcatgaaactaacaaaagcagctgatgtagtatcatttgaagccgaaaaagcatatgacttactatcaactaatgctcccgtagaagggtcaaaaactcgtaaatgaagacctgtgttaaatgtttgacttcctacaggattatcttgaaatttaacgtatggttctgcggtagaaagcgggcaagaacccgctatacttattttatatcttactgaattactttccgataaaaatggcgtttggacatatccttgtccaaactctgccataaatttttccataatacctcttattcaacccattcaaatttaaccgttttattcactgggtcaggaataatgcgaacattaccaattcgtaagaaatcacgaatagtaagattccccattatagcattatcagatggtaaagcaccgatatcagacggttgaggagggttacctccatcaaatacctgaacaaagcttgaccaagaatttttggttttctgccatgtacgcgtccagcgagtggtgcgcgcttctggggttgttggataagtaatccaatcttggtaaagcgaatcaagtgtgttaccaaattgagttaaagtaccaggagatttaacttcttcgccacgttctaaatatggaagaccagtcacttcattagttttttcaaccatcttaaaataacccgggaactggttataagtggctgaatcattaatatcgattgaccagaatcctacagtatcagatgttggcgcacgagtatataaatcagaggttttagtaccctgagaacgaattctcgagttgacagttaaaccgcctgaagttatagtagcacctttgacaatgattaagctttcaccaattgtaacctgaccagattgattattaattgataatggacgtaatccattaaatccaccagtctgatcgccagatgcagtaagcataaaataggtgttagcagcatcattacgaataaagaatccataatctccatttattgctctaaaagcgtttgcgcttcgagaaataatttcaccagttgcagtgaccgaattaccaaatgttgctacgccatttacattcaatgttcccgaagcattaacatttatcggggttactgtaccgttgatattaaatgttatatttccggctttattgcgctgtgaataaaaatgactagacgtttcatcaccaacttcaaatacagtagaacgtgttgtgtctgattccccactaaattgattcccccacacgctgactgtcatcgtttgagctgggttcgttccagtttgaggtcctttctcaaaaatcagacgagttgctgttccatcagtattagaaatggttagtgtactatttgctgaaactgatccaccaaacgtagcagtactagatgatacaagaggggcactcagattcgtttgttgggttaaggttagtgaaccattaaccgtttgtgcaatatccctacgaatgaactgagatgaatctagaccatccaataaattactatctacagcttttgcttttaatggcaaataatttgctaatacacggtttaattcatatggtgatactgcatagttatttttctcgtataattccaatgactgcgttgaaccagccgtatcattaccaacaaatgtaattgaaccagatgaagtcttaacaaaacctcttactagggtagtagctgcccaagtcggttcactctgtacaatccattttaaattttttggagatacagcagtatttgctgacgttccagctacagtttcagcctgagttgcaactttaataacgccttcttgtgcttcggtagatttagtacctaaaagctttttaggagttattaaaacattatctaatgttcctgcagcagcttcgacctgtgtagctacacgaagtgtaccacgctgtgtctcatttgcttcaagaatattaagggtataatggtcccagagagttcctgattcaactaatccagatagagcaacaacagaagtacgatcagtactattaaatctggttttaatttttaacggtgtagagatacgagtatcgtcgacgcctgcgtcgaattcaacttgtgtagcaatttcagctataccacttaaactttcagttgctttacggtcatttaaagttttaggagtgactgcacgagtataatcagttcctgtattaacttcactttgcgtagcaatttcaattaaaccaattcttccatcagttgatgtctttttgtgtaacgtttctggagttacaaccgcatttgcccatccttcttgactctgtccagcaattacttcactttcaactgctaaaattactgcaccttgctgcgttggagtagctttatactgatccaaggctttaggtgaaacaactaaattattagtgtttttattataaacatttgtgccatttaattcacgactagaagctggagtagctcctgcagtagatacaaaggttacaataccagataatgactcagaaccttgacgagcttgaagctttttaggagtgatgattgttgtatcatcggttcctgcattagtttcttgctgtgtagcaatttcagcaacacctctacgagtttctgtagcagttctttcattcagctttttaggagtgatgataatatcatcagcaaaagagaatgtggtatcctggtttacttgagcagttgttgctattcttgcaatacctctacgggtttcagtagcagtacggttagctaacgtttctggagtaattgccaattctttttgtggagaattttctaaatcagcattagcttgagcttgtgtagctaaagctattacgcctaatcttgctctagtagaattatttaaagaatctactctttctacagttggaacgttttgctgtacaacccagtattttccatcagaatcttcaatgtaagcaagctgtaaaactggaacataattagtttcaccattaaaaactaattcttggactgtaacccattcagcctcaggtggatattctgaacgttttggaaattgaagcaattgaacagatgaagcaattttatcttcaccggcagctttgattttaactgtttgtccttttctcatgtaattcatggaaattttaacagtatcaccgactgaaatattagttggaagctgaagctcaattgtttgggttgttccattattcgcaccgaacaccataacttcttcatttggaagaatattagaattagttgttataatgcgtaaacgtgctttactatccccgtcaaacaatctccataatttttcattatcatcaaacattaagaaaccatcaatcgatgtacggccttcaatggaatgagttccaacttcttgtactgaagtcgtttcatcgtatgtagtaacaattgtatgataaagaggatttaatttatctaaatcaacgaaattaataatatcgccgtgattagcaaatctcgggagtttaatattaataggtgcagcagaagtaaatctacgcacgataaaatcgtttgactgcgcttgataaagactcgctggcgttacaactgccgcttctctactataatcagcaacatacatttgccacaaacgattactaaaaattaaaactatctgtgattttggatgagtcattagtactgatcgtacttgctgacctctgaagtttacaatgctttgtaccggagctgtaattaaaacctggttaactcccggttttcctccaatatcttggagaacgatagtatcaccatcaattggagaagatggcaaagtaaatgtaatgtcattaccagctgcggtgttaactgaaattgattcacctgattttaattgatacggtcctgatgaaacagttgtccaatttgcatcagtacgtaatgctctccatcgtacgctattaaaagctcctgctggttttggaatatcatttatagcagcccaaaaacggttatcataaatgattacaaaatcttttaaatatccacgagttggatcatattgttgaactgtgttttcttgaattaagtaatcaacgttaacaccgtcagttcctacggtacgatcagctaaagctacattgattactttatcgccacctgcgtccagaccgtcttctgctctgaactttcttttaatctcggccattctcccgggctcctattgtgttttcaataataagtatttatacttgtttactttaagatttggatggtatataatagaaatctcactaattgaacgaggttcatatggatttagaaatgatgctggatgaagattacaaagaaggaatttgcttaattgactttagtcaaattgcgctttcaactgctttggtaaacttcccagataaagaaaaaattaatttatcaatggttcgtcatttgatattgaactcaattaagtttaatgtcaaaaaagcaaaaacgcttggatacactaaaatcgtgctgtgtattgataacgcgaaatctggatactggcgtcgtgatttcgcgtattattataagaaaaaccgcggaaaagcacgagaagaatctacctgggactgggaaggttactttgaatctagccataaagtcatagatgaattgaaagcttatatgccatatattgttatggatattgataagtatgaagcagatgaccacattgcagtacttgttaaaaagttctctttagaaggacataagattttaattatttcatcggatggtgactttactcaacttcacaaatacccaaatgttaagcaatggtcaccgatgcacaagaaatgggttaaaattaaaagcggttctgccgaaattgactgtatgactaaaatccttaaaggtgacaaaaaggataacgttgcttcagttaaagtacgatctgatttttggtttacaagagttgaaggtgaacgaaccccttcaatgaaaacttcaatcgttgaagctattgctaatgaccgtgaacaagctaaggtgcttctcacagaatctgaatataatcgttataaagaaaatctagttctaattgattttgattatattcctgataatattgcttcaaacattgtgaattactataattcatataaattaccaccgcgtggcaaaatttattcatattttgtaaaagcgggtctttctaaattaactaatagcattaatgaattttgaggtgaataatggctaaaaaagaaatggttgaatttgatgaagctatccacggcgaagacttggctaaatttatcaaagaagcatctgatcataaactgaaaatttccggttataatgaattgattaaagatattcgaattcgtgctaaagatgaactcggtgttgatggtaagatgtttaatcgtctattagctttgtatcataaagataatcgtgatgtgtttgaagctgaaactgaagaggtagttgaactttatgacacagttttctctaaatgatattcgtccggtcgatgaggccggtctttcagaaaaagaactttcaattaagaaagaaaaggatgaaatagcaaagcttcttgaccgacaagaaaatggatttatcattgaaaaaatggtagaagagtttggaatgagttatcttgaagctacaacagcattcttagaagaaaattctattcctgaaactcaatttgctaaatttattccttcgggtataattgaaaaaattcaatcagaagctattgacgaaaatcttttgcgtccttctgttgttcgttgtgaaaaaactaatacattagattttctactatgattaaactccgcatgcctgctggtggtgaaagatacattgatggtaagtcagtttataaattatacttaatgataaaacaacatatgaatggaaagtatgatgtaattaagtataattggtgcatgcgggtgtctgatgccgcttatcaaaagcgaagggataagtattttttccagaagttatcagaaaaatataaattaaaggaacttgctttaatctttataagcaatttggttgctaaccaagatgcttggattggtgacatctctgacgctgatgcacttgtgttttatcgtgaatatatcggacgcttaaagcaaattaaatttaagtttgaagaagatattcgcaacatttactatttcagtaaaaaagttgaagtttctgcttttaaagaaatttttgaatataatccaaaagttcagtcaagttatatttttaaacttctgcaatcgaacataatttcgtttgagacgtttatcttgcttgattcgtttttaaatataattgataaacatgatgaacagactgataatttagtctggaataattattctataaagttaaaggcttatagaaaaattttaaatattgattcacagaaagctaaaaatgttttcattgaaaccgtgaaatcatgtaagtattaattgcttattataaatagattataattatctcactgaccagctatgaggtcatacatcgtcatagcaccaactgttaattaaattaaaaaggaaataaaaatgtttaaacgtaaatctactgctgaactcgctgcacaaatggctaaactggctggaaataaaggtggtttttcttctgaagataaaggcgagtggaaactgaaactcgataatgcgggtaacggtcaagcagtaattcgttttcttccgtctaaaaatgatgaacaagcaccattcgcaattcttgtaaatcacggtttcaagaaaaacggtaaatggtatattgaaaattgctcatctacccacggtgattacgattcttgtccagtatgtcaatacatcagtaaaaatgatttgtacaacactgacaataaagagtacggtcttgttaaacgtaaaacttcttactgggctaacattcttgttgtaaaagacccagctgctccagaaaacgaaggtaaagtatttaaatatcgtttcggtaagaaaatctgggataaaatcaatgcaatgattgcagttgatgttgaaatgggtgaaactccggttgatgtaacttgtccgtgggaaggtgctaactttgtactgaaagttaaacaggtttctggttttagtaactacgacgaatctaaattcctgaatcaatctgcgattccaaacattgatgatgaatctttccagaaagaactgttcgaacaaatggttgacctttctgaaatgacttctaaagataaattcaaatcgtttgaagaacttagcactaaatttggtcaagtcatgggaactgctgtgatgggtggtgccgctgcaactgctgctaagaaagctgataaagttgctgatgatttggacgcattcaatgttgatgacttcaatacaaaaactgaagacgattttatgagctcaagctctggtagttcatctagtgctgatgacacggacctggatgaccttttgaatgacctttaatagattatattactaattaattggggaccctagaggtcccctttttttattttaaaaatttttcataaaactgtttacacgcatagagctttgtggtactatacaactatcggcaatactgctgataattaaagaggaaaatgatatggctaaagttgatattgacatcgttgattttgaatatattgaagagattattcgtaatcgttatcctgaacttagtatcacaagtattcacgatgaccctaattattgcaatttttctattgtcattgaaggtcctcttgaagacctcacccgctttatggctaatgaatattgtgatggcatggatgccgaagacgcagaattttacatgggactgattgaacaataattatcaaggggctatcaagcccctatcaaaatgaggaaaatgtaatgtatattggcaaaaagtatgaacttgttccaagacttattgatacatttattaattatagtccacgttctaattcatcaatagttaaaattattcaagataatggcggatggtttgaagttaaagaagtttcagtcgctaatggatataaagcagtaaaacacattgaatgcgctaatggaaagcatttttatttttgtgatagactttcagaaatttgcgaagacgaatttcattgtttccgcgagtataaagaaccgacttctgaagaagatgaagtcgaagacaagatttctggcgtaacaaaaattcactgcgttgtagacgaaaacaatgtagatgaaattattgaacttttgcgaaaaactttcaaaaagtagtttacagtagggtagtagtgtgatactattaccctattaactaaggagaataaaatgagattacaacgccagagcatcaaagattcagaagttaaaggtaaatggtattttaatatcattggtaaagattctgagcttattgaaaaagctgaacatcttttacgtgatatgggatgggaagatgaatgtgatggatgtcctctttatgaggatggagaaagcgcaggattctggatttaccattctgacgttgatcaatttaaagctgattggaaaattgtgaaaaagtctgtttgaggaaaatattatgtctgacattcatgtaactggaatttcccaagtaaacatccgctgtcaatttaaaactgtacctggggtgactcacattgctttatcacacgacccatattctcgtggaagacagttaactggtgtaattaagtttttcggtggaattgatggtaatgaatttactataggcgatgacgaaattgttggctgtaaattaaaagttcaaaagggcgtgttagaactttttagtgatgaagtttttgatgaaatttcacaagcagttaataaaggaatgctaacgttaattaaaatgattaaagctagcggatatgttcctgatcctttttaataggagataatatgatttttgtttttgaatttatgaatgacgaattcgattatgcaatttttaacgcattgcataatcctgatttaagtgaatttaatgaaatgttttctgacgctttgagtatgtcagaagaatactgtggagaatgtcaacgtgtttgtgtgacagtttttgaaaacaaagaaaagacatatgaagagttattctttgatgctaataaagccactgaatggtttattgaaagggggttttgagtaatgattaaattggtatttgcctattctccaactaaatcggttgaaggctttaatgaattagcattcggtttaggtgatggtttaccatggggacgagttaaaaaagaccttcagaattttaaagctcgtaccgaaggtacaattatgattatgggtgctaaaacgttccagtcattgcctacattacttcctggtcgtagccatgtggtggtatgtgatattaaacgcggctatcctgaaactaaagacggtgatttggctcatttttatattacctgggatgagtatgttactttagtagccggtggacgtatccaattatccagtcctaatacaaattttgaaacgtttatcgatgccagcgaaaatcacatcagtgcaattggcggacccgctctgttatatgctgcattaccttatgcagatgaagtagtcgtttctcgcatcgttaaaaggcatcgtgttaattcaactgttcagttagatgcaagttttcttgatgatataagcaaacgcgaaatggttgaaacgcattggtataaaatagatgaagtaacaacccttacggaatcagtatataaaaatgaaataccgcggcgctgaaatatgaattttaattattaccctattctattagaaaaagacgcgaaacagccaaagtggcagggtcctcagtttattaaaggtgtctatcaattagtagttcctaaagacaagatttatagtagctgtttcactgaatccgcttgcagtattttcggtaatagttctccgtattggaattttgatataaaacttgacagaaatatcgatatttggctgaaagctatggatattggtaatattacgtttgatgagaataattatcatattattggtcgcttttccaaacgcggcaaagaattatatttcacacctgaaattgaaagaaaatttgatgcaaagccatattaattataggtactaaatgaaacaataccaagatttaattaaagacatttttgaaaatggttatgaaaccgatgaccgaacaggcacaggaacaattgctttgttcggtactaaattgcgttgggatttaaccaaaggttttcctgcagtaacaactaaaaagctcgcctggaaagcttgcattgctgagctaatatggtttttatcaggaagcacaaatgtcaatgatttacgattaattcaacacgattcgttaatccaaggcaaaacagtttgggatgaaaattacgaaaatcaagcaaaagatttaggatatcatagtggtgaacttggtccaatttatggaaaacagtggcgtgattttggtggtgtagaccaaattgtagaagttgttgatcgtattaaaaaactgccaaatgataggcgtcaaattgtttctgcgtggaatccaacagaacttaagcagatggcattaccaccttgtcatatgttctatcagtttaatgttcgtaatggatatttggatttgcagtggtatcaaagaagtgttgatgtgttcttgggcttgccattcaacattgcatcatatgctgcattagttcatattgtagctaagatgtgtaatcttattcctggagatttgatattttctggtggtaatactcatatctatatgaatcacgtagagcaatgtaaagaaattttgcgtcgtgaacctatggatttatgtgaattgcaattaaaatttccggatgaattcgaagaatgggacacagaatcgcaggtattttggttgagtcaattcgcaaagccgcataattttgttcttaacaactatgtatcgcacccgccaattaaaggaaaaatggcagtgtaattttaatttaattgtgaggatatatgattttacgatttaaagatacttctggtgtagttctttttacacttcctaacccaagcgagttagaagttccaggaccaaatcagcctattataatttatggcaaaaaatattatactcataaaatgactcgtgagtattttgataataaaatttccacagttaaaacttcttctgactgttattatgatattactgttttaacggaaaaacaatatgaagaattatcaccgcgcgggccgtctatgccaggtagtgaataaatataaatccgactttgatgttaatattcaccgtggtacattttggggaaattacgtcggtaaagatgctggcagccgggaggctgccattgaattattcaaaaaagattttatacgtcgaattaaatccggagaaataactaaagcacatttagagcctttacgtggaatgaggctaggatgcacatgtaaaccaaagccgtgtcatggtgatataatagctcatatagttaaccgattgtttaaagacgattttcaagttgaggacttatgcaattaattaatgttatcaaaagtagtggtgtttctcagagctttgacccgcaaaaaattattaaagttttgtcttgggcagctgaaggaacatcagtcgatccttatgaattatatgaaaatattaaatcttatctccgtgatggaatgacaactgatgatattcagactattgtcattaaggctgctgcgaattctatttcggttgaagagcctgattatcaatatgtagctgcacgctgtttaatgtttgctcttcgtaagcatgtttatggacagtatgaaccgcgttcatttattgaccatatttcttattgtgtaaatgaagggaaatatgaccctgaattattgtcaaaatattctgcagaagaaattacatttttagaatcaaaaattaagcatgaacgggatatggaatttacttattccggggcgatgcaattaaaagaaaaatatttagttaaagataaaagcactggtcaaatttatgaaactccacagtttgcatttatgactatcggaatggcattgcatcaagatgaacctgttgatagattaaaacatgttattcgtttttatgaagcagtatctactcgacagatttcactgccaactcctattatggctggttgccgtactccgactcgacagtttagttcatgtgttgttattgaggcaggtgattcattgaagtctatcaataaggcttctgcttcaattgttgaatatatttctaaacgcgctggaattggtattaacgttggtatgattcgtgccgaaggttctaagattggtatgggcgaagtacgacatactggtgttattcctttttggaaacattttcaaactgctgttaaatcgtgttcacagggtggaattcgtggcggcgctgctactgcttattatcctatttggcatttggaagttgaaaatcttctcgttttaaaaaataacaaaggtgtggaagaaaaccgtatccgtcatatggattatggcgttcagctgaatgatttgatgatggaacgttttggaaagaacgattacattactttgttcagtccacatgaaatgggtggcgagctttattattcttattttaaagaccaagaccgtttccgtgaattatacgaagccgcagaaaaagaccctaatattcgtaaaaagcgtattaaagcacgtgaactgtttgaattgctcatgactgaacgctcaggaacagcaaggatttatgtacagttcattgataacacgaataattatacgccgtttattcgtgaaaaggcacctattcgtcagagtaacttgtgctgtgaaattgctattccaacaaatgatgtgaatagtcctgatgctgaaattggattatgcactttatctgcatttgtattggataacttcgattggcaagaccaagataaaattaatgaattggcagaagttcaagttcgtgctcttgataatctgttggattaccaaggatatccagttcctgaagcagaaaaagctaaaaagcgtcgaaaccttggggtaggtgttactaactatgcagcttggctggcaagtaatttcgcttcttatgaagatgctaatgatttaacacatgaactatttgagagattacagtatggactcattaaagcatccattaagctcgccaaagaaaaaggaccttgcgaatattattcagacactcgttggtctcgaggcgaattacctatcgactggtacaataaaaagattgaccaaatcgcagctccaaaatacgtttgtgattggtcgtcgctgcgggaagaccttaagctctttggcatccgtaatagcacattatcagcacttatgccatgtgagtcatcttcccaagtttctaacagtacaaacggtatcgaacctccacgtggaccagtctctgttaaagaatcaaaagagggttcctttaatcaagtcgtgcccaatattgaacataacatagacctctatgattatacatggaaattagctaagaaaggtaataaaccgtatcttacgcaggtagctattatgctgaaatgggtgtgtcaatcagcttcagcgaatacatattatgacccccaaatcttccctaaaggaaaggttccaatgtcaataatgattgatgaccttttgtatttttggtactttggtggaaaaaatttctattatcataatacccgtgatggttctggtactgatgattatgaaatagaaactccaaaagctgaagattgttcatcctgtaaattatgatataatttgactcacggacgagtcactatctattaactaagcggaaaatttatgagcacagtttttaatacaaatccagttgatgttttaaaagaaccgatgttttttggttcaggtcttggtattgcgcgttatgatattcaacgccataaagtttttgaagatttgaccgaaaagcaattgtcatttttctggcggcctgaagaagtaaacttaatgatggatgctgcacaatttaataaacttcctcagtatcagcaaaatatttttactaataacctgaagtatcaatcacttttggatagcattcaggggcgtgcaccgtctgctgtacttatgtcattaatttcagacccaagccttgatacatgggttgctacatggacttttagtgaaactattcacagtcgttcatatactcatatcatgcgaaatctttatactgatccatctaaggtgtttgatgagattgtattagatgaagctattatgaaacgcgctgagtccattgggcgatattacgatgatgtcttggttaaaactcgttattgggaaaacgctaaagctgatatcgaataccaaaaagaaattaatgcagacgaagacgttattgaagatgctattgagcatgagacatattggaagcgtgagctgatgaaatctctttacctttgcttacatgttattaatgccttagaagctattcgtttttatgtatctttcgcatgtacctttaacttccacaagaatatggaaatcatggaaggtaatgccaagattatgaagttcattgctcgcgatgaacaactacaccttaagggcacccaatatattattcgtcaacttcaacttggaacagacggtgatgaatgggttaaaattgctaaagaatgcgaacaagaagcggttgatattttcatggaagttaaccgccaagaaaaagactgggcagttcatttatttaaagatggagacgttcctggattaaatacaaatagcatgtggagctttattgattacttaactgtatctcgtatgaaacagtgtggtcttccatgcccaattaccgatgctccggttaaacatccatatccttggattcgtgaatatcttaattctgataatgttcaatctgcaccacaagaagtagaactgtcatcttaccttgtagcacagattgataatgatgttgatgataaagttatgatgagttttaaaaaatatttttaaggagtgggccgcaaggcccattttattatgaaagaaattgcgacagaatattcatttattaaatatactgagctagaattagacgataatggaagtataaaacaattgtctgttccgaataagtataatgtaatttatgctattgctataaatgatgagcttgtttatatcggaaaaactaaaaatttacgtaaaagaataaattattatagaactgctattaatcgtaaagacaaaacgtctgattctactaaatctgcattaattcataccgcgctaaaggaaggaagcaaagttgaattttacgcccgccaatgctttaatctttctatgacaaacgaattaggtacaatgacaatcgcaacgattgatctagaggagccgctattcattaaactgtttaacccaccttggaatattcaacacaagaagaaatgatgcttccacaaggaatgtggtactatattcaaaacacaaaagaggatacataatgcaagaactttttaacaatttaatggaactgtgtaaagattcacaacgtaagtttttttactcagatgatgtaagtgcatctggaagaacttatagaattttctcatataattatgcatcttattctgattggttacttccagatgcactggaatgtcgtggaatcatgtttgaaatggatggagaaaaaccggtaagaattgcttctcgtcctatggaaaagttttttaacttgaatgaaaatccattcacaatgaatattgatttaaatgatgttgattacattctaacaaaagaagatgggtctttggtatcaacttatttagacggtgatgaaattctgttcaaatcaaagggttcaatcaaatctgaacaagctttaatggctaatggaattttgatgaatattaatcatcatcagttgcgcgatagacttaaagaattagctgaagatggatttactgctaactttgaattcgttgctccgacgaatagaatcgttcttgcttatcaagaaatgaaaattattttactgaatgttcgtgaaaacgaaaccggtgaatacatttcatacgatgatatttataaagatgctgctcttcgtccatatctagttgaacgttacgaaatcgatagccctaaatgggtagaagaagctaaaaatgcagaaaacatcgaaggctatgttgcagtaatgaaagatggttctcattttaaaattaagtctgactggtacgtgtctcttcatagtacaaaaagttcattagataatccagaaaaactgtttaagaccattattgacggtgcatcagatgatcttaaagcaatgtatgctgatgatgagtattcatatagaaaaattgaagcatttgagacgacttatctgaagtacttagaccgagctctattcttagttcttgattgtcataataagcattgtggcaaggatagaaagacctatgcgatggaagcacaaggtgttgccaaaggtgctggaatggaacatctgttcggtatcatcatgagcctataccaagggtatgatagtcaagagaaggttatgtgtgaaatcgaacagaattttttgaaaaattataaaaaatttatcccagaaggatactaagctgtttacaagtcccttatgttgtgttatagtggtcttactggcataacatgagggctttataatggatttacaacttattactactgaaatggtcgttgaagcatacggtgatactacagatgggatttctgtattcaagggaaatcgtcgagttggatatatcaccgatcttaagaaagatttagcaaaacaagtcaagcggaaaacgaccattaaagaatatcgaaatcgtcgtcttgagcaagcccgtgatatgcttcctgatgcggttgaggagatgaaagtctttttagaaaatcagcttgcgaaatatgattgtgatgtattcattaatcagactcaacctaatgttcatatcaataactgtaaatgttatattatcgttaatcctttgacaggaaaacatcgtcttggaattagtaatccaaatcgtagcgcatcggatatggcagaagatgttgaggcatgctttaaaatttctaaatctccggctgaacatcatattttaattaacggtctttctcaagacgatattatagaggttattaaaactttatgcaattaagtaatacaacaacaggcttgttattaattgtaattgcattgggcggaacttctttaattttaaaaaataaaattgaaagattagaaacgtctgttgtagaaattacaaaaacagccaatgaaaacgctttagcattaaataatttgcgaattcagtataattatattgatgcaatgaataataaaaatcgtgaggcgattgctgctattgagcgtgaaaatgaaaaactgcgcaaagatgcaaagaaggcggatgtggtggctcgtaagccaggattggttgaaaaacaaatcaacaactccttcatcaagttcgcagaagacatccaggatctttctaaatgattaaactatctgcagtaatattatctattggtcttctagttggttgttcgacaaagcctctagaagtaaagaaagaaacagttcatccgaattggcctgtgcaaataaagtcatatgatgaagctaaactgtcttggcaagttaaagttattgatggtaaagcttgggtcggtatgccatttgaagattcccaggaatttcgtatttggcttaatgacgtaaaacgatatgtacacgatcaaaaaactatgatatgttattatcgtcaagagttaaaagaggataaatgtaaatgatttcatggcatcaatttgaacatctcaaaggattgatttatgaatccgagatggcagcgatgatttatggacgacagattcagcggttagaatctttacctccaactaatgatgttttattagctcaatcacgtgctaatcttaaaaatgaataccaaaataagtggggcaaagcatctaaagacttacacgattatattcaatcattggttgagaaaaataaatgaaagctttactagaacgttatattgaatgctcagatcgttacattgatgcatgccatggcgcagtatacatggatttggatcgtggaatagtattaaatgatgaagaccctgcgaaagcgttggatgacgctggtaaagcattacgaaaagaagcaaaagctcgtggtcttgatatgtatcagcttaaaaatcacatgataaaatttatttcatctaacgttcggagcaaatcagcaaatcaatcaatagctgaagcatataaagggcggcgtgagcataatattcgtattcttgaagttttcttaggaattaaatgatgaaaaagattattttgactattggctgtcctggttctggtaagagtacttgggctcgtgaatttattactaagaatcctgggttttataatatcaatcgtgatgactatcgccaatctattatggcgcatgaagaacgcgatgagtacaagtataccaaaaagaaagaaggcatcgtaacttacatgcagcatgatgttgctaacatgattctctgccaagacgtaacgaagggtgtaattgtttcagatactaatctaaatcctgaacgacgtaaggtctgggaagagtttgccaaagaacttgggcatcaaattgaatataaagtgtttgatgttccttggacagaattagttaaacgtaactcaaaacgtggaactaaagcagtaccaattgatgttttacgctcaatgtataaaagcatgcgggaatatctcggtcttccagtatataatgggactcctggtaaaccaaaagcagttatttttgatgtcgatggtacactagccaaaatgaatggtcgtggtccttatgaccttgaaaaatgcgataccgatattattaatccaatggtcgttgaactagctaagatgtacgataagcaaggatattacattgtagtcgtttcaggccgtgaaagtggaactaaagaagacccaacgaaatattatcgtatgacccgtaaatgggttgaggatgttgctggcgttccattagttatgcaatgtcaacgcgaacaaggtgatacccgtaaagatgatgtagttaaagaagaaattttctggaaatacatcgcaccacattttgatgtgaaattagctattgatgaccgaactcaagtagttgaaatgtggcgacgcattggtgttgaatgttggcaagttgcctcgggagatttttaatggctttgcaccatgaaacttgggatattattaattggctcgaagaaaattatgtgaggtaaatatgtttccgacttactctaaaatcgtagaagtagtgtttagccaaattatcgctaataatatgtttgaaaaacttgataacgcagctgaacttcgaatccacgctcaagtgactcatgtattgaacgctttgcttccagaccaggtggattctattgccattacgctgtatccaggttccgcgcatatcattgttgtatttggtcttgatgctgagctagttatcaaaggcgacattcgctttgaatcacagacatcagaattcaaagcaatttaatagtttactttacggtagagttgtgatattatagctctaccaaaacaaatgaggaaattgaaatgagcgaatggtttgaagaagataaggtttatcgttttaaagctgaatataaagatatttttaatgaaacttgtgaggctaataaacgaattgcccagtttattggggaaaattcatttaaagtaaaaatcgatcctgcgaaaaatgttattagcattaaacgcgaaattgacgattgctggtataaagctgttgacgtaatgggcgaatcctataaagttagcccgttattttcaattactcatatgttagaatattcttttttcgaagaagttcaaaaagatgattctatcagtaaatttgaaattaaagctgataaagaaattaagtggaaagtagtaggtattactggttgcatgttttatatctatgctcaaactgatacgaaggaagaagctaaaaagaaagctctagaatatcttgaaaaatatgaagaaggcccggtaatgattactcaagatgctgaattagtttctgtcaaattagttaaaaatgttgaaagtaaggagcttggatcaacatgctgctaagtgaaaaaccaattactgttaaagaattccaagaaaaagttaaactatttgcgcaagaattagtaaataaggtttctgaacgatttcctgaaacatcggttcgtgttattaccgaaactcctcgttcagtattagtaattgtgaatccaggtgatggcgatcaaatatcgcatcttaaactggattttgatggattagttgaagcacaaagggtgtatggcgtactatgatgaatttaactgatataattgataattgtcttgaaaatgatactggcgatcatagagcgcttgattctgaaacagcacagttcattagaataactttaatgaatgatactctagtgaatagtattcatccttctgtgtatgatgctattattgtgacgaagtatccagttgagcttcacgaaaagatgattggcgcaatttttatcgataagaaaaaccgctttaaagatgggcagaatataattagttctgttattaaaagtataactaaacttcgtcacgaaatttatcgtgttgaaactgctaaatctgcttatctggtgattatgaaatgaaagcgagtacagtacttcaaattgcgtatttagtatcacaagaatcaaaatgttgctcctggaaggtaggagcagtaattgaaaagaatggacgtattatttctactggatataatggttcacctgcaggtggtgtgaactgttgtgattatgctgccgagcaaggctggttactgaataagcctaaacatactatcattcaagctcataagccagaatacgtatcatttggtttaactgatcgatttgttttggcaaaagaatatcgcagcgctcactctgattggtcgtctaaaaatgaaattcatgctgaactaaatgcaattttgtttgctgcacgaaatggttcttcaattgaaggtgctactatgtatgtaacactttctccttgtccagattgtgcaaaagcgatagctcagtctggaattaaaaagctggtttattgcgaaacatacgataaaaataaacctggctgggatgatattctgcgaaatgcaggtattgaagtgtttaatgttcctaagaaaaacttgaataagttaaactgggaaaatatcaacgaattctgtggtgaataatgaaatttcgtttggtacagctcacagcaattagttcttattctaccgagaacatttcatttgctgtagagtataagaaatattttttctctaggtggaaacagtattataaatcaaattgggtttgtattgatagaccgcatagttggaaatctgatttagaaaaatatcaaaaattactttccactcttaaagaacgtggaacaatttatcataaaactgtaataggtaaataaatgaaactgacaactgaacagaaagtagcaattcgtgaaattttgaaaactaaattgtccatgggtatttcaaacgtagtttttgaaaagtctgatggtactattcgtactatgaaaggtactcgcgatgctgactttatgccaaccatgcaaaccggtaaattgactgaatctactcggaaagaatctacggatatgattccagtatttgatgttgagcttggtgcatggcgaggtttttctattgacaaattgatttccgttaatggtatgaaagttgagcatttgcttcaatttattggtaaataaatgctttaagaattatttgttattattaattcatctgttaacaaaaaggaaaaacgatgtctgaagtacaacagctaccaattcgtgctgtcggtgaatatgttattttagtttctgaacctgcgcaagccggtgatgaagaagttacagaatcaggacttattatcggtaaacgtgttcaaggtgaagttcctgaactatgtgtaattcactccgtcggtcctgatgttcctgaaggtttttgtgaagttggtgatttgacttctcttccagttggtcaaattcgaaatgttccgcatccttttgtagctctgggtcttaagcagccaaaagaaattaaacaaaaattcgttacctgtcactataaagctattccgtgtctttataagtgatataaataataatatgaattgggtgtcggaataataagttaaccgaacaattctatgtggtagtctacaactgagagatctgtcgaaagaagatgaaattcagaagaacgtgactaccgagttttaatctctaacgagaatttttaaatgattaaacaattacaacacgctcttgaactgcaacgaaacgcatggaataatggtcacgaaaactatggcgcatctattgatgttgaagccgaagctcttgaaatcctgcgttatttcaaacatctgaaccctgctcaaactacattagctgctgagcttcaggaaaaagatgaacttaagtatgctaagcctctggcttctgccgcacgaaaagcagttcgtcattttgtggtaacattgaagtaatttattggagattcactgccttagtgtgagctaaaatcgaggagccgtcgaactgtctgattaatgatttgcgaatcattatagttttaagaccccggcagttttacggtgtacctcttgaatgttattcttatagcggcaagtgcatgctaccccgaggtgatggccaatcgggagtacgcctcaaggcctatatatccatcagtatatatcttatcctcgagaaatcgaacccggaacctttaagctaacggtgtgcaacagataagagttataagtatgttgacgaggtttatggttatcctgtcggtaaatattcaaaacctaagtacccctttgagggctttcgcaggcaatgccaataagtcctgcattttcgtttaaaagagaatttataatggcaaaacaagctaaagcaaagaaagcagttgaaaagaaagttggtgattctaaacgcgctggttacaagcgtgggtcgaactctcgtatcaatcaaactgttgagaagatcatgcgccgagcacgtgcggttcttcgagatgatgcttctcgttttggtaagcagaaagcataagttgaggactccttcgggagtccttttttattttccaaagaatgcacaaagttgtttacagtatagttcctttgtgatagtattatcttacacaaacaaaggagaataaaatgaaaacgattaatctgaacgctgcggttaaaactaaatgtttcaacggtgcatataatgaaactatgtggttcttaatggcagttgaaggtgatgtcattgaagtagaaacaacagaaggtatgggaacagatttcacctttacgattcaagttcataatttctttactggttggatttatgaattgaatacagtaatcgttggaaaaattgaacaaaatgaattaggtgaatggtattatgttacagctcgccaacgtgccgaacgcttaattgcgaagatgaaaaaagttggtaaacttgacatgaagcattggaaagtagtaaaataattgtttactttggtacaggatatgatattatatacctgtaccgcaattaaacatcttggagaataaaatgaactacatcaacttcgaacgtaaatatgtttctaatggtattgcaggttctattgatactatctgcctttggaaacatcaaaatgggtcagtatgtgaaattgaacagtatatgactcctaactacgtttatatgcgatttgaaaatggtatcacagtttccatcacgatggaaggttcaaacttcaaaatcgcattggatgatgattttcgtgaacgtgatttaggtactcatccttgctggaacggtgataatcgtaagcttttggttaaaacttggattcgtcatattctgagtaacaaagctaaacctgagcacttggaagcaatctttgatgtagttcttaacgaatttgatatttaaaataaaatgaggggcttcggccccttactgaggaaaatattatgtttatgactacttattttgatacccgcaaaaatttctgtgaagttgttttctcaaaggcgcctaaagaccttcctgctcatttgcagcctaccagtgaatcgattaaaaactacgttgatgtggtttgtcctttagagttccgtactgtaaatgggcgcgatactttagctatcgctaaactcaatcgtgaaattgacattgacccttcaattgcgcgcgaaattaacatttctgatattggcggcggtaatgttaaatcgcacgggtttcagatgaggttctaatgaaattctttttaggtcaaactgttgaattaaagggagttggtatacctggattaatttctaaggttttatctgcatttaaattgggagatgttcaggtaaaagaggcttatattgtttcttgggtagatgggaatgaagaccttcgtatgggtgatgaattatctcctatctacggattaaaggaattagtatgaatataattaataagatttttggaattcagtacattaaggtcacatataaagtaacagataaaaatccgtatactgacgagcatgaagaaccacaagttgagtctattatattagaaaaggaccctaactggccagttgaatttcgtcttccttgctacggtcattgggctgatgttgaaattataagcattgaaaatgtctgagttagagataagaagtaattttagatggccatcgtgcgcattaagtaatttcgcccaatggccttttgttatggatggtatccaatttggaggtcttgaaggatttctccaaggatgcaaggtgaaaaatgttgaacaacaacgtcgcatatttgggttatccgggcttgccgcccaacaagctggaaggtcttatgctagagctcaggaccgtgggaccctcttctggcttggagttcctttttcaagacactccccagcctggaaagagttgtacacaaatgcatattttgaagcagcgttccaaaacaaaggctttcgtgatgcattacaggcttcgaaaggaaaagttttgaagcacagcatggctagtggtctaacaaaagatgatacaatactaaccgaagctgaatttattgatgtgttaaacctattaagagactctttatgaagcctactattttaactgatattgatggagtatgtttaagctggcaatcaggtcttccttattttgcccagaaatataatcttccattagaacatattttaaaaatgatccaagatgagaaatttatttctccaggtaaactttttaattgtgatgaagaacttggtgttaagttaattgaaaaatacaatcgatcagattttattcgttacttgtctccatataaagatgctctgtgtgtaattaacaaattaaaagaagattataattttgtagctgttacagcattgggtgattctattgacgctctgttgaatcgtcaatttaatttgaatgctctttttcctggtgccttctcagaagtaatgatgtgtggtcatgattcttcaaaagaagagttgttcaaaaaggcaaaagagaaatataacgtaatttgttatattgacgatctcgctcatcactgcgatcacgcgagtgaaatattaaatgttcctgtttattggatggctcgaggagagcgtgacagtattccaaaaactgcacagcgagtttatacatggaatgatgtagagaataagcttttttcaccgaaggaaaataaagaaagttttgatagtgaaaaagctgtaaaagatgtaattgagaagatgattaaaaacgattcttttcgctggaacactacctggagaactcctggatttaatccttataatccatatcatccatattatacacactcatatcagaatccattccatccattccacacatggagttatattaaacctggtggaatagagtatttgtataatagacctacttgtggtgataatattttccaaggagcattctaatgtttgttgttcacactatttatgaaaatgaaggtaatactacacgtgattatggtcacgtaaatcaattttttagatgcaatccagaattccgagctcaaaaagatgaacgaatttttaaaaaatgcgtagagcaaggtttcatttatgtcaagcattggatgcaaggaaataaagttagaaccacatatcataagtctttaactgagcttaatgatgaattgatttataatagaactgtaaaccaaactctgaaggatgagcaatgattcttaaaattctgaatgaaatagcatctattggttcaactaagcagaagcaagcaattcttgaaaagaataaagataatgaattgctcaaacgagtatatcgtctgacttattctcgtgggttacagtattatatcaagaaatggcctaaacctggtattgctacccagagttttggaatgctgactattaccgatatgcttgacttcattgaattcacgttagctactcggaaattaactggcaatgcagcaattgaggaattaactggatatatcactgatggtaaaaaggatgatgttgaagttttgcgtcgagttatgatgcgagatcttgaatgcggtgcttcagtatctatcgcaaataaagtttggccaggtttaattcctgaacaacctcaaatgctggcaagttcttatgatgaaaaaggcattagtaagaatatcaaatttccagcttttgcacagttaaaagcagatggagctcggtgttttgctgaagtccgaggcgatgaattagatgatgttcgtcttttatcacgagctggtaatgaatatctaggattagatcttcttaaggaagagttaatcaaaatgactgctgaagctcgccagattcatccagaaggcgtgttaattgatggcgaattggtataccatgagcaagttgaaaaggagccagaaggcctagattttctttttgatgctcctgaaatcagtaaagctaaagagttttccgaagtagctgaatcgcgtactgcttctaatggaatcgccaataaatctttaaagggaactatttcagaaaaagaagctcaatgcatgaagtttcaagtctgggattatgttccgttggtagaaatatacggtcttcctgcatttcgtttaaagtatgatgtacgtttttctaaactagaacaaatgacatcaggatatgacaaagtaattttaattgaaaaccaagtagtaaataacctaaacgaagccaaggtaatttacaaaaagtatattgaccaaggtcttgaaggtattattctcaaaaacattgatgggttatgggaaaatgcccgttcaaaaaatctttataaatttaaagaagtaattgatgttgatttaaaaattgtaggaatttatcctcaccgtaaagaccctactaaagcgggcggatttattcttgagtcagagtgtggaaaaattaaggtaaacgctggttcaggcttaaaagataaagccggtgtaaaatcacatgaacttgaccgtactcgtattatggaaaaccaaaattattatattggaaaaattctagagtgcgaatgcaatggttggttaaaatctgatggacgcactgattacgttaaattatttcttccaattgcgattcgtttacgtgaagataaaacaaaagctaatacattcgaggatgtatttggtgattttcatgaggtaactggtctatgaaagcttatttagaaacaattgttatagctcaaaaagaaggcggagatgtttctacttccgtatcacaagtcattctcgaattcgtagatgcatatgcttataataaatttacagaaacatttgatgcctatgaaaaaggtccaaagtttgaaatataccgtactctcttaccactagattattaaaggccttcgggcctttaattttataaatagaataaacactagagaggatatgatggaacttattacagaattatttgacgaagatactactcttccgattacaaacttaaatccaaagaagaaaataccacaaattttttcagttcacgttgatgatgcaattgaacaaccaggctttcgtctatgcacctatacatctggaggtgatactaaccgtgatttaaaaatgggcgataaaatgatgcacattgttccttttacattaaccgctaaaggttcaattgctaaattaaaaggtctcggtccaagcccaattaattatatcaattcagtttttactgttgcaatgcaaacaatgcgtcagtataaaattgatgcttgcatgcttcgtattcttaagtctaaaaccgctggccaagctcgacaaattcaagttattgctgatagacttatccgtagtcgttcaggtggcagatatgtccttcttaaggaactctgggattatgataaaaagtatgcgtatattcttatacatcgcaaaaatgtatcactagaagacattccaggagttccagaaattagtactgagctctttactaaagttgaatcgaaggtcggtgatgtttatatcaataaagatactggagctcaagtaactaaaaatgaagcaattgcagcatctattgcacaagaaaacgataaacgttctgaccaagccgtaatcgttaaagttaaaatttcccgtcgagcaattgcacaaagtcagtcattggaatcttctagatttgaaagtgaattattccagaagtatgaatctacagcagctaattttaataaaccagctactgcacctttaattcctgaagcagaagaaatgaagcttggaattaattcattagcttctaaaactaaggcagcaaaaattattgccgaaggaactgcagatgaacttcactatgactataaattccttccaaagagtgaggttggtgaagtttcagaaaaaattaaagatgtaattcttaatgcgattaaaaatgaaccaactacttcaataaaatgtttagagaaatacgcagcagctgttaataaattctttgaagattataaagataaatggcttgctaatcataataaaacccgtaaaggacagccagatgaagtctgggaagaaataactaaaaattcctggaatgcagcaaaaactaaattcctcaaacgaatgatttatagtttttctggaattggcgctggtccaatgattgatattactattgcccgtgatggttctaaatatactccatcacaaaagcgtggcattagagaatattgtggctcaggatatacagacattaataatcttcttttgggtcgttacaacccagagcgatatgatgtaatgagtgaaaaagaaattgaatctgctataaataatttagattcagcttttgaaaatggtgaccgcatacctgaaggcatcacagtttatcgtgcccaaagtatgactgctcctatatatgaagcgttagttaaaaataaagtgttctacttcagaaattttgtatctacttctttaactcctatcatttttggacgttttggaatcacgcatgctggtatcggccttttagaaccagaagctcgcaatgaattaacggttgataaaaatgaagaaggaataactattaatccaaacgaaataagagcgtataaagaaaatcctgaatatgttaaagttcaaataggatgggcaattgatggtgcgcataaagttaatgttgtatatccaggaagtcttggaatagcaacagaagctgaagttattctacctcgcggattgatggtcaaagttaataaaataactgatgcttctaataatgacggaacaacgtctaataatacaaaactcattcaagctgaagttatgactacggaagagctcactgaatcggtaatctatgacggagaccatttaatggaaaccggtgaagtagttgcaatgacaggtgatatagaagacagagttgactttgcatcatttgtttcatcaaatattaagcagaaagtagaatcatctcttggaattattgcgtcttgcatagatattacaaacatgccttacaagttcgttcaaggataaatcatggaacttattacagaattatttgacggcgcttcggcgccggttgttaacttaaatcctaagcataaaatacctcaaatttttgctattcaagctggtgaagaaagtgttctccctggatttagattttgtacatacacctccggtggtgatacaaataaaaacgttaagccaggtgataaaatgatgcatatcgtaatgataggtgttaatgagaaactatcattagttaagcttaaaaacttgggtggaaatccaattggcgttattaatgccgtttttgatactgctcttcaaacgatgaagcaatataaaattgacgcatgcttattccgcgtactaaaaagtaaaacaaatggcgctgctcgtcaaatgcaagttatcgctgaccgtttagtgcgtactaaaggagcaggtcgatatgttctcttaaaggaaatctgggactatgataagaaatatgcatatattatggtttaccgtaaaaatgccaaattagaagacattccgggtgtacctcctatttcaaccgagctattcacaaaagttgaatcaaaggtcggtgatgtttatgtagacgttaaaaccggggacgctgttcctaaagctgttgctgttgctgcttctattgctttggaaaatgataaacgtactgatcaagcggttattcagaaaactaaaatcagtcgtcgattagcagcgcaagctcaatattctactgtcgatgcttcacttcagggcgatagtttcgctgctaagaagtatcaggaatttgaatctaaagttccggtatataaagcagaaggaccaatgaactctggtgttattcaagttggttcaaacttcagcaaaggagctatcggtggtatgaggagtgcttctcgttttaaatctaatgattatgaactagaaagcttccgaaatcatattgcactggctcatgcgcgtttacgtgatccatcgatcaagttgcagagtgatatatcatatcaaggttctcaggaatatttaaagaataaagaattctttgattataaaactgataaaattttaagcgatcttgctgacattaatatttctaatagctttgatgttattaagaaaattgtcaatgatttagttaaaggttctaaagctacaccagatgaaaagacagctattgttcaatttgtaatgaatggcatttataaattgattaatgaatctgctgcccaggcatacgaatacgcaagcaccgaagtaactccaaaaggattaactcaggctgagtctgatgtaattgaagagtattgtgcagattcatatgttgaaatgaactcgttccttttgggtaaaccagattctacccgtgaagaatatatggaacgtgctattaagaacatcgaagcgttagattctgcatttgctaaaggttcagttcttcctccaggaactactctttaccgcgggcaagaagttacctttaaaactttgcgtcataacattgaaaataaaatgttctatttcaagaacttcgtatctacatcgcttaaaccaaatatctttggtgaatatggtaaaaactatatggccttagatgattctggagcagtattttctggcgaaggagaaggttcagttgacgccgaagatttaatgcatatgggcagtcattctacatatgctaatgaagatgctgaaactagcgtaggtatggtaattaaaggggctgaacgaattaaagttatcgttccaggtcatttatcaggatttccatcagaagctgaagttattctaccgcgtggaattttactgaagattaataaagtaagtacgtactttatgaaagaaactgcctataataagtatcttgttgaaggcacgattgttcctccttctgaacaattagaggaatctgtatatgatggcgaccatctaatggaaactggtgaagttcgtccaatgactggatttaatcaattccttgtagaagaatcaaaagaagaggaaaacgaagtttctcaaatcttagcttctttggttaacatcgacaaaatgtctaaaaagttcaaaatgtagtttacaagtccctcatgttgtgttataataatcttacttacataacatgaggaacacaaaatgaaatcttctttgcgctttttaggtcaagaacttgtagttgaaggcgttattcccgctgataatgctttcaatgaagcagtttacgatgaatttatcaaaatttttggaacagataaaaagttcggaatttttccttctgaaaatttttcaaagccagaacagactgaaagtatttttcagggtgtagtaacaggtaaatttgagtcagaagctccggtaaaaattgaagtttatattgaagacaatttagttgcttcagttgctgcttttatttcattccgtaaataaaaatatggggaccgaaaggtccccattgttatattgctcctaatattttactttgcgaattgacaattcctgtcatagtattaatgtttgaaatgcttccagcagttcctcctaatctactaagtcgtgaaagcgaattagataatccagtaacacctccactatttccaagaacgctttgaataccatttatagcagcagattcaagccattcaagcgcagcttgtctatcaaccgacccagcctgcatgactctatacgcaaaagtaacatcaaatgtagttatttgattatctccatcatatgataactcaggagcactcactgacactggaatgcatccagtgaacatcaccgcagtatgaggtaatccattacgagcatgaagattaacctgaatatctgcctcgacatcttgtggcaaagcacgcagtccagttactgggtcttgaacagcgttaacccagtcttgcattgcacgatagttacaagcttctgaatccattctgaatgaaataaccaaagggtctaattctctcccagttatacgaatattaggagaattgtagttccagtcagtttcataagataatctattctctggcatttttacagaatatatcatcaatccagatgagttatatgccatgttaaagaagtcaattaaatatgtaccaactgtaaatgagcctaataaactctggacagtacgctgactcatagcgccaataagatatttactgactcccgattttcttatcagtttttgtgtgccagctgtaattagcgtggtaattccctgattaatatcgccttgagtcaatcctaaccaatctgaatttaggcccaagttattataagaaaagttgctaattgaacttatcaacgaagagcttttagttgatggagttgtcgcaaaaacgcagctaaacatattattacgctggaaatctgcgtttattgcttgattattaaattcctctaaagaatacattagaaagtccccgcatataaagaagcacggtttaacgtgataatttctctcatagtaatctcgagagtaaatgtactagggaggtttggagcaatagctaatccgttaaagttaccattcggtgttttatcaaatctgatgctttgtatttgacatggaccaaatatttcagtttttccatcaaacttagatgttgcaccaaagtttttcaccatccaaattgtcgggtttgaaactacaagaacgttcgttaaacttgctgtcattttctcaaatagtgttttatttttagctgcgtcttccggagataaaggttcaattaatgtagaacgataccaatcatctaaatacccctttatttcagcagcatattgagatttacctgtttcaccataagaaaaatagttaaaatactgatagatattaataatagccattaaatcttctgttgaacgtggagtcaaatcccatgtaaacactttagttctattttcagcaccgccgtacatacttctggctgtcgtataaatctgttcattattatcagccattataccttgcgttatactttccagtgccccaaatactgcagttgaagcaatattacttagtacaccagtagcagtacctccgcctctgctgataagactttcttgaacatcattaaatctatgtgatgatgtatcaacatcagatttagatctcggtaaaagaatgtttgcgacaggagctttacttattgttcctgaattattatttgatattaatccatttgatagttttgatactgtattactaatagtgtttctagctgtgcttaaaatactcgaagatgaagaagagtagttagatctcatcgatctaagacttccagaatccctagatgacatattgtatgcagtaaataataatccattcttatatagatctgttacctggaagtcccctgtagtgtcattaccactagcacgcccagttggaaactgggctgtgtatgttttagttactacttctgatttagtgctctgtccggctgaaattttctcaccggactttttaattaaatcagtagttatttctttaacaattgccatattattccttaattaactccagtcgcatcaaatacaccaggagcagttgtgcttgtgacaggtgtcatattatgaacgacagtatttttcttaataacattattagtattattgattgaaggagatgcttgctgaacaggagtttgctgtgctttgttcttttcaataacctggacctgtttcgcttctggtgatttagcagaagtttcaggtttggcattaggctgatttttcttgagttcttgataagtagcatcaattttagaaaatctagcagcaagttcttttttaactgccggtgaattatttaaatccgggtcatccatccgttttttaaggtcttcataggcagattcaacagatttaaccgttgagtctttactcatatcagctgaatcagcatatttttcaaaacgaatcatcgcggcccgggcttcattagccttcattaaagcattttttctttcttcaggtgaaagttgctttaatttttcttcttctgctgcacgttcttcgtcggtagtcagtgcttctttattatctacaccacgaatccagttagatgcacgagttttccagttcgcaattttgtctaacccttccgctattggaccaaggtctccattcattcttttatcttggtaattagctactttttcttggtcttctttattgagagatgctccagtagaattttggaaattttctaatgctcttccttctacttcatcagcagtatccttcataccaggaatgactcgaagaattgcagcagataatttagccatacctaattgaataagttcacctaaattatagagaacctttccaagcccttctacaatagctaccgtcaaaccaccccaatctcccgcttcccagaattttttaatttcgtcaatagagctaaagatgctctgtaataaaggaccccatgttccggtttcgctagagaatttagtaaagtcagtactaaacaagtcccaggcttgcgaaaatttatctgaccagtatttaaagtgaaccatcaaaaggtctattccaacaacaacagccagtatcattgcagtcattttagcagcttcaatagcagcactgacggtgtacttaaatagcatgcttgatattttatcagtaattgaaatggatttcttaaatccaaaatcaacggtctttgttaatttatctaaagcttgagataattttaagttaaatgcttcttttttctgtttttcttctggtgattcttgctttggctcaactggctgaggagtagggaaaaaatcagcatcaggatcattattaactgcttcaggggccggtaataaaggacccacagattcagctgtatcatcttcaacaactttaacaggaatagcattttcgactactgctaaactcgttccagtctgttgaattccagctgtctgaattttttgttctaataaactcgttaatttatctaatttgcttccgagtgattcgcctatttctttattgatattattgccaatttcgacagtttcagcaattaactcagaaccagcggtagtatcactcactgcgctttctacattatcaattgctccaactatttcatttgatttttcttcaacagtttgagctattaattcagaagcagcttgagcatcatccaattttgtagaaatgtcattaagcccagataaagtgttggaagcggatttagccgcttcctgtgttggtttattatctgaaataacttttctacgcatcgtttgcatttcttgtggctttttcattcaaataatccaataatattgccaattccagttattggaccattagggccaggaattgctaaagttgtaaaaatatcatttgcccattttaaaacgaatgctggcatctcaagaaaattaatttctttaacttcatcgttgaccttaagcaagcatttggataacatatcgctcacagttaaaaattgttcaaattttccaggaggtctaaaataaaacgtatttccttggtattgaaactctaatctttggcatacataaacatcatttatgtcataagtatatccatctatttctttacgagatttaatctttccattaaattctagcaaatgaatagaaacgaaatcaacttctgctggtgataaattcggacaaatagaatcaataagaagttttaaattttcatcaggacctttaacatcttttaaaatattataatgtttaagacccattttaggaatagaaacttctttattgcttattggaagaactactttcttcagtggtagtatcagatttaaattcatttttaaccttaactgggtctattgtttccagtttcgttgcattagtgaacatatatagatgagttacggaattattatttgataattcatggataacttcatcaacgtaaaattcggttttaaattgatttttactatcattaaaaataattttaacgccaggagttaagttaaaattaccgacagtagaacatttagcgtaaccatcatactgtgccatagtctgaagacgaatagcttcttcatagccattcctataagtcatttcagaataagctcctgaccttgacactacaatagagttttcgccctttcctgtagtaatcattggcaatgaagaatctaaaaatgaatgcgcatagatagtagcatttttaattgggtcacgtttatgaggattcgatttagtcaaccaaacgaaatcatatgctaatggatattttaattcttgaatgaattgacctattaaagatggctcaccgacaatcattggatatggttcttgatttatcatcatatcatagtccatcatgttaactcccatgatgtcttgccatacgaatacaaatttgtcacttcctacagctagagcaacttctcttacataggacaaataattttcaaatgtgctagtccatggaatatcaggaacataagcatttatagcatttattgctggagtcaataacgtgcgatcttgataaatgacaccaagcatttcctttatagattccccggcatcagggaaaaacggtctaccaaatttaagattttctatagaatgaatagttcccaattcaatagcaatgatgttatcaccctttgaatctactgatacggaaaaatgcttacatccataaattcgtgttttaacattattaatatcgtttgcattagctacagaaatttgaattatttcatttccatccatttttgtgtggatatttttagaatcataaaactgcagcattccttcatttcgaccataaagagagtcacgcatagttaatgtggtaatagtagcagctaattcaacaaatctattattactccaagcgtcgtagctatcaaataatttaacgctgagatttggatatccagggcgttgtaacatactcattgatgtttatccttctcaatcagttttaatacgaatccgcgctcggcaggaatcattttcattattgaatttaagctataattactttttacgagtgtgtgattaatttgataaaaagtaaatatttcatctgggttaactaatagcttaaacacatctactatatcagtgtatttttttacatacttattacaacacgacatatgtaatgttaaattaataggattcattgaatcgagaattttttctaatgtttctatctcgatggcgtcaacaagttctatttgacttgattcactaatttccttccaatcataccaagtttcatctacttggacagaatgaatattttcagtaatcatctttgctttattttcataaaactcagaaggaaactttaatttaattttaacattagctacatcaaaaacaggttcctttaattctttttggtatatttcaaatggaactgtcttttcttttttgcattttggacatacaaatgtgactggtactttagttttgcctattgaccctacaaatacctgcaaaaatataaatggttgccaagtctttggatagtctccaaaataatcagcaattaaatcagcaattacttctttttgttcttgtggtgaccgatgttctatatcgtttcgaactaacaaaaaatctcgataatcttctaccgtaaatggtttaaaacgatgaacaccatctggtaatttacaacgaataatgtttgccatagatgctccttttattctatttataaatatgataaataaaggagctaaatatgtatgaatataaatttgacgtgagagttggttctaaaataatcaactgtcgcgcattcacacttaaagaatatctagaacttattactgccaaaaataatggttccgtagaagaaattgttaaaaagctaatcaaagactgtacaaatgcaaaagatttaaaccgtcaagaatcagaactattactgattcatttatgggcgcattctcttggagaagttaatcacgaaaactcctggaagtgcacctgtggaactgaaataccaacccatataaatctattacatacacaaatagatgcaccagaagacctctggtatacactaggcgacattaaaattaagttccattaccctaaaatttttgatgataaaaatatagcccacatgatagtatcgtgtatagaaacgatacacgctaacggggaaagcattccagttgaagacttaaatgaaaaggaattggaagatttatattctatcatcacagagtcagatattgtagctataaaagatatgcttttaaagcctaccgtttatttggctgttccaattaagtgtccagagtgtggaaaaactcacgctcatgtaataagaggactcaaagaattctttgagctattgtaatggcaaatattaataagctttattctgacattgacccagaaatgaaaatggactgggacaaagacgtttccagatcgcttggattaaggtcaattaaaaatagccttttgggaattattacaacgagaaaaggttcaagaccgtttgaccctgaatttggatgtgatttatccgaccagctttttgagaatatgactcctcttactgctgacacggttgagcgtaacattgaaagcgcagtaagaaactacgagccgcgtattgacaaattagcagttaatgtgataccagtttatgatgattatactctgatagtagaaatacgcttttcggtcatcgataatcctgatgatattgagcagataaaactacaactggcttccagtaacagagtataatgcttcacgtataaacgtggtataatgaatctaagtccatccaataacaattgaatagagaacaacatgaaattagaagatcttcaagaagaattgaagaaagatgtgtttatagattcgactaaattacagtatgaagcagctaataatgtaatgttatatagtaaatggcttaataagcattcaagtattaaaaaggaaatgcttagaattgaagcacagaaaaaagttgctcttaaagctaaattagactactactcgggacgaggagatggtgatgaatttagtatggatcgctatgagaaatcagaaatgaagacagttctatcagctgataaggatgttttaaaggttgatacctcgttacagtattgggggattttattagatttctgtagcggagctcttgatgctatcaaatcacgaggatttgctattaagcatattcaagacatgcgggcatttgaggctggaaaataatgagatataatattgatgatgcttttaattatgaagaagaatttgaaactgagattcaatttttaatgaaaaagcataatctcaagcgtcaggatattcgtatcctggccgaccatccatgcggtgaagatgtcctttatattaaaggaaaatttgccggatatctcgatgaatatttttattctaaagatatgggcattgatatgcatatgagagttatataaatagatatataatttagaggagacaatcatgtcagataagatttgtgttgtctgtaaaactccaatcgattctgcattggttgttgaaacagacaaaggtcctgtacatcctgggccttgctataattacattaaagaactaccagtttcagaaagttcggaagaacaattaaatgaaacacaacttttgctatagtgtgacctttagtctatagttttggcccttccttttcggttgggccttttttaatttaaaagctttcttctacttcatcgtctgaatcttctaattcagctctttttcctgccaaagcatctctcacagagatgtcatcagtatcttttaattcagtttctttaactcttttcttataataagcttcaagttcttctaaaccttctattgtttgacaagaggcaattttacccataaattcatcaatagaagcttcataaagaaattgtttaaattctagtaacatctttttctccaaagggccgaagcccttataaattaactgttttcattacgtaattaaatttttcatctgcataacgctgaatacgatcaataccgtgttttaaaagatagttcaagtgaacatatttctttttagtattagcagattttggcttaacaccgcaatcatctatgaggtcccagactgttgctattgttttagaaccatgcttacgtaatacgcgacctattgtttgcaatacgataattttagatttaacaccatgtgctaaaacaacgtgatgaagatttttaactgaaatgccagtagaaaatacaccataactagctactataattattcctttaccattttcagctaaggttttcattatattgcgtgtttcagtatcaacttcccctgatacgtaataaactttatcgtattcatttttaattaaatcgaaaatagctttaccatgcgatacatgtttaaacatgacaaaagtgttttcatctttttgcgcaagcttaatagctaatttagcgatccatttatttcttttactgagcccagtaataatttttatttcttcttggtaagtttttccctttaatttagtagcgaactcatcaggataacgaagaaaaatactattaatttttagctcagttacttgtccatcttccattaatttagaagtcgttactggcttaaatatttcaccaaacattccaacatactgcatgatattggctttgccatcacgtaatgaacctgacaaaccaaatttaaacatgcaattgtttaaaccagatatgatagatgaaatactttttcctgtagcaagatggcattcatcattcatcatcataccaaattgcgagaaccattctttcggttgttttactacagtttgccatgtaccaacaacgactggtgcatcatttttatatttatcatcttttgatgctccaccaccgattttctttatcattgtatgactgaataaacgatagtcaacaaagtcatcagccatctgagttgttaaggcagttgttggaacaataataagaattttaccttcgtaattttccaaataataccgagcaagcaaagcctgaattaaagatttacctgcggatgttggaagattaagaattctacgacgattaactaatccttcgaacactgcatctttttgataccaatgcggttcaattcttttatttcctgaatagatttctaatttagaaagccattcatcaaaatcttttcttgacagttcttccttttcgttaatttgtggatcaatccaggctttatagccaaagttatcacagaactttttaatttgcccgactaatccaaatggaagaaggcgattataatctaaaagacggattcgtccatcccagtgaccatatttgtatttcggattaaaacgatacccttcagcttcaaagctaaagaaatcacggagttcatgaaatgtactttcttcacaatcaattctcacgtgactaaaatcataaaaatgtactttaatgtcagtcatgtctaaataccatgtaataaatatatctatatttatactgaggaaatattatgatagataaagattatattgcagagctgaaggctcttgatgataataaagaagctaaagctaaattagctgaatatgctgaacagtttggtataaaggtcaaaaagaataaatcttttgataatatcgttactgatattgaagaagccctccagaagctcgctagtgaacctatgccagagactgatgggttatctattaaagacttaattgatgctgctgatgccgcagagggattaaaatatgacgatgaagaagtcaatccagaagcagcacttctgattgattctccggttaaatctgacattaaaattgaagtagtagaaacggataaaattcctgaaaatactgatgttttgattgaagacactccttttgttgaagaaaagttcgaacaagctgtagctgagattattgaatctgaaaagccatctgtatttactcttccagaaaactttagtccgaatcttcagctgattggaaaaaatccaggattctgtactgttccttggtggatttatcaatggattgctgaaactcctgattggaaatctcatccaactagttttgaacatgcgtcggcacaccaaactttatttagcttaatttattacattaaccgcgacggatcagttctaattcgtgaaacacgcaattcttctttcgtaacattaaaataaggataacttatggcttttacagttgatataactcctaaaacaccgacaggggttattgatgaaaccaagcagtttactgctacacccagtggtcaaactggagatggacctattacatacgcttggactgtagacggtgctccacaggaagaaacgtcagcaacttttagttatgtactaaaaggacctgctggacaaaaaactattaaagtagttgcaacaaatccagttcctgacagtgaagctgaaacagctgaaattagtacaactattacagtcaaaaacaaaactcagacgactacattagctgtaactcccaatagtcctccagcaggagtaattggaacagctgttaaatttaccgctgctttggcttcgcagccatcaggtgcatctgctacgtatcaatggtacgttgacggttctcctgtaagcgaagcgactagcgctacattcaattacactcctaccacaagcggagttaaaaaaatcaagtgtgtagctcaagtaactgcaacaaattatgatgcgctgagcgttacttctaatgaagtgtcactaacagttaataagaagacacaaacaactacattggcagtaactcctgctagtccttcagctggagtaattggaaccccagttcaatttactgctgccttagcttctcaacctgctggagcgtctgctacgtatcaatggtatgtagatgattctcaagttggtggagaaactaactctacatttaattatactccaactacaaatggagtcaaaagaattaaatgcgtagcccaagtaactgctgatgattataatgcaaaagaagttacttccaatgaagtatcattaacagttaataagaagacaatgaatccacaggttacattgactcctccttctattagtgttcaacaagatgcttcggctacatttactgctaatgtgactgatgctccagaagaagcgcaaattacctattcatggaagaaagattcttctcctgtagaaggatcgactaatgtttatactgttgatacctcatctattggaagtcaaactattgaagttactgcagttgttactgcaaccgattatgatagtaaaacagttaaaacgacgggtcaagttcaggtaactgataaagttgctccagaaccagaaggtgaattgccttatgttcatcctcttccacatcgtacttcagcttacatctggtgcggttggtgggttatggatgaaatccaaaaaatgaccgaagaaggtaaagattggaaaactgaagaaccagatagtaaatactacctgcatcgttacactctccagaagatgatgaaagattatccagaagttgatgttcaagaatcacgcaatggatacatcattcataaaactgctttagaaactggtatcatctatagctatccataatcgtaggggcttcggcccctttcttcattttgaaagcacacaaaacacaatcagaaaacgatgtatataatggcaccaactcgataacatgagattgattatgagaactgaggttgtggtgtttactcttcatgagtctggaaagtcattcattgaaattgctcgtgaattgaacttacaggcgaaagaagtggctgtattatgggctcgagctatgactgctaagaataaatttgaaactcgagaaaaagttgtctatagaaaaagacacattaataaaaaggtgaaaaatggaacagtatgatctttatgaaaatgaatcttttgctaatcaattgcgagaaaaagcacttaaaagtaaacagtttaaactagagtgttttattaaagatttttcagaacttgctaataaagcagctgaacaaggtaaaacatattttagttattattgcactgctcgcgataaattgattactgaagaaattggtgattggctgagaaaagaaggatttagctttaaagtcaatagtgatcagcgtgatggtgattggttagaaattacattttgaggattaattatgtttaaaaagtatagcagtcttgaaaatcattacaattctaagtttattgaaaaactttatagcctgggattgactggtggtgaatgggtagcccgtgaaaagattcatggaacaaatttttcgttgattattgagcgtgataaagtaacttgcgctaaacgtactggtcctattcttcctgctgaagatttctttgggtatgaaattattttaaagaattacgctgattccattaaagcagtgcaagatattatggaaacttcagcggttgtatcttatcaagtctttggtgaattcgctgggcctggcattcagaagaatgtcgattatggtgataaagatttttatgtatttgacattattgttactacggaaagtggtgacgtgacttatgtcgatgattatatgatggaatcattctgtaatacattcaaatttaaaatggctccacttttaggtcgcggtaaatttgaagagcttattaaattgccaaatgatttagattctgtcgtccaagattataattttacagtagaccatgctggattagttgatgcaaataaatgcgtttggaatgccgaagcaaaaggtgaagtatttaccgctgaaggatatgtattgaaaccttgttatccttcttggatgcctaatggcaatcgtgtagccatcaaatgcaagaactctaaatttagtgaaaagaaaaagtctgataagcctattaaagctaaagttgagttgtcagaagctgataataaattgctgggaattttagcttgctacgttacactgaaccgagtaaataacgttatctctaaaattggtgaaattggtcctaaagattttggaaaggtgatgggactaactgttcaagatattttggaagaaacttctcgtgaaggtattactctgactcaagcagataatccttctttgattaaaaaggaattagttaaaatggtacaagatgtacttcgtccagcctggattgagttggtgagttaaataaaaagggaccgaaaggtccctttgttttattcatcaatgataatttttggtagcttaacacctaataaaacagacaaatcagaacgacccgccattttatccatgtctccgccatcaattattcttgcttctttttcatcttttgctacggtataaggatttgctgataaagcatatctaactaataaaccgatagatggttgcaagctttctggatcaacaacaactttaaatgcacctacatgttcagggtcatctaagtcaagaccttctgtatacggagcatagaaaattgaaccaacaatttctttttcaccgatattttctactacaccaacgattacatagtctaatgggctgttagtatcacaataaagcggtaaaccattagctaagaacccgtaggcattttgtgaaagatatttgtcatcttctggtttatgttttaaccaacctgatgcagcaagaatcgcagcagcacgagctgaagctacacagaatgttgctgtgtaagttgattctttttggatatgtgaaaccatttcgcataccattcggtataatgaacgacctgcttcaggagcagatgcataactcaaatcaataaatccagtatcagtaattcctgtaactttgtagcgttttgatactgtaatcaaagactgcagaatatctttattgatttcatctgccatttcagttgcaagcaaatcttccaagaaattaggagcatcgaatccatttgcttctaaatcttgtgctaattcaactgtgattccagttttaagtttacgagatttaacagcggtttgccatttattaatctggaatctagcatccgcaatttcgctatcggagctttcaaatttgcttgttggcgctgcatcagaaaatagacgaacctttaaaagaacgattgcaatctgaagagctaattctagatcgctttcttcaatatcagcaaacggtgtatcttctaatgctttataaacgatattattatatttgaataaatcgcctttattgagagttaatttagactcttctgataattctgtgatttgttctcggtctgcatacccggcttcgccagcgtaagtagcaccagttttaaatgtaaattcgttatctgggttaaggtatttgataccataaaaagcagcaacaggttgattagttctttgcgttgctacaatgtcagaatatattaatttagtggtagcgcgagtcaaagcaacgagatttgggcgaccgattgagttgctgttcgttgtggttgattcgcgcagaagttcgttgattttagccattgcgctttccttttggtttatatgatttatttataccataaaaacaactaaagggacccgaaggtcccttaaatcgtcaaagattagatacctttaacatatacacggcggaagtaagcgtttttaccaaggctattcagaatagaaggcataccgctctgaatgcgagaagccggagcctgagcagcggattctgcaaatgggttgataccgataccgtaacgagttttgaatcccattactggttggaagttcttcggatcggaaccacgcagcggagtcagagctacatatggagcgtagtaaataccagcatccatttcgttcggacctttataacctacggtgaaataatcctgtttagcatactggtcgatatatacacggtatttaccacccagaacaccagcaaatactgacttggtagtatcagtgttaaagccggtagccagaccttgtgcagcataagaaatgccggtatcaactgaagccagaacgttaactacgttacgggaagcgataatgaagttaccttcaccgcgaccggtttgacgagcaatttcaactgcttctttgtcaatctggaacaacagagctttaaaggattcacccgcccagcgagcaccacgaatatcaatcggatcctggaagtcaaatacaccagctttagaacccggagtcagggtcataccagatttaccaacctgtgcggagtagttaatccaatcaacaacttcacggttgatttccagcataatttctgtagccagaataccagacagttcagcatcagcatccataccgtgaacagcgcggaggtcctgtgctaattcgatagagtaagcagctttcagctggcgagatttagcttcgataacttgcttatcgatgcggaagcccatttcattccatgggttatcggtagaaccattgaaaccttcctgaagttcagcgatagaagtagccataccttcagcgatttctaccagtgcaccagcttccatttgtttcttgatttcagcatccaatttagctgcatcagttgcaccagcattgattgttacgacagaagaagcttgcagatatacagtaccagtttcctggaagaagtgggtatagatatcacctacaacagtagtagtactagcagccagagcagcgaatttcttagcagcaccctgaccagagaacattgcatctggaccatacattgggtggaatgcttctttagcaccggcagcgattgggtctttaccatataccgcgcggagtgcgaatacctgaccagttgggctgctcatcggttgaacaccgcaaatatcgaaagcaatcaggttaggaatagcacgacgtaccatacccataacagctgggccaatctgagttactgcgccagaagtctgacccgcagcgatgttagtagcgttgtaaccgtggtcaccgccgatttcagcttctgttaagaaagaaccaaatgcctgggcaattttttcgtctttatattccggagctgtctggaaatctttttcctggttttcaaagattttagcgataatcgcttgtttgctattagcaatttccggtaaaccttcaccttccagtaatggcttccatttgttcaaaagttcagctttagttttgatagtcatttgtgttaacctttaaaattagaaacgagatgcgactttcgcatatacacttacaatatcttctgcaccagatgcagatttatcttctacagcttcagtgacgaaattcagtccggctgcttcagtatcaggagtatttatactctcagtaatagtgctttcatctttattagatttcttcaccatttctacgatggcactcaatttacttgagaattcatctgaataattcataccttcgaccagagcagagactttttctttttgagactcagtcagatctttagtactttcgctcaatgccacttcacgctgcacataattgatatatgcgtcgcgcatattgagttcttcgaacagacgagctgattcttctttatgttcttgcagctcttcttccatttcagctacaacatcaactgattcttctggaacaacaacgttgtgttcaacaaagagctctttcaatccaccaagcatggattcaaacagttcggctttgatgcctttatctactgctaatttattttcagtgagccattcttttgcaagatggtcaaggaatttagaagcttgctcagcgattttcttctcagctttttcttctgcttcttctttatttttttctacttcttcttctgctttttcagcaattttagcgatatgagattcagctaatttaacggcgtgctgcttgacggtagcttcgaatacagtgccgaaagtttcttttgcttccggagaaatattaactgattcgaaaatactatcaagagcaacggaagcatcaattttctgcgcttcggcaatcagttgttctttaagcattttgtagtcctgttgtttagataataatatttataacgcttttttcatggcctctgcgagagccatataggcgtcatcggcacttgtatcggcttccgccgtctgtgattcggtaatttccttaggagttacccatgcatctggagcacttggaccccatactgcatcaacacctacagttaatttgaatccttcgtttacgatacgataacctttatttgtgtcagtcaatgaacctaatccacgagaagaaactcctggaatccatccggcacgaatattagctgctaatttatctccaggaccatggtcaccttcaataacacgagctcgtccgtatacgtcatttcctttccaccacatatcttctataatgatagcggcttgcatcgggtcaacattagcgcgtggaggatgatttaattctccgagagcttgtttagttaaaacttgctcattaatatagtcttttaccgctttttctaatatacgttttggataaagacgtttatttctattgacgacttctgcttgcatgaatattccttcgatgtataaaccaggttttaaacctaagtctttcccatcgtgggattcaagcattggtacaccatcaataatttcgccaggttgaccccaagtttcaattagcaattggggttcattcattagcttaatcctaatgctttacggcgtttgagagcttttttacgcttacgctgagcacgagattgacctgctggattggcaatcttcgttttggtagctttacgagcaatttgtctacgttttgctttagacaacccggtagtttgaaatgcattacgttcgcgggttttgcgatctttagtgcgagtaatttcaccacgggcagaaacatgtttaacgatgaattcatttaacggcatattttcattaatagaagctaatgcaatcgctaaatcggtttcatcatcaagcatattctcgataattgtatttatatcgtctttatttaaagcagaagacaactcgtcaaagcgaccctgtgcttcaggaataagtgcttcgacattctcgagaactaattcatgagtttcagggattagaatcattattcatcatcctcgtcttcgtcagagtctttgtcttttttgtcgtctttatcatcatcgctatcttcgtcgtcatcatcttcatcctcatcatcaggttcttcaccttcgattaagaaattacgagcgatagcgattttttcttctttaattaaatcagtcgttcttgcagccatggcttcagcaaataatttacgagcggctacgaggtcgtttgatttaatagcttcaattaaaccttccattaaaaatcctcttgttcttggtcggggtcttggaaacgagcctctttagactcttcttcaatttgcttggcttcttgttctatttcttcatcagtcatctgcaaaatatctttcatagcagttctgtgagaaatatatttaccaataaatggttctgccatggttagcatattaattcttcgttccaaaatttctgcttctttgagctcagcaaagtagctatcccgatgaaattctatcttaatattatttatttcatcattccactcatcttctgtgattatacctttaagcaaaagatttgttttaagcggatctaggaaaacttcttcaaacttatgctgcaactcgcgaataaatttagcaaacgttaattcatcacgtgtaatgctagttccagaatcaaacatcacaccaccttgctggtcttgcggaatgcgtgaaagaggaacacgtaatgccatataaagagcttgtctaaaccaacgaatatcttccatattaccggtattatcagcaccaggaagagtatcaacttctgtcacagctttaccatcacggcgctgtaaccaatagtcttcggtcatagacatattatgctgttgattttttattttacctgttgatgcatcatatactacacggtttttcatcgtgttcataacatgttgcatgtgctcggcagctttacgagcaggcatattacctgtgtctacataccacacacgacgatcaggagcacgagtaatacgataaatgactacagcatcttctaataattttaattggttagcaggtttaacagcacgatgtaaatacccgatgatatttttaccacagcaatcgactaatccagaatgggcataaacgacagcagctttaggaatttttatttttgtgccggcttcatacattctaccatcgcatgcatatgactcatgggcagtatcatatataaaatattctttgtaacctttaactatttttgtgccagcttcagtttcggttataatttcacgaacatactgaacttggcgagggtctaatctacgtaattcttttatgccttcttttggacgttttggatcaatgattttatggaagaaaattcttgaatcaacataccaacgtctaaaatgatcagaaccttttcgttgaaacgatagatgatttaatacatcactaaattcatctaacatcatatttttaatttttggactaaatttagatttatccaaatttaacgctacgacttcagtatcatcttcatagacgatagcatctgaaacgatttctgaaactgcattatctacttcatagttattcatgagattacgatatgtatcaataagctcacgagtagttttcattcctggttcatatgaaccgaaaatcgtttgaaacgcagcattataaggagaagcagcttcattcgagcttacttcaaattctcttgctccatcatcaagctttggggctgtaatggaaacaagatcttctttttcttggtctttaaaatttcgttcgtccattttagcccatggagcaaacaaacttaatacattaaatttcattgtattctccaaatgggaattatagttatatttataatggacttctctgcttaaagcaggatggggatttctccccattcattttattcccaataatcgagagcaagagttacttcaaatgtttggatttcgttatttgaatcccaatctaattgaagttcacccacgttagtaggccacaagcctttaatttcaatttcttttgttactgttttagcgtcacgagcatattggcgaacaatagcgctctttttatactctgcaggttttccaccagtaatttcgtttccttgtccagcagcaatgctttgccaatcaacgaacttctgacgagcatcatgagcttcatcattcattactgtaacagtccagtcatcgaatgtacgatcgcctgccacattaattttacggttcataaatccaactggaattttttctacaataccagctggtaaagcagtagctttacattggaacgtaaaattttggccaagataagaaatctctacttggaataagttaggtcgcgcaaaatcaccagattcaaacgctcgtgttacatcatctacaaacatattagcctctgtagtatttatatccctatgtttaacctagggcatatagaattaaagaattaaggatatagtgtatttatatggcctgccgaaacaggcctttagaatgcaccgtattaaccagcaagaccagttaactcatcgaaatctgcaccagtagcagttgctacgaagttcaaggtaatgtagttaatgcttctagccggttggatgtagaatgttgcaacaaactcatttctatcaattactgacggagtgttatttgttgtatcgcaaactacacgatattcataaattccgccaagagctttaattccttgcaggtactgagcagtttctgtacggaatgaagaacgagtaaatgcgttgttcaattcgaataaacgatattttgaactgcgtccgatattcgttttcaacatattaaacagacggcgaacgttaatacggtcaaacggagaaggaacagaagtagctgttttatcaccatacaatacgtaaccatcaccaccggtaccagttacagggttaatagcttcttgatataagcggtcacgctgagcttgacgagtttcaatagcaagtttaataacgttcagaatttgaccacggttataaccagctggtgacatccaagtttgagaaacattatcagttcttgcgcacaatccagcaatatcagctgctaatggaacccaacgattcacatcattatatttgtcatactgatatttgtagttaccatcaattgctgcataggttgaactaatattaaagttattatcagtatatgaacctgcggcagttctccagttaactaaattatctactgcacgagttacaggaattccaactacagtttcacgcggaggagagcacaatactaagcaatcttgacgagcatcaccaattgaaacgacgtgtttttggacagtagatgctgtttcaagagattcaccggcacaagaaccagcaataaacaactgaacatctacagattcacggtcagcaaagaagtcccatgcttccatcaaatctcctgctgttacttcagcatttgatgataacccaccagacagagttaaaattccagagaatccttctggccagttttgtgcagttgcaaaaatatattctgaaccaccttttgcgaaaaagtcatcgatatagatgttactatcgtaaatatctttttcaccgcgcttagttgaaagaacaatgctttgaacaatagcatcatttcgacgaactataatagcgtactgtgagtcagtctgcggtccatatccaaacactgccttggcagtagatgcacgagtaccaccacctggataaattgggagtaatgcagaagcgcctttcgcgtagtcagctttagatacgatttcgatttcgattttatcgcctaattcgcctggataaagagctactactcctggaattccatattttttaagatttgtctgaaaatcaacagctgttatagcagcttcagcattttcaatttcagctaataaaataccagaatcagtaataatttttccaagagttattactgcagctaaaccagaggaagatgaagaaacttcagcggtccagttagaacctaattccggatattcaccgacttctttcgctttagcgataatttttgcagtaggaatactaattttcttgatttttccatcagcatctacttcggtgattttaccttctgtttcaacatcttctgaaacatacttgacactgattttatctccaactgcgtagttactacctggggtagaaatcgtgtattcaatattaccagcaatcggagatgagtttttggcggtatctctatcgacagcacgaacgactcgtaagtcatttccgtactgcaagaaattcatcgcagacataaagtaatcagctgtttcagccgtaggttgaccaaaagtgttaactaaatctacttcgtttgtaacctgtttaatttgaaaagcaggaccccactggaatttaccggccaaagctgctgtaccagtagagttattaaccacggtgctttgaaccgtagtttctttgagctcaatgcccggagataataaagtcatttttaatcctctttaatatgctttaatatatttataccattgacataccatgagatactggaacatactcagcagaatgaaccgaatcaacaaatataactggagcgtattcatcacccatatcttggagttcttttgaaaacacctcagatgctaatcgcatgtcatctttgtcagcataatcaataaattttgattgtgttgataaccatccaaaaatcactaaagacattactaaatcatcatgataaccttcttcagccgcccaagacacgcctttttcactaaacgttctaaactcttgaatagttgcacggtgatgaataataagcttatctttttcaataaggtcttttaatgtagagcatcctactgctttagttcgtttagtttgtttcattcctaaatcagtatatgaatcgcaaataacgccttcgtattctaaatccatataaagcgatttagcaactgacacaccagtactatttaattcaatataaactgggcattcattatattctactaaataacgcataacgatgtcaggtagaattaaatgagaaatagtgtttgagtgtaaaacaccaacttgttcccacacatcatcagtgacatcaattatatgtaaagcatgatagtcttgaccgcgtccttctgaacaatctagagttgcaatatattttctatccggttcaggttttttaaattgatgaaaaccatgatcatctggagttacttcaatgaaatccataacagctaatttcattcctgagattaatgtaccagaagtcccttcaaacgctgcagtgtgttcttgacggaattgagctaatgaagaaccattaatagtttgtatactccattgccatccatcgtcaaaaatatcttcatcgttataaagacgttctttaactgagttccaaatagcagtatatggttcaaatccagatttaccttcaacagctgcagtccaaatatcataaaaatggtttaaaccattcggagttgtagtaatgataattttagaacgacgaccagatgaaattactggttgaatagcaagccaagaatcatggaaatttggaataaatgcgcattcgtcaatataaatcattgcgaacgagttaccacgaactgcgtcaggagatgaagcataagctccaattgaagaaccattatcaagttcaatagaccctttattccattcaacgattcctggctgcaaaaagtcaggaagcaattcaattgcttgcttagtacgatctaaaacttccgcagacattgagcctttgtgtgcaagaatacctacagctttatccttgttaaaacatacaaagtgcgcaaggaaaatagctactaccgtagttttacctaactggcgcgatagattacaaacagtcatacgtttagatgacattattttgagcatatcacgctgatagtcacgtaattgaacctttatgacaccatagtcaatatgagtaatggcgcagtatgtttctgcaaaataaacaatatcgtctcgacattttttccattcctcaaccatttcacgagtccattgtgttttaatattagctcgtttcaagttaggaagacccatataccgagatcttttattattcttatctttataagtttgaaataattcaggcttatctgagttatttggaatttttactattttgtgtaaacgaagataatcactgaatttttcaggataccattttccatcccactgagattttatccaatgaattccatcttcatcttttctttctgctaagcttgggtgttttattaaaatttttccagcttcatttaatggatggaaatcatttaatgcattaatcggttgttccatttatcaccttctcacgagcttcttgagcctcgtaagcatcaccaatttcgtccattaattctgtcggtgaacccatgaatactgtcgcattctgaatattcatttgaccggtaggagcagcacctttagtgccaacctgctcagatgtaatatctttcatatctttatgaagcttcagtatttctctattcgtcgtagtcatttgccccataagagttgcaaatacttccatgtgacgaggagaatcagcgttctttgctgtctcaagaaaaatcttggccgcgtccataagcatttgttgctgaaaatgcatatttcgacgaactactccataatcatcttctaagtcaggagtacggttttgaggattgcttttaacttctactaactgcagaggttcatatactttaatttcctccccgtcgattccggggaggtcagaaatatctaaaagtttgtttatatcaagaccttccataataacctctatgttcttgggccaggaggttctggcggtgttggtctatttacattactagtgaaagtttgttttactgttccatcccagtcttctgggtcaatatctcgaggaacaacttcattatcaacagattcaaaaacaccttcgccattgggtaaatctctggtgttagcatgaaaatctgtataagtagtacgaattaatccttctgcatcatctactggaggatacatccagccatttacttcaaatgttaatgaccattcaattcgacgacgagataaattgtccccatctatagtttcatctatagcagcagacatcagtacaattttgatatcccttttaaatggaatatcatttccaaattgttcatacattgtcgtattaaaatgaggctgaaaatacggaagaatctgttcaactatttgaaacatatcatcttcatagcgagtaaaaatactcaattcataaatcattttaataggagatggattatactgtgatactacagaagttgcgcctttttgcagtaaattctgatttaaaatgttagttttaaatggagcgttatagctaaaatcaactaaatgcaaatttatacgaggtagaatagtttcaaccttggccacgtcttcttgtgaatttattgatgtccatttatttaatttcatcataaagtgttcctttgatgcatatgtaataggaacacgtataaacttatcaccagattctaactgacgcttgatttggatatttgaaaacaaatcgcccatcaaggtagcatatcgtctaaaagacgaattataaaaataaccaaacatgatttctcctaatctgggctttaattagtttataatatttattaatccatgaaatcattatcaaatgggctagattcgaaagatttgcctctgttattgacaacaacataaggttcaacatattctttagcttcagaattaatttgatctacttcagaatactgatcaatattaatatcatgaataccattaagattgcggacaggatttaattctaattcactaaattctggaatgttaattccttcatttttctgcagaactggattaatttcttctccagagtaaatgaatttacctgctgtaattttacgaatagcattttggcctaattgataaaatggatcatatggttcaacccagttaatttcaaataagctgttatccataggaaaatatatcaaatcgccttctttcggttcttgcccatttacttggtgtttaaacaagtttggattgattgacagagtaacttcatcttgtacttgcataccaaagttactaaagaacgatttagctccttcatatccttcaaatgaatttaaatatgcagcaaatttccaagctttagtaaatttattttttaagtcttcgccgaatatcaaatcaggggaaacatactctcttggaacataatagcattctacgcctctcatttgaatgctttcagctactaatacatcagctaatatttggctgtttttataatgattgaaatttacataaggatttagtatttcagtttcattggtctgagaataacctgtgtggttttctaatttagcaaagagatttttatcgtaagtagccatattaacctaccaaaattccaaatggagggtcaagtaagtataattcttcgcgcaatgcttctttttctaaacgagcttcttctattaaacgttgaccatcaattgtaacaccgccaggaagcatcattccttggtgacgtgctaaaatttgaccattcagttctttagctaaagctgttgcataatctttcacccaacggttattataagcaccttgcttaacattagggtcctgaccaactacacgaccgaccaaattatggtctgggttattatatcgttcagataatgaccagctatcttgtggaccaactgttccatatcctactgtatttccaaccattttgtttgtatcaatatatgatttagtccagctttctacgataattaaatcatatttttggaagtttcccatgactttgagttgttcatttgctgaattaaaccaaaagtctggaataggagagagcatatcttgcatcattcccatataactggtaagctgagtaaaataccccaaatcagctccaaaggcgttcggtccataaaatctattgcaagaggtccccataccaccattaataccagccattcctaaaagaaagtcagtaaaccatggatatgtagcgttaccgtccattgacgttattgatccaatattcgtgcgtaaaatgcgggttactgcgaatacatttgaacctcttaaatcaaagactccagtcttatacttttcttcatcgtcccctacataaaatacatgaaaacctttgttaagtccatcaaaatggtattcaccgtataattctagggcacgctggatacaatcgtaaatttgatcgggtgttaactcaacattaataattggagcccctaaacgtcttagaatgacatctttgagttcctttggattctgagaattatatcctgacatttaaaatcctttggggccttgcggcccatgttatgctggtgataaaaaggtagaaagcaatacccattcgccgtctttacgaacgtaagcttgcccatcttttggagcttcaggaatataaccagcttcctgtaaagtctggacatccctctgtaatgaggacacattacctttaatactacgaatctcttgattaattgaagaaatgttagtctcattagcttttattgaattagtcaatccgcgttcttcgacagttgaaccatttggatttgttccatttactaatttatttagtgttacaacctgtcctttaattccggaattgttattaccaatttcaacatgtaagttttgaacatcattgttaagtctattaacagaggtttcaacagttgaaaccctatttaaaagagacccgggaggagaaggttgacctccactagaatcagttccaactatctgatttagccatgaaacgttagctcttaaaccagacgaggtgttttcacctacaattccatttaaaaattcaatagaagtagtgttatctttaatttgacctttaatactagaaggaatatcatctgaaccaatcgatgtttcaataacagttaatcgttgtttaataccgccacttttattcagttcatcatttaaagctgaaatttcttgactattggtattgacatctgtgattattgaagtatttcctggatatccaatagaagtttttataaatttaatttcagaatttagaccaagcacagattgatctaaattatatacacgtgaatatatgctttcactaaatgaaggtggtctttgtcccagttcctgtctaagatttcctacttctattgtaagcgaacctacatcagattcaataaatttttcttctaaatcgcttaaacgtatcccttgggaagttatagcatctgtattattaatgatgcggtgcttcattcccgtactagtatttcctacaacaggaagaccattaatgtcttgcccagcatattgtcctaattcccttttaatccataacaaatcatttctaatcgttctataaactgaatttgcttgcgaattaaatggaccaatatcagaaagaatattatcaaccgtagtatttgtaccatttaatatatcagtatgttcattcgtgagtgtctttaaatttgatatatcatttttattaatgctgatctgtgatagcgcttctatatctcctgatacatctaaaatgccttgaatggttttaatatcttcctgagatgtttcaatggcagttttaagaattcctacattttcgtcgagaacctcgacatttttaaatacggaaacagttggtctattcattgatccatcgtttccatacttagtactagctcctagtatttcttcaccatttttaatccatgaaatacgctcctgaccttcgccaggaacgctatcaacaaaaggtaactcttttaattcaatcatttgtaatccttagtaatgaattttaataatatagtttaatgatatattccatggtctagtttcatagccaattaatccttcgcgattaagtgtaccaagggcatctctcggtccgcctaattcaaatccatcattagtgaagtatgaagcattatcccagtcggcatattttctagttccaagatatccttgataaacagatgcgccaaatggagcttcatgtctttggtattctccccaaccaccagcatgtttatggtatgacatctgctgtgcttgaacaccaccaacgtgcattccatcacatcctacaccaagtctatccttcccataaccatcttgtcctcgttgatttaaaatgtgaccaccagtacccgctcctctgacgaaaagacctcgcatatcaggaataccaggattattccaatcgccgccaaatctcgttccgaccgtgtttctataatcgggatattgatctcctgacacggttccaccatgacacataatccaaccaggaggagctgaatctccggcaaacatcataatagttccaactggaactctttcggacgcatatctttcagtagcaacaggttgatcgccatttttccacataccaccgcgtgaccaaattccatttgctgtaagatggtctaaatttaaagaaccgttaatagtttgtccaccgcgagtattaattacatctgcgttccatgctaatgctccagagccatcaccctcgggggcaataccggcttgcgtcgttaattttactacaccgcgcatagaaccagtagctcctcgaccatttaatgtttcgcctgttactgcaacatctcccaaattactgttaatttctgactgcgttcctaaacgtataacacccttatattcttgtgttgcaacagaattcataaaggtatatggggaaattgcatatccttcgcgaagagttccttgacgagtttgagcgacagttgataactgaactacacctctaacagattctgatgcagtatcttcggaaggagctatttgtgaaattaattttattgcaagtttttgggtttttagtggagtcatcgctgtcgtatcatcaactccagccaaagctgcgggtgttgatgatattttaataactccatttgatgattcagatgaatacctgttttggaatacatcgtcagtatggtattttaatttttgtggagttattgatgaattattatctgagccttctaaagtttcttcatttgttgaatagcgtgttaaaccatatttagtttcagtagcatttggatacaataatcttgttgctaatgtagctggtgtaacgattttagaattattagttccatctaaaacctcttgctctgacgcaatcattgctattcctttaacttccatagttgcatcaggaataccatttacgccaatattacttatttttgataatgcagactgcactgtcgtaacagtgtcaggaaaattcgatccagtaggatcgaatttaacatattttgattcatttgatacgtgctgatatgtattgttactcatgctattctctcaaaataataaaatactgtaggttgtgtgtgactatctagcgtaacagtttgcgcacccaataattgccaagttccatatccaggtttagaaggagaaattatttcttgtttgaaagtaattcctttatcagagtattgttctaagatatgttcttggttatctaaatacttaacttgtattttatttcctatggtaggatggtcttcaaatgaatcaattgcaataaattttgcaaccatttcctgtagagctgttctaacggcgctggtaaattcaattgaagtcattccgttagtagctttaactggaataccaaacatattaacaataactgggtcacctggtttgactgaagtatcagtaacagttccttcaaatgaccaatagtcggtttgttgcacgccagtgggagatacgccgcttatattaactaatacagctccaacctgttgctctgccatatttctaacatcattgatagcagattctacatttgggtcataaaaaccttttgctatttgtgaaattgttacagcgcctaccggctgattattcataactgaaatatcatttttcttagttctaaaaccaagaaaatctgctaagcgggaaataactcccgctttattattaagtaaactcattatgcaatccttatccaacggtatacagtaatagacggttgaatattactaatattagcaggaggagtatgtgaagagtttgttgttgcgtagtcttcacggtattttgtatatataggaccagtttcgtctgggtcatattgacaacctccaataataactgatccgttttcatcttcaattaaaactttttcatcagttttagtcgcaggaagatttgcgttctcaagtgtcactgatgttgttccaactgttccaccggcagtatgcgaaggatttccgctagaatctaaatcattgttatttaatgcaaagtttggatccgtaacatcatcattccatcctactaaaacttgtcctttaccaaataatttccatgagccaaatcccatataagttactggattatttgggtttacagcattttcataaattgaaccaataggataaatgctatcgaaaatagatgatattgaattatacgttctagtataagaatcaactttttcaacatttggccaaccgattttatcaaaatcagttaaggctacatcaccagtaacttcagtagatgatcctttgctaacataacgttcatcagttaattcaataatgtcatctttttccaaaagagttcccaaatcattattgaaccatgttataacgattatatcacctgattcaaattttctatcaaataaaagactgatcggttttccatcttcatactctatagaataatctgtgtttgattctttccattcaccgccaagagatatacatcctgcttgcgtatctgaattagcaccttcacacaaaaacagaggatatccggctgttccagcttgttgttgtaaaattccattaaaacgaacttcaagagaattaggattaataggttctccaggaattaatccaaatgcagagaatggaattgatttcattgttgataaatcagtaacgtaaatacttccttctaaagaagtttttgacgttaattttgaatctaatacttttatttggcgtcttgtatatgaacttctccattgtgatacaccatccataaatgtttcaatttgaacagtgtcaccaatattacaaggctgtcttaatctaatattaaatccatcaagaggaaccaattctccttcattttcccctggagagccaaagtcgctgttttcactaaaaacatcgccgtaatacaattcattaccgcgatgttttactctgatgttattaacattataactagttccacggaaaatatctaaaaagtctgtttgtccttgaacttcgactaaaaattctttacgagctacattgctaatgtctgaactaataattttgtcaatttgcttatttttgacatattcccaacgacccggagcacaataaactagctctaaatcactaaattgaacgttgatttcaaccgatgacgacgatcctttaatagtatcaccagaagcggctactaaagtaactggattaacattccatgttgcaaatacatccctggctctaattactttattataatcattaacagttcctttaggaagttgcagtgttactcttccagacgaagtattaatagcgtatgattttccccactcagcttttagcgtttgcccagatgaagcattataagttttccaggcaccggctgaatatggaacatctccatcaccgagctcgtaataaagctcatcaaagttttcatttatttttataccacctttacgcaggtagtcaccggtaccatcatctacaacattaccgatattaatattttgtttcattattgtgccaccccgattttctgcgtagcgataactttaactgctgctctcataccgacagtagaagaacttatagtcgccgttacataattttctttaatactaaatgcaatattagcgatttcgtcttcttctgtttcattcccaacacgcatgacagcatactcagaagaaataacttctgaattaacagtatccacaagaatatttatttctgccgttttaatttttcttccatctaccgattggcatgtaactaacaatttagccatattgtattcagtgcgatgaaataatggaatgtcaactgatccagatgtagaaatattccatgtaccttcagctggtgattccttttgcccaaacatgctttcaatagaataattccaaactgaagttgaattatcagatgaaatacaacgtaaagtaactttactatatggagtagttactactaaattacctgaaacacctttaattgaatcaatagcctgaatcgttaaaggattagtaactgatattgatccgttagagttaatgaattcaacacaatcgccgagttctcctctttcaataataacttttacgcctacggtagatgtatcaatatcatgtctagtaccaacttttactggagttgcatactctgcaatagagtgtttttgataatatccagtagcatggataatttgaccatctgctccagtgccatttgctactgccattttacgctgatcgccaaatgcattataaattgcgttaaaatcactattaattttattaccaccgtcgaataggatatcaccagtagaagcgttaccaatttcgccggtatcaatcaatttctttggttcttgaatgaacatagcggtttccttatgagttttatagtatttataaagaaaaagggagcccatgggctccctcaatttaaaatgtaaacagaatattaatttcttctgtttgatccattgccataataataggtggcctattttccatataaatcatttcgccagaatgcctcattaaatcttccggatcataatagtccttttcagctttaacgtttggatcatttggatgaactttagcttcaaaaggatttgtaattatcgatatttgtctaaaccctttatttcctggcagtgcagcttcaggaaaataaactgagtctaaatatgctttaaaacgaatcgtattagctttaacacgataaattagtccaaaatcatcttgctgccaagtgagattatcttcgtatccccatctagtcgggtcttcttttaattcctcaggccaaggaactacgatatactcattcgtacatctatttatagatacatctggtggaatctcaaaaagatattcccacacatatccgtcaccgggttcaattgttccttcggcatctcctcgaccttcaggaggagtcattgacctaacagaaggtgtccattttccgcctaatttaagacattcgtccttattagttaaagatgatattgagcacattcctgtatcaggaacatctaaacagcgatacactaaccaacccgcgcctgattcagtagcgttataaggagctgagttacacactacaatatcattaattctaaacgtgtatggatccggatatctagtatctccccaatctcgacgaggaataactgcatcaagcatagatggaagaacctttacagttcccatcatatgcgtccacatatcagttacacctaatacagaatcggttggataaggtggggcaaatcccacctcattttcgtttgatgaccacggttctgatcttccaaatgtgataaagatggtgtttttatccggaccacttccaattgaattataaaaattcaacattttttctgttctaaattttgaagtaactatcgcacgatagataacacttgaatcattcatctattttaacctgtgttggattttcagggtctcttggatttcctatattatcttttagacgtttattaactaaatctctaaattgcgcaaatgttgttccagatgcgtcaaatagagggctcattaatttacgtcgttcagacggcaattgaccttgaaatattgaattattattttcagcattatagtcatcaggaagaggatattttataccagacatcggaccaggttcataaattgcttcacccgttaccgaatcatgttcaatttcaccggtaggagtcaatttagctatacggtctgcgtattcagtaggtaatccagaatcccatttgtagtttttatatttattaattattgtctctgtgtgtttaagagttaaaccgacattaataaacatagttaaaagtgtaattgctataaatccaaatcctactgggtgaacaaaacgaataacgtcagatttccagcgggaagaaggtaaattggatttaattttcattacataatatgatcgacttctattaatatagtctatattattttgaagcaaatcctttcctttaacaccacgaataatttcgccttcaaaacctggaagtctttctgctttaacttcttgtcctgctattaaacgccccaaaagattatgtatagtcacagtccattgcaatttaccattagaataacttctttctatataagtaacattgcatcttccggttgcagtatagatagtctgtcctactaaatcttctgtaagagaatcagattgaatgattacatcatattcagtacctgctcccgattcaatttcaatttcaacttcttcattataaagaactttaaaaagaaatttgtatgatgcttcaattcctttagtagaataaaaatcataactacgtgattcaaagaatcttgcaacagcatcacgtttatcagcatttaaataaatgtttcttttatatatctctgaccacaaatattcccatgcatgctcttctcgtggatactgattacgaataagatttcgtaaattattatactgagttccgtatccatcagaaagatattgaatatatgcttcgcaaaatgcctcaaaattcgaatcctgtaacaaataagaatcaggcatcattgtgccaatcaatggtcttaaatctggatcagctaatccatgctcttcttccggtgaccaaggagtttcacgctcttggttctgtaaaaacgcttttaaaaataccccagttggtttccaaataatttctaccgtatctctcacacgatagttaaaatcataataagaaattatttcaccagaggctttataaaaaagcatcccagatgcatattttttaaatccagtgaatttaacatttggcattactatagtgcaatcgccattatcccagtattcatgtactaatctatctggtgatgtttctggaatattttctataactttggtgtattttaaatccgcataaactactacagctctatcagagttgtttatccaacaacgcgtgttagattttttagaccagttaaagaatggttctgcgtagtatttcatcggttgaggagtaaaagtctcccaatcagatttttcatccgctataaacgccatcatatgataatgtttatcagctaaccattcgcgaggaaattcatatttaacagcaccgattaactgatattttgatgcagtttcagggtcattgactatgctatcacttaaaaatttaaaattactcgaagacagagaaattaatttgccgtcagttgacatattcgcatacccaggttgaatacgtcttctttcttcttcggtattaccaaaaactcttttccatgttttcgtatcatgatttaaaacatatattcctttatcaacagaatcaattatttttgatgttctcggattggcatttaatgtttcaacttcgccaataataagagcaaaaaccttatcaccgatagaatccattttatagcatactgctttaggatttccagttatagtcattgtgtcaggttcaaaaagcctttccgagtatgttggtgataacgggtcagaatctatgggtgcattactcgtttttatatatctaactttatctctggcaacaacatagatataatcatccgtgcaagtaatagcctcagctatacggtatacattcgctggtaaagtagcataagtagcgaagatttctacatcgaatcctaaatgaagttggtctcctaatttagcaaatgttatatcctgtgaactgaatctgacatcatctgctgaccatctaacgtcagtcgatttacggccgtagaagaccttgtcgtatcctagaacgtatgttgtgtttgcagattggtaatatacagtcttagataaaggatatcctacacggtcattgaagagctttacagctttccaggtttgtcctttatcattagatactttaactacgggttgatagcgctcaaaaagatatagaataccttccgattccatcaaataaactcggttaatatccttacatacttgctgaatagaaccttgtatttcatgatactcattttcaccaataataaaattactgattgatgagacatcaacatacgatgggctgaattggaacgattcattcatcaatgcagccattatggtgtcattattaaaattaacatagtcagaattattaagagtgaacttttcctgaatgaatttattggctaattgcatttcaatcatattttgaaatgtgtaagcattcgtagcaaaagtttcaaattcttcggtataaatccagtcagactgctcaaaatcttgagccgccgtagctactctaataacatatgatgtcagtggatcagcatcatcaaaaaagaaactattatttgctgtatatcctaaattaatccaacgatattgatcactcgggagattttctcccgagtctgtttttgtctcagcgatttctacaaaatagtagaaattagcaccaacgtcatcccagcgtacttgcacctgatttgcggataacttggaaattctgagactagtgactgaaggtgcttttactgtcattgtgatataggctccaaatcgatagttaagtattgtggacgtaagtcattttcaaatacaatcagtgaaccatcgcgagtaaagataacatcatcggttgggtcagaatataattcaatagtctgaacttcaaatttttcagatgttaaattaattttagcgatattccaataaatcacatcagctggatagtttatttcaccgataacatagtatttgtcacgtcctgtggagtttgctaatttgttaaaatcatttcctgtgtatggctgaatattttcattttctgtaacatcgccagaagcaaatggaccgataataactttaccaattcctttagaatctcggtctgttgatactatacgaacatcgtataatacatcttcttctaaaccagtatcaggatttacaacttttcgtccagaattaaatgaaaacgtattagattccatagaacggtcttttatttgattattgtatttaataccagcttcaggcgttttatagaagttttgtacttcacgaaccatttgaatagtcgctgatgaaccaatgatagaatgatctgcatcatctacataagttaacatcttagacttggcaaaagatgagttaaaaatttctacgtcttcagtataatagcgatcaattttatcaattatttgaccttcaagccactgttcggattcttgcagcttatttaaagcatatgtgacttttaaattagtcttaataaaaagataattaggagaaataattgatggtgtaataggtgctaaattataatctttgagataatttttaatatcttcacgctgtacagtagttaaatacagtcctgattttggtttagcagcaataaatgcataaccaggtttagtagaatcagtgaaagtctggacagcttgaataatagaaccaaatctttctgagacaaatgtatcataatctgtcgcagttacgcaacgctgctgggtttcacgcttaatagtacccaattcacgaatacgttcaatatcttctggatcaccaccgccatcagcaccaacaaaatctgggtcatcatttggattttcattaatattgatgacagttatatttgtcaatgtatctgcatatgaaaatccgactgcaccattcgcatctgcaccattagtactgatatattcaataacgatagttgagttctgagtaggtttaagacctccaatatagttagcagttagagctccttctgccgcattaacggaaatctcaccttcaccaaaataaaattcagtatttccatcaatagtttcacgcatgtagtaaattgttgatgtagaaccagcatgaaccatcgattttctcgtccagttaatccattcagctccatcaacatataatttaacttggtttctatcaatatttttatcataaatgataataggtgtcaatttatcataaatgatttcagttcttactatacgtccttgagcaagttttaaacgtggaaaatattggttatttttatcacgaatagcaataacatcttcagtagatacaaagttgtaaggattaactgaagtgtcttttgcatatgctaaaaagcgagtaccacgaggaatagtaatgtaatttctattcaatgcgtctgtacacgttaacataatttcggtctgtgcagctgattttgaagtaggtaaatatccattatcttgcgcagcttgaacaactgaacttcgcaagttagcagtacgcatgaagctttcatacacagcagcattaccgaactgctgaatgtataatgtattataagccaaaaggtcacacagaacgtttaatcttgagccttcaaaatcataatccaaaaattcattttggccattaagccattcaatgaggttttgttttatttcagcaaatgtacccccgacgaatatctcgggaatagcatttgctgttcttgttaattgataatttacaggggtatttgccattttaaatcctatttaatgaatactttagatgatgcctgagccacagtatcgccgcatgatattggatcagccatttgaacagctttctttcccgtgacatataccttagatgttctaggttgtgtcactccgccatgtgtttcatatggctttttaatttctgtatgttctgtaattggatcgcctgctactagaacagcaattcctccagtgaatactttactttgcgtagcattcacaactgttggaggccatgcttcatgaccagcagtaacgcacttatcataacttaatcctgacatttatggcctctcatagacataacttcttaatttattagcccaacgactccaatttccaactatagttttagtataatttttaacaagagtttttcttactggagcaggagggtctgttggttcagtagtatcagaagatgacctagaattactgccagaacctccagattcactttgttcttgatagtcatatattaatgttacttcatatgtgaatgtcttctggaggttttggggagctttccataaatacaactgagtattagaatcagttggaagttcttcccatgaagaagcagttttaaattcatcgcctaaacgatattttaatgcgtcacttccaaaaccaaatacagattcatacgttccatataagcggttttcttctactgaaactcccggagtttcttcgtaactagttatatttatagatactaacgtttcacctgtttctaattgagcagtaaaggtgacgtcgatagaagaaccttccatggattcccctaaatcagtgctcattggaattatattagccaatgtcaatcctcgatccatcaattgtgtattgaccagatgaaatagaactcatagatgccattttttctgtccaatcgccaccaacatcccaatcaactgtcccagcaactttccaagaaagatttccatttactgtattagtttgatttccttcaactaaagtagtagcatctcctttaactgtaatgtcagcattaccttcaactacaatagtaacattacctttaactaggatagttccattaccttcaaccgtcttagtttcatcgccacgcacaaatattgtgttgcttccatctatttggtgaagacgattgtccatgttgtaataaatttctgaaccgccgacgttagtctttttatcaccggctaccaaaaagttaccatcagcatttgttatgtcatacaaattatcaacagtttttcttgttcttcttcctgacggtgatacttcttcataagttccagttggatgaactaatctatatcgttcttgcccgggagtatcatcaaattcttggatatggccgctttcagtttccattgtatgcacataagggtattcacctttatacgaagaaactggttctttgaataaaattctcgagtcatttggaataggagggtcagctggatcagaagacttcgccacagtagcagccattgccgacaaagacctagctggagttttaacttcaataccgtatgattccaaatttcccgtaagaataatcatagtaacacgggatgcacgaccctttgtttgttgataccacaatgaatcacgaccggctttgtatgctttttcccaatcccctgctaacatggcagttagcattgtgttaaatttagccacaccgccaacacccatttggaatgccatattttctaatgccatttggcgagaacggttgacagctttccagaccggtcctactttagaatgtgatttaatgtcgcgttgcatatcagccaaatcacgttcaaataaagttaccgcttcttccattgtaatggaaccaggatttccagtaatttcacgaccaacttgttttgataaaactttattaatttgagccatatcacgaactggttgcttcatgataagatgaccaataccaattgttggatatccttcagtatcccagtaaacttttagtcttaatccttcatcacggcgaagcatttcagccattgacatatttggattatcatcagttggaatatctgatagtggtctatcatctggatttattgcagtgtctaagttgctatcttgaataatgttagaagaggaatcatatcctacttctccaccttggtttaatacgtttgtatcatttcctaaacgtctaggatactgtccagttggatcagaaaatccttcaagtctattaggtttctcacgaactattccaccatacgtgccaaggacaattccgttagttttccatttgtctaaaaaatgaccataaactctagttccttctactggtccagtaacagaacctccaattccagacatagctgccgaagttataggttgaataactgacatccatggtaatttatcggttggaatacccattacatcaccttgcgctcgttggggcggatgcaaaccaactacacgaacacgaacacggcctaatttcaatgggtccattctatcttcaacaacaccaacaaaccaattaaggttattacttatcatttccataagatttctccattatacgtataaggtcgttcataaatgaattgatgtccgattttgctattatttttatttgacgaagtttttcattttcaagaacagcagcttcatacgtatcgaccgcagcaagcgctccttcatattgaggatattttctagctttatcacctttatcataccaaacatatggattatcatcatatgatactaaattataaaatttttcaccattctcattcacatggtatactatttggtctccacctacatttttgtatttttgtatagatgcttgataagcagcttcctgcgaagtaatccatccataatatgggtcataattatcattacacatcaataaaacccaatacagctgtggatttccatatatagcatttgctaattcttccgggcgtggtgaacctttaatataataagtacgtaagcgatatcctgcaagagcacgcttaaaatagtctttatagtttctaaaaatatctgtcataggaatagtcggcgcgtttttattcaccgttttggccgcatattcaatcggatcaaaaaatgtaaagagcatgggccctcctgtttataaatatattatctatttataaggagaatccaatggcatattctggaaaatgggttcctaaaaatatatcaaaatatagaggtgaccctaaaaaaattacgtatagatcaaattgggaaaaattcttttttgaatggttagataaaaatccagaaattattgcgtggggtagtgaaacagcagtaattccttatttttgtaatgcagaagggaaaaaacgtagatacttcatggatatttggatgaaagattcttctggacaagaattttttattgaaataaaacctaaaaaagaaacacaaccaccagttaaaccagcacatctaacaactgcagcgaagaaaagatttatgaatgaaatttatacatattctgtaaacactgacaaatggaaagcagcacaatcgttagctgaaaagcgtggaataaaatttagaattctaacagaagatggattacgagctcttggctttaagggggcataatggctatttttcaaataattaatgaaagcactccccaagttccaaaggttaagcaatcattaaatgaaaagaaatggattcagataggtcttgaatataaaaaggccaaagcaaaaggaatgacaggaaagcaatttgccgaagaaagaggaatcaaatactctacatttacttcagcaatgtcaaaatatgcttcaggaattaaaactgccgaaaagattcaaaagcttgaatcaaaaccaatgaataaactcaataagcaagaaagacaactgcttatgataaattcattcagacaaacattacgtgataaaattcgtaatgaaggcgcagcaattaataataaaaccagaaagtggttcgctgaaactattaagcaagtaaaaggacataaagttgttcgcccgcagccgggacgaatatatgcttttgcttatgatgctaaacacaaagaaactcttccttactgggataaatttcctttgataatttaccttggtttaggtaaacataatttaatgtatggattgaacttgcactatattccacctaaagctcgtcagcagtttctagaagagcttttaaagcaatattcaaatacacctactattactaataaaacgaaattaaaaattgattggagtcaagtgaaaggatttaggggtgcagaccaaatgattaaggcatatatacctggtaatattatgggtagccttgttgaaatcgccccgaaagactgggcgaacgttgtgttgatgccacttcagcagttcgtttcaaaaggaaaacgtttctctgcaaacaaagtctggtcaaatatttaattctattatcttccattcttttctgttgtttgttctaaatggaattgaatggaagggacttagacccattataccaccaacagttataaagcattatgaggaatatatgtcgcaagctctgcaacaaatttttaaccaagcaaatacaactaactttgtaatatcaataccacatagtaatactacatctgcttttactttaaatgctcagtcagttcctattccaggaattagaatacctgttactgataccgtgactgggccgtttggacttggccgagcacaacgaccaggtgttacatttgagtacgatccactcattgtgagatttatagttgatgaagaacttaagtcatggataggaatgtatgaatggatgctaggaactagcaactatcttacaggtgaaaatactgctcaaaaaactggtcctgagtacattacgctttacatcttagataatagcaaaaccgaaatcgtgatgtcaataaatttttataagccttgggtttctgacctatctgaagtagaatttagctacacagaagattcagaccctgctttagtatgtacagcaacgattccttacacctatttccaagtagaaaaagatggcaaaattatagcagaagtttaatgcttcagttttgtgtgttataatcttaattaaatttgaggagaaacacatgaaactaatctttttaagcggtgtaaagcgcagtggaaaagatactactgctgattttataatgagtaattattctgcagttaaatatcaacttgctagtcctattaaggacgcattggcttatgcatgggatgtgtttgcagcaaacactggctatccttgcttaactcgtaaagagtttgaaggaattgattatgatcgtgagactaatttaaatctgactaaattagaagtaatcacgattatggaacaagcattttgctatcttaatagtaaaagcccgattaaaggtgtgtttgtttttgatgacgcagttaatttcgtagcatttaacaagattgctgacgttataaataatattgaagatcaatggtcagtccgtcgtctgatgcaagccctaggtacggatttgattgttaataacttcgaccgcatgtattgggtaaaattatttgctttagattatcttgataaatttaattcaggttatgattattatatcgttcctgatactcgtcaagatcatgaaatggatgcggctagggcgatgggtgctacagtaattcatgtagttcgtcctggtcaaaaatccaatgatacgcatattacagaagctggattgccaattcgtgatggtgatttagtaattacaaacgatggttctcttgaagaacttttttctaaaattaaaaatacactaaaggtactataatgtctgaacaaactattgaacaaaaactgtctgccgaaatcgtagctctgaaatctcgcattcttgatacgcaggaccaagcggctcgtctgatggaagagtccaaaattctgcaaggaactttggctgaaattgctcgcgcagtaggtatcactggcgataccattaaagttgaagaaatcgttgaagctgtcaagaatcttactgctgaatctactgatgaagcaaaagatgaagaatgatggaatttaaagacttttcaacgggtctttatgtagcagctaagttttcagaattaacactcgatgcgctggaagaacttcagcgctctttacgtgttcctaatccagttcctagagaaaaaattcattcaactatatgttattcaagagtaaatgttccgtatgttccatcaagtggaagttttgaagtagcttcttctggacatttagaagtatggaaaacacaagatggatcgactcttgtacttgtgctagattctgaatatctgcgctgtcggcacatgtatgcgcgggcgctaggtgctacacatgattttgatgattacacaccgcatataacattgtcttataatgttggacccttatcatttagcggtgatgtacaaattccggttgtacttgaccgtgaatacaaagagcctcttaaacttgattgggcagacgatttaaaataatttcacaaagttgtttacatactgatggggtagtgatactattatctcatcaaaattaattaggaaaataaaatgaaaactttcaaagaatttacttctacaactactccggtttctaccattaccgaggctactcttacttctgaagttattaaagcaaataaaggacgagaaggtaaaccaatgattagtctagttgatggcgaagaaatcaaaggtactgtctacctaggtgatgggtggtctgctaaaaaggatggtgctacaatcgttatctctcctgctgaagaaactgcattgtttaaagctaaacacatttctgctgcgcatctcaagattattgctaaaaatcttctgtaataaataatttcacaaagttgtttacacggggttttagtagtgatactattaccctatcaactaccgaggagaataaaatgaaacgctgtgaattaattcgaaatgttgctattgcaatttctgcttctgcttttagtttttcaatgtttgttggatttatatgcggattattaactacagtagaaaatgttttttcacttgtagtagcatttttaattggtttaattgctatcgttatggataaaatttctaaaggtgaataatgagtattaacattaacgaatactatgtttatgctggggattatgcaaatccttctcattttgaaggtaatttaatacctgataaagtttttaatactccttttgaagcatggagttggattgaaagtaaaaatggattttcttaccgttatgttgaagtaactgattggaaaggaactaaatatcctaaagagcattattacgtaaatccatctaaggtaaattttcttttattcgcaggtgataattattacccttgtggtggatatgatgatttaattgcgtatgctgaaacagaagatgaattacgccaaattattgaagacaataaatcaaaacgatttggcgatagtttcgactggtggcaaattgtaaatgccaatactcatactattgtcgataaaggttaataatgattctttatgctaaagtatcgtccattgaaaatggatataaatatgatcaagaagcagctaaagccttgattgatgattatggcattttaacatattttgaagttgaaaaggtttacattgaccgttcatcttcacaagttaaattagtgaaggaagacagtaaatttaatacagtaaattttgatttctttattgaaacagaaaaaggtcctcttgaatatgatattttcaagaattctttaggtcttgaatgtattgaatatacttacattaatatggtgagcaaatgaatatttgtttaggtactacaattccgcagggttacgtaattgatgtcactacctgggaaaatgatggtgacaactataaaaccaaaacactgtttggcgtagaagagcatgaaatcttacaatttcaatatcttttaaagaagtttaaaagtcgacattctagcaccaaagctgaacgctattgcggtaatggtttgttcagcgagcaatctctttttatttatgaatacttggttgaaggactgttctcagatcagctttatccagaattcattaaaaaggtctttcgcatagaagttgaccttggtaataaatctgaagaagatgaagaacgtgtatttgacttattctttgtgaatagtgataaagtgcttgaaggacttattaatattttaggtaatgcttctgagtattatgattatgattttttgcgtgtagttgagagtgttaaatactcttatatagaaaaagaaattgttttgccgaccgttaaaatgtttaatttgctttaagaattatttgttattattaactcataccgcactgattaataccctctatcatcaagggttcttgtttgagagcctttgttaataattgggaattagccaagttggtaaggcactggattttgattccaggatgcaaaggttcgagtcctttattcccagcgcgagaatggtcaaattggtaaaggcacagcacttaaaatgctgcggaatgatttccttgtgggttcgagtcccacttctcgcaccaaatttgcggatatcgtataatggcattacctcagacttccaatctgatgatgtgagttcgattctcattatccgctccaatttaatttactccgtgtagctcagtttggtagagcgcctgatttgggatcaggaggtccaaggttcaaatccttgtatggagactggaggcgtggcagagtggtttaatgcaccggtcttgaaaaccggcagtcgctccggcgactcataggttcaaatcctatcgcctccgccagttttgctgatttagctcagtaggtagagcaactcacttgtaatgagaaggtcggcggttcgattccgtcaatcagcaccaaggccctgtagctggaaggttcaagcaagcgactcataatcgccagatggtggttcaattccacccagggccaccaaattaattaggggagttatcccgtagaggtagcggtgtggactgtaaatccattgtcattgcgactcgggtggttcgactccatcactccccaccaatttggatgtgtagctcagtggtagagcagttgactgttaatcaattggtccatggttcgaatccatgcatgtccgccaaatacgaggcatagctcaattgtatagagcaacggacttctaatccgtaggttgaaggttagaatccttctgtctcgaccaattataagtgaggaaaatatgaaaggtaatgtttatttagtagttcatgatttaacattttattttaatcataatgatactgttatttctgaacgcgtaattaatttgctttatcagcatgcagattatgtttatgttgaaaatgaatttggccattggcaatttctcaaaaatcgttcatttggtttagatggttacgaatactttgatcgtaaagaccttttagatacaattccattatctacacaatatcaaaatcataagtctttacataaatgccggctaattcgaaatgctgaatccgcttatgaagcaattgatttatggcgtaaacgccgtgaacaaattgatgctttaaaagaatattaagaaaccgggtcgctaccggtaagtcgtcggactgatgttccctgtttaaggactggcattaacaaatctttacgatctgttaatgtccccttatatcacagcagaaacggcgcaccgaattatcgattcgaggaaatatctttgccgtaagccgagtagcgtttttgacggaacgttcggatatggtcgagatatggccttttaaaaatattgagtagcgtcaactgcttggtaaccgggttcgaatcccggcgtttcgtacaaacacttgccttagcaggtggaaccccgacaaggcatagccccgaccgaaaggttggggctttttagtataaataagtatattaaaatcacgaattaaaccaggaaataagatgaaatcatatactcaatttttaaatgaagctttgttaaatgaagcatctagcaccgaaattcaagctgttgcaaaagctgccattgccgcgggtaaatattcctataaagatgcttctgatgaatcgcgattccaatttgctcgcgatatgaaagcagaaggatttacgggaaatgcagttagtatggcttggaaaagtttagttgctactggagctgcttttgcaaaggcttcaggtaaacctgctcctaaagcagatcctaaagtcgcacaagagaaaaatattgttaaaggaattatctccaaatatgaagctatccttaaagagcttttagtaatcaaaactgaaggccaaaagttagctcgtgcttatagtttcaaagataacccacatgttcactctcttgagtatgttgaagacatccaaaaaattattaaagaccgcatttggtctgctaaacaaatcaaataacaatcttagccccaacagaaaggttggggctttttggtatctagacctttctggacctttctaggcatcatttagtttctatcctttataatatattatcctatcctttaattgcccctccctgccctagaattccccaaaactttttaaaaattttttcacaaaactgtttacatccttgttcttctgtggtactatacaactatcaattactgatacagaaaaacaacttggagaacgaaatggataattacggtgaactgttcaacttctttatgaaatgtgtttcagaagattttggtcgtatggtgaatgatattaaagttatcggtcctgaccatccgatgtttgaaacctatgcagtaatgggtaatgaagacggtcagtggtatactgtaaaggttgtgattaacatgttcactgctgaaggttatgttaagctgtcttctaaagtttaccatgataacgacgaaatcgcagaagaatatttcaataatatgaaataattgtgtacaaacaccaaggacggtgttattatagacttatcaaaacaaatatagaaacggagaaataaatgactactttaattatttggttcgacgaaaatgaagaaacatattgtgtgaacattgacgaaagcccaatgccagaatttgaatcttcagataaaaactcggttgtatcttgggctgaaggttataaagcagcaaaaggcgatgttgaagtagtttataaactctttgaaatataatactctcacggattttaaatcttaatcaacctaaggaaatactatgaacacactgaagaaaattgttgagtttattcgcactaaacttggttctgctatggctaaaaatctatctgttgaagaacagtatactgctgcagcagcaaaactacttgataaaattaaagacctaaaaactgcttctgttaaatctattaatgaagaaaaacgtattcgtgaacttattgtcgaaaagaatcgacaggccgaatcaaaagagcgtgaaattcgcaagcttctttctgaaggtcaagatgtaacaatgcatgctaaactcggtttactatatcgtcgaacagctgagcagttgactactaaagctgatggttatgctgaaatgcgaattgaaatcgccaagaaagtagttgagttagatgatgctcgccaagaacttgcagttaaattggaatatatccgtgaaactcgtgcagcaaatgcccttggaattagtactgccgatgatgtagttgaaattgcagcgctgactaaggttgatattgaagatacccttgctcgagttgaaacctttaatggtaatatttccggggttgaaactacctctgccgatgttcaggaatacattaattctctgaaataatgataaggggcttcggcccctattacttggagtaaataggaatgaaaatgcaaagtgatttcaattcaatgtttgaagagttccaaagacaggttgatgttccagaccaattactaaatgctcttaaacgcatggcagaaggacgtaattactattgggggtcttcatatgaaactgatgaaagcctttctggaagattttgtagaggtaaaaagtctttaatacgtcctggaatactcattaaaagtattgaatcaattcattcattgacatgtgattttgatgttgaatttactgatttcatttctcctgaatggacagtttgttatttaaatgacgattatgattatcttggcatttatagtttaagtgacgcatggtttaaacgtaatttacaaaagtcaaatttattttatattgatactacggtaaaatttcagggaaagaaatatttctttactcttatagttgattctgaaacaaagcatgaaaataagcgtattcttagtaaaaagaatatcttaactattgttgatgatctttttgataaattcgtggaaaatcctaattttgaaagcgatttattactagaaaaatttgttaaggaatgtagagaatatgtcaaagccatcaatgtatcttccaagtaaaccgttgaagtatgaattaaagcgccagctaatttctactgatgtattaataggtcctgtaatacttatatcatttgtaattctactgattattggaggtgttttagatgttatgactgatattgattctggcgaaatactcgtgttaatgctaattcttccattaatagttccatttttattagtacctgtaaattgggtaggatactggtatcaaggaagacattatcgtaaacgcatacgcgattggaaagctcagtgtaaaaagattaaaaaggaacaccagcttaaacttgctgcgtatgaatttgatgaaattatgaaatttgttaaggaatcacgatgcaaaagccaaaactaaataaagtcaaatattcgtttcctgagtcatttttaatttttgctgtggcgttggctacagctattgcgggtagtcttattggattgttaattgactgtcttattttaaatatcgacggcacagtaaatataatagaagtttggagtgaacttcattatactatagcgatttcatcattttcattctttggtatcatgttatattttcattatgataattttaaaataaattggcaaagaaaaaaggattacaaaatacaattaaaagaatataacagctacatgtcttatattgaaaatgaatcaatgaaagagtttgtgagtgattgcaggaaaatcagatgattttaaaaactcgctggtatgatttagatgatggcatttcagttgatagagttgactgaaatggctgttccgaagatatgaaaaatttgctaattagggagtttagaatgggatatcaaccagttaagccatctactgtaacagatgataaattcgtgtgtattcaaaatggtcgcgctaagttaacgaacgctgattggtttacagacaagaatatgcttctgtggtatattatcagtcttcctgtgtcatcattcgtattttacttctttggaaaaaatccaatggacagaataggagattgggctctttgtactatatttgttaatatttttactgcagcaatattatcaggaatatggtgcgtgttcattgaaatgccatggcgtttacgcagacaacaaaagatttttgatgaaaagaaatatactcaaaatttaaataactttattactgaatgcaggaaattaaaatgaaaacattatcagctggtattatctttatgacagaagataaagatttatttatgggtcgggttactggttctcgtaagcctggaatgatggcacatcgttgggatattccaaagggtcgtgtagaaaattccgatttaagcgcattagatgcagcacgaagagaatgcttagaagagactggttttagcaattataatccagaccttctagaagacctaggtgtatttaaatattctagtaataaagacttacagctattttattatacgattccagtagagcatgagatgttcagaaattgccattgcgagtcttattttgaaaataaagatggcgttatgattccagagatggacgcttttgctcttattcctcgtactcagtggcaatatgtgatgggcccttcactttaccgaataatgaacagcctcttttaatttataaataccttctataaatacttaggaggtattatgaatatatttgaaatgttacgtatagatgaaggtcttagacttaaaatctataaagacacagaaggctattacactattggcattggtcatttgcttaccaaaagtccatcacttaatgttgctaaatctgaattagataaagctattgggcgtaattgcaatggtgtaattacaaaagatgaggctgaaaaactctttaatcaggatgttgatacggctgttcgtggaattttgagaaatgctaaattaaaaccggtttataattctcttgatgctgttcgccgctgtgcattgattaatatggttttccaaatgggagaaactggcgtagctggattcactaactctttgcgtatgcttcagcaaaaacgctgggatgaagcagcagttaacttagctaaaagtagatggtataatcaaacacctaaccgcgcaaaacgagtcattgcaacgtttagaactggaacttgggacgcgtacaaaaatctataaagttgtttactttctcttggaattgtgatagtatattcacagttacttggataaataaattactaattaaaatattcacatttaaaggaaacacatgaaaacctatcaagaatttattgcagaatctgctgcaggacaacgtgtagaaggcggttatatctggattgaacaagttgagccgccaagtcgcacttctacaggtaaatggaaaatcactgttgatggtcctggtggtaaacgtaggactcttaaagaaattaacgggtattatgaagaagctctttctgacgcgggtacttatatgatgcaaatcatgattaaaaacccagaaaatcgttttgcggctagagttttccgccgtattggaaataagctttatgatgcatattctaaaaacttccctaaagaataaaaattaaaggaaacatatgaaaacctatcaagaatttattactgaagcagctatcaaatctcaaattattgctgaatcttttactgatcttttgaaatttaaaaaaggtcaaaaaatcactgctgtattggatgatggtacagaagttgagatggatgtacaaggatataattatgcagtagatggaaaactgtataataaatcccatgctaaatttgattcatttgacgactttgttaatacagttgaagatgaaaaaactcgtcgatccattgcaactggtgatgctaaggttcttatggcacatggtcatgaacgcattcgcgctaaacagaataaaatgggtgaagataatttcgcattagttggttatcaatctggtaaacaaacttatggctatcaacgtactgctaccatgtataacaaaaatggtaaaattgcctttgtgaacagtaaaggttctattcagtacgtcaaatcattcaaataatatagtaaataacatgggaacaacctggacctcatgattctatgagggattcccgccaacctgtaataaggtcgagcccaagcgcggtaatgggtaaatacaggaatggacaattcatgcgccacggatggcccaaatttagagagaacaaaatgagaacatttttgactggtccttatctatccctgatgaatgcttttacacaccattctgatgctagagtagaagaaatttgtaaaaacgaatatatcccgccatttgaagacttactcaaacagtactgcactcttcgacttgacggtggacgtcaatccggtaaatcaattgctgtgactaattttgccgctaattggttgtatgacggtggaacagttattgttctttctaatacttcagcttacgctaaaatttctgcagataacattaaaaaggaattttcgcgttattctaatgatgatatacgttttcgtttatttactgattctatacgcagttttactggtaatagaggtagcaagttcagaggtttatcgctttcgcgaattttgtatataattgatgagcccgttaaatctcctgatatggataagatttacgacattcatattgaaactgtgcaacattgctgtaaaagtaaatgctgcattggtggtattactcgtccgcagtttttcgtaatcggaatgcaatgatgacagacactcagcttttcgaatatctttatttttcaccaaaaactattaaaaataaattggtgaatcattttgaaattttggcaaataacgatgtattgagcgaattttatcctaagcagtataaattgcagaaaggtgtatttaaaggatgcagagttttgtgtactgctcctaatgcacggctaatgaataaaattccatattttacaatggaatttattgatggaccatttaaaggattgattactcaaagtttaatggcatatgattctgagccatttttaattaaagaacaatcttggataaatttattttctaattgaggtttatatgaaagcatatcaaattcttgaaggcacacacaaaggcactatttattttgaagatggtattcaagcacgaattatcgtttctaaaacctttaaagaggactcttttgtagacccagaaattttctatggtttgcatgcccgtgaaattgaaattgagccacagcctacagtcaaaattgaaggtggtcaacacctgaacgttaacgttctgcgtcgtgaaactctggaagatgcagttaagcatccggaaaaatatccgcagctgaccatccgtgtatccggttatgcagttcgctttaactctctgactccggaacagcagcgcgacgttatcgctcgtacctttaccgagagcttataatggcaaagataattattgaaggttctgaagatgtactaaatgctttcgctgaatggtttagtaattcaggtgagcaacaatttaatgaagcatggaatatgggcgatattgatggaatttatcctacgacagaaatttctgttcaaggatatggcattcatgaacctattcgtttagttgaatatgatttgggtactggcgaggaagtcaaatatgattgaagatattaaaggttataaacagcatactgaagagaaaatcggtaaagtgaatgctatcaaagacgctgaagttcgtttaggacttatctttgacgctttatacgatgaattttgggaagcatttgatagctgtgaagatgatgaactcgcgaagaattacgccgaaagcctcgatcagttaactattgctaaaacgaaactcaaagaagcaagtatgtgggcttgccgtgctgtgttccaaccagaggaaaaatactaatggctcaattaagcgcagggtttggttatgagtattatactgcacctcgtcgtgtatctgccgctcctaagaaaattcaaagtcttgatgatttccaggaagtagtccgtaaagctttccaggactatgcacgttatcttaaagaagattctgacgactgtcttgaagaagacgaaattgcttactatgagcagcgtcttgagcagctcaaaaatctacatgaggttcgagcagaagtttcaaagtctatgaataaattgatcagatttaaagaataactgtttacttttcctcttgactgtggtataatttttctataagttaagaggagaataacatgactatcaacacagaagtttttatccgtcgaaataagcttcgtcgtcactttgagtcggagtttcgtcaaattaacaatgagattcgtgaggcatcaaaagcagcaggggtctcatcgtttcatctaaaatattctcagcatcttcttgatcgcgcaattcaacgggagattgatgagacatatgtttttgaattattccataaaataaaagaccatgttttagaagttaatgaattcctgagtatgcctccgcgtcctgatattgatgaagattttatcgatggaattgaatatcgccctggacgtttagaaatcactgatggaaatctttggcttggatttacagtttgtaaacctaatgcgaagttcaaagacccgtcgcttcaatgtaggatggcaattatcaacagtcgtcgtttaccaggaaaggcttctaaagcagtaattaaaactcaatgaggtaagcatgagaaaagcactactcgctggtctattggccatttcaatgatggcacatagctccgagcatactttcagtaatgtccaactcgataacatgcgttacgcatatcaattcggggaacaattttctaaggatggaaaatataaaacacaccaaaatgttcataagagtggattaggtcatataatggcagccattatatggcaagaaagctctggcggagttaatttaaaatctaaaccaaagcatcacgcttatggaatgttccaaaattatttgcctactatgcgagcaagagttaaggaacttggttataatatgaccgatgctgaaataaaaagaatgttgaataaacgatccaattcagcttcatgggcgtacattgaactttcttattggttaaatatacataagggcgatataagaaaagcaatatcctcttataattcgggatggaatgttaaagcaggttctaaatatgcttctgaagtcctagaaaaggctaattaccttaaaaataataaacttttggaaatagtaaatgactaaaattttggttttatgtataggattaatttcattttctgcttatgcgtcagcagatacatcatatactgaaattagggagtatgtgaaccgcactgcggcagattattgtgggaaaaataaagcatgtcaatctgagtttgcgcagaaattaatatatgcatataaagacggagaaagagataaaacaagtagatacaaaaacgatacattattaaaacgatatgctaaaaagtggaataccttagaatgctcagttgcggaggagaaagataaagccgcttgtcattcaatggttgaccgtttggtagattcttataatcgaggattgagtactagatgattgtaaaatatatcaagggcgatattgtcgccctctttcttgaaggtaatattattgcgcacgggtgtaattgttttcatacgatgggcagtggtgtagctggtcaattagcaagggcttatcctaaaattttagaaatagataagaccacaactgaatatggttcgcgtgaaaaactcggtgatatgtctatagtttttaaacataaacctaatggttttggcatatgttataacttgtatacgcaatacgaaccaggtcctaatcttgattatggtgctttagtaaattgtatgatagaattaaatttacaggcagaaacccttttgtttaaaccagtaatttatattccacgtataggttgtggtattgctggaggtgattgggataaggtttctaaattaatcgacatgtttactcctgatattgatttaatagtggtggattatgaaagcacattacccgcatccgtttgaccctaaaaataaagcagaaattattcgtcaatgggaacgcatttgccgtactaaatgtccaattaatagtccacatgatgtagataaagactatattggaacattcgttgaatatacctttattgataagaaaggtcgtaaacaacatgtagaagaatattgcttaaaggttacatggttatgagccaaactagtattcttaaaaatgcccactgtgaaaagtgtaagtggccggttgtttttgctttatgcaacgatgaaatggcttgtgatttcgattattggtgctattgttctaataaaggatgcatcaatcataaaggtgaaggattttattcaggattttatccttatcctgatttcgttaaagaaggtaaaccaaaatgaatagttttgagttacaatatgaagtgttacgtgagcttgataatttaattgaactcgctgtcaataaaggttttgccattggaatcggtcaaaaagatactggtcatttaactatggaaatatttaagcaaaagcgaattattttaaaactcctggaaattaatatatgagtctgagtaaagaacaaaaagataaattgtttgagcttatccatgaacttctagatgagcatacagaagcaaacaccttttatgatgaatacggcccgctatctcccgaacagcaagaagaatttgctgttcggtttgataagaaagaaaacgaattaatagcttatgtgaatacgctttaagaaggtgatatggcgagtttaatttttacttatgcagcaatgaatgctggaaaatctgcttctcttttgactgctgcgcataattataaagaacgtggaatgggtgtattagttcttaaacctgctattgatactcgcgattctgtctgtgaagttgtttctcgcattggaattaaacaggaagcgaatattattacggatgatatggatattttcgagttctataaatgggctgaagcacaaaaagatattcattgcgtatttgtagatgaagctcagtttttaaaaactgaacaagtacaccaattaagccgaattgttgatacatataatgttcctgttatggcttatggattaagaactgatttcgctggaaaattatttgaaggttctaaagaacttttggcgattgctgataaacttattgagcttaaagcggtttgtcactgtggtaaaaaagctattatgaccgctcgattaatggaagatggaaccccagttaaagaaggcgatcaaatttgtattggtgatgaaatttacgtatctttatgtagaaaacattggaatgaattaactaaaaaactggattagtgcaaaagttataaataggtttatctaactaaaggggtatatatgctacaattaactgaaaagcagcttcgcaatcttactgtgcttcaattagatgaaattcgtagagaagttggaaatgttatttcagctttgcgtcgagaagtatcaatcaaccaatctccggcagactataccagattgcgaaattttgaaaaataccttgataaagttaaggccgtgcatcggcataaagtaaatacaggacaaaaatgataggaggcctttatggccttaaaagcaacggcactatttgccatgctaggattgtcatttgttttatctccatctattgaagcgaatgtcgatcctcattttgataaatttatggaatctggtattaggcatgtttatacactttttgaaaacaaaagcgtagaatcgtctgaacaattctatagttttatgagaacgacctataaaaatgacccgtgctcttctgattttgaatgtatagaacgaggcgcggagatggcacaatcatacgctagaattatgaacattaaattggagactgaatgaaattcagcgacttttcacaaagtggaaaaccttcaaaggcagatgaatacttaggtttattaatggctgcacaagcttattttcattctgcgcattttgaaactaaaagctatgctagacacaaagcatacgattttattttttccgagttaccagatttgattgacaaatttggtgagcagtatttggggtattctggtagaaaatacactccttcaattccagatgctagtaaacttcctaccgatacaattaaaatgattgatcacatactagaccaatctaacagcatttataaagaaatgcctccagccattcaaagcacgatagatgatattactggaatgttttatcaaagtaaatatcttctttccctcgaataacattagtctccttcgggagacttttttcattttaccggtttactttccgtttgagctgtggtactatacaactatcagataaagaggagaacatcatgaaaattgaagcactcaatcaagaaggaaatatctacgtcatcattaatggtgattttttcgtcgacatggatgaagttactagtgaagaacttgtagaatttcttaagaaacgctataatatgtgtgatgaagctgcaactcacatggcgtgtgcaatattttctctttcatatgtggtggaataatgattagtatcgaacaagctgataagattaaagaattggtagctttaattcgtaaagcagatgaggaactcactgactttgcttgggcttcatctggtattgcaaataaaggtattgatgaatttgaagctaaagttgataatgctgtagaagctttagatatgtttcttgatgaaattatcgatcataatacgagagtttaagtatgctgacacgtgaacagtttgaaaaaatcattaaattagcacgtgatattgaaatagattcataccaattagcagttgagcattgtgaaggatattcatacgatggtatagaagcggctaaaagggatttagataaatctaaggctaagttagttcaatatcttgaaatgattaggtggaataatgaaaactgaaaagcagatgtttttaatgaagctaattgaagaatatgctaatgcagtttctgactatgaatattcttctcgggaaagaggtacagctttcgccaaagaagaaatgaaaatcatggttgatgctcatacaaagcttcaaaattttattgaaaacaacatttaacggtttacaagttggcaaggttatggtatagtaatcttgtcaactgccgaggagaagagaatgaaagttttgtttgttgtgtatgtgatgattcaatataattacccaatgtttacttataatctggtgaacaacattattgatatgattcagaggagtatgtaatgatgggagaggcgaaacgattagtattagaagttagttcactttttggtgaattggctatagaaaaagtaaataatatgtatcgtttgacacaagaagacgatatgctatattttacgcctagtgaaatcattcatttaacccaaattgaaaatccttatactgataaaattgtaagcattaatgatgagcataaaattcatttttattctttatgcccaggatttaatattgaaagcgagtccatatgcttatcaattaacaattgggataattttataactaagattaaatatttttattattccaatgaaagaaaacacagtttaaaatggtttaaaaatcgcaatgctattattactaatgcttgcgatcagaatgatgaaactgttttaaatgtatcaaaatgctatgaagatggagatgtcttaactattcgtcaaattgatgattttcgatcgcatattgtcacatttactaaagacgaagctattgcgctaaagacttatcttgattctgtcattccaactatgatttcaaagtgaggaaatatgtatatttcaagtgaaagtggtttaattcgtgttgaatttaaaaatgatattttccttattcaaggagatgatattattaaaatgagttatgatgaaatcaagaaaatttgtcatactcttgaaagccgtggaaacgtaaatgctgttattgacattggtgatttatgggtaacgctttatgaagtatccgaaggatttaacattgaagatgaaaataacattttagctattgataaaagaactgatttgtttgatgtattaaaagcctatgaacagtcaaacggtggaagaaaagctgcattgatttatcaaaaaccacattcatgtggaactgcttcaatcatttcagatattgaagacgaatctgatacttatatgtgtattttaaaagctggtggtgaccgtcatccggattttatttctattcgtcaaaacaatggagaaatttcattatcaaaatcagaagctgaagccatgattaagtatttaacaaccgttacgccttcaatgaaaggataattatgattattaatgaaaactcttggcactataaattgttcaaattgtttaacgacgaatggcaacgacctaagacactatgtgcatacttttggtctattgttatccctacatttttcgtttctatttttgggtgtactatactcgtagggctaacaattatttgcgcagaaagcctacaacgatggcttattttcggtagtttatggactcttcttccatcggcatttatacttgctcttttggttgttttacttattatcggttcatttgttattcctgcgcatttgcgtgaaaaatataaaaattataaatggaaaaaggattatgctttgcacatagaaaatatcaatagggcgtataaagatttacctcctattcaacccaagaaatctcttattatcaaatttttaaaagcgcgtaaagctaaagtatgtcctgttattgaatataaggctgaatgatgaaaacagtaatgaaaagctattttggtagtcatctttatggaacttctaccccagaatctgatgtagattttaaagaaatttttgttcctcctgctcgtgatattcttattggaaacgttaaagagcacatgagtaaaaacactaacaacacatcatctaaaaacactaaagatgatattgaccacgaattgtatagtcttaagtatttctttaaattagcagcagatggtgaaactgtagcattagatatgcttcacactccacctgaactagtggttaaatctgatttgcctgacgtatggaagtttattcaagacaaccgttctcgtttttatacgactaacatgaaatcctatttaggatatgttcgtaagcaagcttctaaatatggcgttaagggttctcgtttggctgcattacgtgatgtattgaaagtagttaatcaaatccctgaccagtgggttgattatcaagaaggtattccagaccgcttgcgtcgtaccaaggttgaagatattaagcatcgtctcccagagaatgaattctgcgaatgggtgttccataatcacgagaaaacaggtccacaaacgttctacactgtgttgggtcgtaaatatcagacaacgctttctcttattgagcttaagcagtcactaaacaaattagatgctgaatatggtgaacgcgctcgtaaggccgaagcgaatgagggcattgactggaaagcactaagtcatgcttgtcgtggtggactccaactattggaaatttacaaaactggtgacttggtctatccactcaaagatgctccatttattctcgacgtgaagttgggtaagcatccgtttaaaacggttcaagagtttttggaagatgtggtcgatcaagtagaagcatcatctactgaagcttctaagaacggtatgcagcaaaaagtagacatgagtttctgggatgacttccttgaaagggtgtatctcgaaaaccatcgaagttattataaatgatagggagccttcgggctcccttttttattttaaaaatttttcacaaaactgtttacacgcataaagctttatggtactatacaactatcaactgatacggatttggagaataaaatgaaaactgtaactatcaataagggtatctacttcggtaaagaaatctctggaacttttgagctcttaggcgaatggttcccagataatgctccggtagatgcacaaggagatggtaaagtttttgttgaaattgacggtaaacgtcgcggtgtttgggtttacaaatccgatatttcatatgatggtgtaaaagttgaagaagttaaagaatcatatgaagatatgaaaacccgcattaataaaagatttaatgttatgggaatgatgacgaatggtattattaacggaaacattcgttcattaattatctctggtgcggcaggtattggtaaaacgtattctttagataaagctttaaataaagcaaatgatgttggatacattgagtataaaagcattaatggtaaaatctctggtatcggtctttatgagcagctctggaataatcgtgaagagaattctgtccttttgattgatgatgtggatgttttctctgatatggacattcttaatcttctaaaagctgctctggacactggagagacccgtaaagtctgctggagcactgcatcttcttacttagaagaaaaaggcattgaccgtgagtttgaatttaaaggaacgattgtttttatcacaaacgttgatattgaccgcgaattagaccgtggtactaaacttgctccacatttacaagcattagtgtcccgctcagtttatttagatttaggtgttcacactaatgaagaaattatggtcagggttgaagatgttattctttcaactgacatgatgcaaaagcgcggtctttctgacgaagaaacttataaagcattatcatggatgaaagtcaatgttaatcgtttacgcaatgtttcactgcgtactgctctttatcttgctgactttattatgaccgacaaaaacggttgggaagaaattgctgaggttactcttctgaaataattcataagaggacttctaagataaaaaggcagttcagaaatagattatatggactgccatcaaaaagatgactagaattaaactggtaaatggaggtaataatgttatactcaaaggctcgtgaaatttacgaaactaaaattaaagaagcagtatttcagttcgcaacgacaatgcgatggacaaatgattgggagtattcaaaaaatcataagaagcctatggtgacaagaaaggctcatatgttagtgttaatagaccgtgagcagattaaagcccgagaagccctccagaatcataaaaaggctgcctttgaatggtttatggataacactgctcccgagactaagaaagcagtgagcgcctggttcagtggaaaaaattgtgaaagaagtttcttttagttgtttacaagactgttcctctgtggtactatacaactatcaactacggaggaacagaaaatgaatgctaaagatattttcaacctggtaaattacaacgatggtaaatttaagtcagaagcacaaagcaagttctttaatgacatctcaatcggaggtgaaattacggttgatggaggacagatttacaaatcccgttggaattggatcgttattattgatgagattggtattgtagaaatttacaaaaatacgaataaaaatcgtacattgcactggtctcgtgatactaacgaacagtacaaaaaggataaagcatctaaattatctcgtgtaactcaagaagatattgagttcattaagaaagatattttaatgtatgataacttaattgctgaagagcaagctgttattgataaatttgacgagattaaagcttctcgtgaaattcctgattttatgaaagaatcagtaaatgaacgatacgctctcatttcagagcgtattgaaacttacaaaaatcaaagagctgaacgccaaaatactcttcggaagtttgaagaacggttaaagacggtactcgcataaccgctttataccaaggatggtataatggttctaagcccttttaattgagattattatgaaacagttgataattaaaagattgaatttattgatatgttgtttatgtatagtagttgcatatggttattatgctattaatgattatatgcattataaagattatgatgttactgtagttaatactattacaggaactcaaggaaaggggtctagtttatcatttattgctgtatatgaactcaatgatggctatagatttagtgaatatatttccccagagatgtattcttcaatagaaaaaggtgataatattactgtaagtttacgtcctttcgacgtaaaaccgacagtgtttgataatattgtttggttctttggaatggcattagttcaatctatatgtggtacttatatagtctgttcaatcatattccgcgtatttggcaaaattgagtgaggataatatgtcagtagtaattaataatgtcaatgcagtaattaaatctttagttaataaaaaaatgatgaatgaatggactgtatttcgtcgtggagagccagataaattttttcatagatttaacccaactttggatttgaatgttattgacagagatgttcatgctgaaattttagataagtttaaaattgatattggatttggattagaaaaacatttacagcgaacaaatgggtctggaatgagtttatctaatcgcattatgaaagcccttaataaaattggagcattgtctcgtattaacgcgagtgaaatccttcgcaattataataaaggatacgacctttatggccgactaatgccgaaattatcattcgaccaaatgattgcggatttatgggaaaatcaacgacgattattagcgttaggagctcgattggctaaaggtctagataaacaaatgatttttaaaactaataatacagaagaccttaaatgctttaaatttagtactcgtggaattgattattatattagagctcgctctacagattatgttaatatgggtcatcatctctgtttagcttttgaagttttaaaagaatctggaacattagaatattcatctggtgcaaaatgcccaattggttcaagttgtattttaatttatcgcccggatgaatccagttcaattgaattgcctacaaaacctgtaccagttcgtagtaacgaaaaacattctgaacaaattgattattttaataagcagattgaagagctgaatatttctattcaacagtatgatgatgaaatttttagactatctggattgaatagtaaagctaaatctgagcgtgaaaagttaattaaaattgttgatttacttaaatcttaaggaacaccatgaaaactcgttctcaaattgaagatatggttcgtaatgccagctatactcgtgatgttatgacatttttgtgccaaaataatttagaccctgataaagttaatcgtgatattcactttaaatatatgaatagcagtgaatggttacgtcattttagtaaagcagggtatattacacaaatgactgctcgtgaacagctcaccgatttctgtaaaactattgattataaaaatcctctatttgttcaaggtgttggtcaaagtaaggtcgatttatcatctggatttttcaatccaaatcattatcgtattgaatggagatttattgctctgttccgtaggcaattaaagcaaattttgtctactgctagtcgattgaaaggctctgacattaacttaaagaatctgaaatttgatggttatactcttcagatggaagtaagaccattaaaagaaaataacagaactgcacgaattagctttaaacctaatacaaaaaattctctttcaatctgtgaatgccttaaatcgcagttgacagaagcatttaagtatatggatgttgtttccgctgttcagtctaagatttcgcaacatttcgaacgatttaaattagatacgacaacatatgaacttgatatggtcgtttcatttaaatatgattatttgagaaaggacgaagttacacaagagaaaaaacctgaacctcaaactaattgctcatccaacgatcctaaatgttggatgtacagttcaagtaatacagatgcatggaaacttaataaagtgagttttcttcctactgaaaattcaaattttaaacctgtagaaaaatggcatgctgatgcgattgagaagtctcttaaagcagtagatgatgaacttgttaaagcaaccaatgaaatgctagaagctgaaaaggtgttagaacaagcacagtcaagagttcaaaatctgacaaagcaacgttctaaactgaacaacgcactaaatgcactgaactagtttactttaccacaaggatgtggtataatgttcttactttctactgaggagattattatgactcgtaacgaatatatcaaatcattcaatagcgttattgatgataaagttaaacccatgtctagtcagaatgctgttctttctattatcaatcaatggctcagtagtattgatgcaagtattgtttcttccagtaaatttattcatgaagttcgtgaaatttctagccgcgtagataaagatgatattaagataacctttaaagggtctcgtcttctttcatatttggttaatcgggatattcttggtaattttgggaaagaaattaaacgaactaaaggtgtaataggatacaattggttcggtgatgttaattcttatcatcttaatattaaagaagaccctaagaatatttttactcgtcgttggattagtaatttcagacttttcaagaagcaacttttaaaatcagcttctaaattatgttatggtgattatcgtcaaattcatcctttggcttctgatatgattatcgtaaaagaatatgagcttgataaaaataaagtagctatttttgtgaattatgaattttttacaccagaagctaaccaaaagaatattaataaatttttctcaattgctagcactataactcatcaattagaaacggctttggattgtatggaaactgtaaaaagtattcatacatatcctttcaaaaatatgggtggttgggaaggatataaaattgtaattagtcttcatgaagtgaaatgtgcttattcacctactgataaagaaatttatcaacaaaaatgtgaggaaattgtgaatactcctaaagaagaaactacccttgaggaactaatggataatcttgatgattcgcctgaaccggtagaaattcgtccagaagttattgcactagaaaaagcttataaagaagttctagaaatttctaataaagcgcagaaagaatatgaacaggctaaaaggatttgggaagaatctgttaatcgtcttgatcgtcttgaacaagctttacagttaattaagtaaaatttaaagccaaggatggcttggagcataaatcattaactaagtgagaagaatatgaaaactcgtaaacattatattgattattttgacagtcttattactaaacatcgtaattatcagataggacacagagcagtagttaataatattcttcgtgattttttagactatattggatgggaaaaccatatttgtaaagatacgcaaaacgcgtattcacattctcttggttctttgctcgagtggttcaaacgttcccgattattatcttctgtgatagctgttaataatgttaaaaaatttatgtatccaagctacattgaaactaatgtatcaaatgctaatgttgttacatttaatattattaacgacgtgaaaagaacttatttagaagaatggttttctaaagatagtaaagaaaaatttgctagtgaattttcacatgaatttaataataatgtgaatatgctttttaagcattctcgtagactgttttgtcatggcgatgaccgtactattaatgtaaatgtaaaagattgggttacggctaaattcattccatcatcacagaatggacaatttgaattgtcaattatcgtttgcgctccacatgaaatatataaaaatcttccgtatatgaaaccacgtgaagctaataaacataataaaacgattcgttctttgacttataatcttcgtacgttattgtctaaaatggacgtagttgaatcctttgatgataatacgaattatggtctttcactgtttgaaactaaagttgttattaagttaaagaatcctagtaaatttaaacctacgccaaagcccaatcatgggaatgatactatgaaagaagaacgcgaatatctcaatgcccgtttggctgaagttgaaaaacaaattgaagagcatactaaagttcttaaggctttaaccgccaaagcaaatggtttacgtaatgccatcgaggtattgaaatgaaaaagcgtttattagaagacatcgcagcttcaagtaattccagtttaattaaaattattatggctggtgaggaagatgatatggaaatgcgtggaaagattcatggttgcgacgatttagattttaaacctccagcatgggacgctattatggccatggttgaacgacgtgaaagagcttctaagaatattcctaattgccctgaatgcggtactgaacaggtttggcagactagtaatcttcgttataaatgtcgccattgtaaacaccgatttgaccgagaagaaaatgaccaagcgtaaagaatatatggagactgctgaaaaggcagtccgtgaattagcaatagcttattataatgaacacggtaaatttcctgatagatacagcgttcttaaatctgctttaactcgttcatataaaaatatgctatcagaagtaagtgatattatatacaaacataaagaacaaactggccaaagtcttgattacgatgagacttttaaacaagtactaggaattaaggaataatatgtttaaagtatacggttatgatagcaacatccataaatgtgtatattgcgataatgcaaagcgtcttctgaccgtgaagaaacagccgtttgaatttatcaacattatgccagaaaaaggtgtttttgatgatgagaaaatcgctgagcttctgacgaaactaggtcgtgatactcaaatcggcttgacgatgcctcaggtatttgctcctgatggaagtcatattggtggatttgaccaattgcgggaatactttaaataatgctcgaaggaactgattatatccatgactaccgcggaagcgcggtatatgtaggtgatgaagttgcagtttactatgggtatggaactttgatgacagccaaggttattcaaattaaaaataaccgtgttaaactcgaagtttattattctaatggcgaaaagtctatttctaagtggaaatatggcgattgcatggtcaaactggggtaaatatgatttacgatattagtgcagcaagagctccatcactggttactattccagctgaagaattggatcgtcttcagaaaattgaagaacttctttgggaaattgaatctgatttgccatcaggattagaatcctggattgactatgaagaacttaataaattgcgaaattaagtggtgacaaatgactattgaaaataaattagatgttgatgcagttctgagtgaaattattgaagaccacgatgcattttcagaaaattatgatttcgatttttcggattatcttaaacctatcgaaatagaagactgggtacaagatggcaaatgtcaatatcgccagtgtgtttattttagtccaaaacataacgttcatgtggctgtaaatgaatctcggtcaggttcttaccattctgactggtattatgcagttccgactgttgaattagtcgagccccgtgaacgtatagtaactcagacagtacgagaatggattacgctataaaaccttggtgggcggctagatgggaaactgtagagccagagccggaagaaccggtttacactgatgaagaaacagtatataatgaaccaacaataaatgacttaattgatatggagatgggacatgattacagtagataagtggtttagaattaatcgtgctgataaagggctgtgtaattactggccggaacttagtgcaggtactgtctttaaagttcgtgaacttgcaaaagaatgcgaagatgatatagaacctgatactggaattattgaaattgaactttctgatggaaagattattaacatctacgataagccaattacgtattggtgcttgtggaatactgaatccgcagaaaatggcgaaattgaagaagtcgtagaacgaactaatcaagctgcccagaagcctaaagccgcttttcaaggtgaacgtatttcatatgcattatctaaatcgtcattgaaaaaagatattgatgattacgaaggaaatttgatgcaagctgccgcagaatacattgaatggcttgaaactcaaatttctttttctgaccgagcgttttaatacttgaaaataataaatacccttatctatttaaggtaagggtttttattatgttattgactggcaaattatataaagaagaaaaacagaaattttatgatgcacaaaacggtaaatgcttaatttgccaacgagaactaaatcctgatgttcaagctaatcacctcgaccatgatcatgaattaaatggaccaaaagcaggaaaggtgcgtggattgctttgtaatctgtgtaatgctgcagaaggtcaaatgaagcacaaatttaatcgttctggtttaaagggacaaggcgttgattatcttgaatggttagaaaatttacttacttatttaaaatccgattacacccaaaacaatattcaccctaactttgttggagataaatcaaaggaattttctcgtttaggaaaagaggaaatgatggctgagatgcttcaaagaggatttgaatataatgaatctgacactaaaacacagttaatagcttcatttaagaagcagcttagaaagagtttaaaatgacaattgaaaaagaaattgaaggattgattcataaaactaataaagaccttttaaacgagaatgctaataaagattctcgtgtttttccaactcaacgggaccttatggctggtattgtgtctaaacacattgccaaaaatatggtcccgtcttttattatgaaagcgcatgaaagcggaattatccattttcatgatattgattattcacctgctcttccatttactaattgctgtttagtagatttaaaaggaatgcttgagaatggatttaagcttggtaatgcgcagattgaaactcctaaatcaattggcgttgctactgcaattatggcacaaattactgcacaagttgcttcccatcaatatggcggaacgacttttgcgaatgtagataaagtactttctccttatgttaaacgcacctatgcaaaacatatcgaggatgcagaaaaatggcaaatcgccgatgcactgaattatgctcaatctaaaacagaaaaagacgtatacgatgcattccaagcttatgagtatgaagtaaatactctctttagttcaaatgggcaaacgccttttgtaacaattacatttggtactggaactgactggactgaacgaatgattcagaaagcaattctgaaaaatcgtattaaaggtcttggtcgtgatggtataactcctatttttcctaagcttgttatgttcgtcgaagaaggcgttaatctttacaaagacgatccgaactatgatattaaacagcttgctctagagtgcgcaagcaaaaggatgtatcctgatattatttcagttaagaataataaagctatcaccggttcatctattcctgtttctccgatgggttgccgtagtttcttgggtgtatggaaagattcgactggtaatgaaattcttgatggacgtaataatcttggtgttgtaacgctgaatcttcctcgaattgcgttagattcttatattggaacacagttcaatgaacagaaatttgttgaattattcaatgaacgaatggatttgtgttttgaagcattgatgtgtagaattagttccttaaagggagttaaagcgactgttgctcctattctttaccaagaaggtgcattcggggttcgtcttaaacccgatgacgatataattgagttatttaaaaacggtagaagttcagtgtccctaggatacattggtattcacgaattgaatattcttgttggtcgtgatattggacaagaaattttaactaaaatgaatgctcgtcttaagcagtggacagaaagaaccggatttgcttttagcttgtattctactcctgctgaaaatctttgttatcgcttctgtaaactcgatactgaaaaatatggaagtgtaaaggatgttactgacaaaggatggtacactaacagtttccacgtttcagtagaagaaaatattactccgtttgaaaaaatttctcgtgaagcaccatatcatttcattgcgacaggtggtcacatttcttatgttgaacttcctgatatgaaaaacaacctaaaaggtcttgaggctgtatgggattatgctgcacagcatttagattattttggtgttaacatgccggtagataagtgttttacatgtggaagtacccatgaaatgactccgactgaaaatggatttgtttgttctatttgtggagaaactgatcctaaaaagatgaataccataagaagaacatgtggctatttggggaatccgaacgaacgcggatttaatctcggtaaaaataaagaaatcatgcatagggttaagcatcaatgaattacgatagaatttatccttgtgattttgttaatggtcctgggtgcaggaccgttctttttgttactgggtgtttgcataaatgcgaaggttgttataataaatcaacatggaatgctagaaacggtattccattcactggtgaaactttagaattactcattgaatgtttgaataatgattatatagaaggattaactataacaggaggtgaccctctttatcctgataacagagacgtgattcactctgtggtacaaactattaaaaatctttatcccaataaaagcatttggttgtggacaggatataagtttgaagatattaaacaactagaaatgcttaaatatgttgatgttattattgatgggaagtatgagaaaaatcttccgaccaaaaagttgtggcgaggatcagataatcagcgactttggtcaaataccgatggggtgtggaaacatgattaaattgaattatattatggatactataaatgatatgatttttcattttggtccagaattttattcacagtatagtttagtgcttatcaatgcttggttaatcaattaagggtaaaatatgtataaatttcgtaaaggtttagctgattttcttacaactgtaacattctttctgtttatggcagttggagctattttccttattccttttattgttatatttttcgtgattagtttgatttctccagaaaaaggactatcttctagtgagttcaatgagcgtctggataaaattactaataagttgaatgctgctcttagtaaggaatagttgtgaaacaaaacaagattgaagtctatggaattccagatgaagtaggtcgttgtcctggatgtcaatcagttacaaaacttctaaaggagcttaatgctccttttactttctataaagttcttacaaataatggtaagattgagtatgatcgcccgctgattgtatctcttgctaaacgtgctggattcacatctcttaacattcgttatccagtcattttcatcaatgattctagacaaaagaacattaaacacttcaaagaaacactcatttcacttggatatgatagagatatcatagaagactaagacgggccctctgggcctttctttctcacattctgtatattaccattctaagctatcgttcctttcttaacattccctaaaatatttttcacaaagttgtttacaacaagttcaaaccgtggtattattaacatatgaattgcctttgaggaattgatatggttgataaagagattaaaagagatcagtattatcgcgttaacggacatatcgttattgttacagcagtcgataatctagatgttcattatactgtacttaaatggaacaaacatatgatttgtgatcgtgctgtatttagttcagttgctaaggaaattaaactccatgggtaaaacgtatcgtcgtaaagacttgaaagttcgtgattatgactatttcggaaagcgtaaagctcctgatggtgtaagtcataaagatatggttgaaaacatttttcgctcagataaatggcgtagaatgaaaggcattgattcagaagttaaagatgagctaaatcgccaattacgcggtgaagtaagaaagttgaaaaaatcagtttacattgatgatgattttgattataatacttctcaacgagttgctaaacgtaaatcaaacgagtgttatcgttacagctgaggaaaatatgaatatcaaacgtatgctttttaagcaggggttatacactttaaatgttactccaaaaggtgatacaactaagtggtcagtaaatgactggattaaatttattgatgaaaatggtaactggaaaatttaaatgaatcctgaatctaaattatcacaacgaattgccgaatctcgtcgtcagttctttgaaaatatgatagctcaaggtattgatgacgaagtttttctaaactggttttggaatcacaaatattcaagttgctcaggagcaatattaatatcagccgcaatgatgtatgaaggctggaagggtgccaaaaagtttagctaagggcttcggccctttttggataataaaattttaacgcaattgaggataatgtatgactattcaaattaaaaacgccattaattcttatgcatatgataaagtagtttctttgctagaaaaaggcgatattgtaactcctcaaattttggataaatgggaaaaagagcttcatcagacgatgaaacagaatgatcagaagattggacgcaatactgtccgtgaattgctggttcaatatatcttgtcagaatttgatgttaaagcctttggtgtagaatcgaaagcttatcaaaagcatgaaatttccgataaaactattcgtcgcatgaaaaatcagcgcaagaaaaaatttgcagacctgaaaattactaaggcataattatgaacgaagctcttattaacgatttacgccttgctggatatgaagtaaatacaaatggcattggtttaactcaaattgaaggaaatggattcatccttgagtatgaattcaatcaatggtggttatacgccaattacggcgaattgattgaatatgttgaccaatttgattcactggatgcagctcttggagcggctaagttgatgaatgtatgaaattaattaatatttctattactatcgaaaattatggaattttctatgttgaccaatacatgaaaatttcatttttcccaaataaaactggtgttggatattgggaaagtcatgtttctgaattaaatgaaagtgaatatgttagcactcatgaaaagtttttagactttttatatcatgctgatttaactagtcattatatagatattcatgaatttaaaaagatgatggagaaagtgttccaagcatactgtttacttagataactgatatcctctgtgctttaagataggtcttcaaatattatgatataatagatctatgaattgagctaagaggtgaaaatgtcagaaactaagcctaaatataattacgtaaacaataaagagcttttacaagctattattgattggaaaacagaattagcaaataataaagaccaaaataaagtagttcgtcagaatgatactatcggattagccattatgcttattgcagaaggcttatctaaacgtttcaacttttcaggatacacccagtcctggaaacaagaaatgattgcagatggtatagaagcttctattaagggacttcataattttgatgaaacgaaatataaaaacccacatgcatatataactcaagcttgttttaatgcattcgtccaacgtattaaaaaagaacgtaaggaagttgcaaagaaatatagttacttcgttcacaatgtctatgacagtcgtgacgacgatatggttgcgttagtagatgaaacttttattcaagatatctacgataaaatgacgcattacgaagaatcaacctatagaacaccgggggctgaaaagaaaagtgttgtagacgattctcctagtttggattttttatatgaggctaacgattaacctctccggattcctggaagaaatacctgaagttgaagctattccctatttacttaaaatgtatctcagggaagttttagctcttgacattgatattgacccagaaaatccgtatgataccgcttttaaatctaatggtgtagaattaaactatcggtatcatttaacagatgatgatttttattttatattagagaaataatatgactgataaacccgaaattaacgatgaagtggaaaagcttatttcttctattgaagaaaagaaccgtcttgaagcagaaagaaaagcaaacaagttattgtctaaaaacaaacgcgaactgaaccgtctttataagcacgctcagattgcagctgaaaataataattttgctcagtacgaatatgctatcaagaaaagtcgggatattcttaaacagccatataacgatgaactcattagtattctttggaagactactagatcgcaaattgaggatatgattgatgcttacacacgtaaaattcaagcgtcttaaaattaatgcaggatttaccgaatctttgaatggtcatctttgtgtgaaaatttctgaaaaagaataccatgacagttcaattaaagaagttaatcctcctattgtaagagcagaccctaatatgaaagtgtgggttgattcttatcaagtcaaaaaatggtggcaactgtgaaagatgaacgcccagacctctgaaatagattataataaaattcgttcctctaaagaagaaatgatgagacgctttaaagagtctcatgataaagctaaagcagaaggaactataaaatataagcgtataaaatttagaagttctaatgagcctctgtatggcgtattatgcggataggagcttcggctcctatattgctttataaatttttggtaaaataaaccaaaacaaagaggatattaaatgaaagtatgtatttttatggctcgaggtcttgaaggttgtggtgtaactaaattttctcttgagcaacgtgattggtttattaaaaatggtcatgaagtaactttggtttatgctaaagataaatcatttactcgtaattgcgcgcacgattataaatcattttcaattccagttttattggcaaaagaatatgataaaacacttaagctggtaaatgattgtgatattctaattatcaattcagttcctgctacttcagttgaagaagacacaattaataactataaaaaaattattgataacattaaaccttctgttcgtgttgtagtttatcaacatgaccattcttctctttctttgcgtcgaaatttgggattagaagaaactgttcgtcgagctgatgttatttttagtcattctgataatggtgattttaataaagttctgatgaaagaatggtatccagaaacagtttctttgtttgatgatattgaagaagcaccgacagtatataactttcaacctcctatggatattgcgaaggttcgatcaacttactggaaagatgtttctgaaattaacatgaatatcaaccgttggattggtcgtacaactacatggaaaggtttttatcagatgtttgattttcacgaaaaacatcttaaacctgcaggactaagtactattatggaaggtctggaacgttctccagcattcattcctattaaagaaaaaggaattccatacgagtattatcgtcttcatcaagtagaccaaattaaaattgctcctaatttgccaacgcaaattcttgaccgttatgtaaatagcgaaatgcttgagcgcatgagtaaatccggatttggttatcagctgagtaagttggacaaaaaatatctgcagcgttctttagaatatactcatctcgagcttggcgcgtgtggaacaattccggtattttggaaatctactggcgaaaatttaaaattccgtgttgataatactccgttaatttcgcatgatagcggtatcgtttggtttgatgaaaacgacatggaatcaacatttgaacgaattaaagaactgtcatctgaccgagctctttatgaccgtgaacgtgaaaaagcttatgaatttttgtatcagcaccaagattcaagcttctgttttaaagaacagtttgacattattacaaaataaagggcttcggccctttagctttatacggagtttgatataatgatatttcttggatatgtgatactttttcttgcgttttatctattcactagagcatgttggattgggttctttaacactccagatggatttatttcaataattttgttttgcatttcaatgacggttcttgatatatgaaaattttaaatttaggtgattggcatttaggtgttaaagccgatgatgagtgggttcaatctattcagctggatggaattaaacaagcaatagaatattctaagaaaaatggaattactgtatggattcaatacggcgatatttttgatgtgcgaaaagctatcacgcataaaactatggagttcgctcgtgaaatagttcaaatgcttgatgatgctggtattaccctacatactgttgtaggaaaccatgatatgcactttaaaaatactttaactccaaatgcttctactgagcttttggctaaatatcctaatgttaaagtatatgataagcctactacagtagattttgacggatgtttgattgatttgattccttggatgtgcgaagaaaatactggtgaaattcttgaacacatcaaaacttcatctgcttctttttgtgttggtcactgggaactgaatggattttatttttataaaggaatgaaatctcacggtcttgaacctgatttccttaagacttataaagaggtgtggtctggtcacttccatactatctctgaggctgctaacgtcagatatattgggacaccatggacactaactgcaggtgacgagaatgaccctcgcgggttctgggtgtttgacacagaaacagaacgaatggaatttattccaaacaacaccacctggcatcgtcgaattcaatatccatttaagggaaaaattgactataaagattttacaaatctatcagtacgtgttatagtaactgaagtagacaaaaatctgacgaagttcgaatctgaactagaaaaagttgtgcattcattacgagttgtgtcaaagattgataactcagtcgagtcagatgatagtgaagaagttgaagttcaatctcttcagacgttgatggaagagtatattaatgcaattccagacatcactgattctgaccgtgaagcacttattcaatatgcaaatcagttatatgtagaggcaacacaatgacttttgatgaatttaaaaatgttatgatgagtcagcattttgaatgcgaagtaaaagatgatattggtcataaagatattattgaatactggtttgaaccactagaggttgaagataattgtattaaaaaggttacagtctgcactgactgggctgtatcttttaacttcaacattttagatgatgacacacctaaatcattacaagatatggctgtatcttgtattaaggatgcatactgtgaagttttcgacatttgacattaacgatgaattcgtagcaaatattgattacaccgaagaagattctagatatgttggaataatttatatcacatcaaaagcagcgcaaggtgttgtttgcatggctgaatttgatgaatactttttagattatgatgatatgatagaatggtctaaaagatacattaaaaggaatcttttgtgaagaattttaaactaaaccgagttaggtatcaaaatataatgtcagtaggtggaaatcctattgacattcaactagataaggttcaaaaaactcttattactggacgaaatggcggtggtaagtctactatgttagaagccatcacgtttgggctttttggcaagccattccgtgatgtaaagaaaggccaattaataaacagcacaaataagaaagaacttttagttgaattgtggatggaatatgatgagaaaaagtactatatcaaaagaggacaaaaaccaaacgttttcgaaatcaccgttaacggtacacgtcttaatgaatctgccagcagtaaagatttccaagcagaatttgaacagcttatcggaatgtcatatgccagtttcaagcagattgttgtccttggtacagcagggtatacccctttcatgggtttgtcgacccctgcgcgaagaaagcttgtggaagacctgctcgaggtaggaacattagctgaaatggataagcttaataaagcactaatacgtgaattaaattcacaaaaccaagtgcttgacgttaaaaaagatagtattatccaacaaattaaaatatataatgataacgttgaacgtcagaaaaaattaactggtgacaaccttactcgtcttcaaaatatgtatgatgatttggcaaaagaagctagaacgctaaaatcggaaatagaagaagctaatgaaagattagttaatattgttttagatgaagacccgactgatgcatttaataaaatcggtcaagaagcatttttaattaaatcaaaaattgactcgtataataaagtcattaatatgtatcacgaaggtggattatgcccaacctgtttgtcacaattaagttccggtgataaagttgtttctaaaattaaagataaagtttccgaatgtacgcattcatttgaacagctttcaacacatcgtgataatttaaaagttcttgttgatgaataccgagataatattaaaactcaacaatcattggcaaatgatattcgcaataaaaagcaatctttaatcacgacagtagataaagctaaaaaagttaaagcagctatagaaaaagcatcatccgagtttattgaccatgctgatgaaatagcactgcttcaagaagaacttgataaaattgttaagacaaaaactaatttagtaatggaaaaataccatagaggaattttgactgatatgctcaaagattctggtattaaaggtgctattattaaaaagtacattccattattcaataagcagattaaccattatcttaaaataatggaagcggattatgtgtttacattagatgaagaatttaatgagacaattaaatcccgcggtcgcgaagattttagttatgcttcatttagtcaaggcgaaaaagcgcgaattgatattgctcttttatttacttggcgtgatattgctgaaaaagtttcaggtgttaaaataaacacactaattcttgatgaagtttttgattcagctaccgacgttgaaggcgtaaaagctatttcaactattttagatagtttaaaaaatactaatgtttttgttatttcgcatagagaccatgacccgcaatcatatggtcagcatcttcaaatgaagaaagttggtcgatttactgtaatggtttaatttacaagagattatgctttaatttattagagtataatctctatggaggaaaaaacatggaatattcaactggacagcatctattaactattcctgaaataaaacgatatattctgagaaataatttttctaatgaagagcatatagttactgaatctatgcttaagaatgcatttaaagcagaatatacgaaaataatgtccaacagaaatgaagcttggactgttactgattattatgactaaaggtgtattatgactaaaattactgtgaattataacgttgatgtaaaagatattcagccaaaacacgtgcgttctgactcaaatccgcaaaaccaaaataaaattcgtcgagcatgggttttgtctctttctgaaaacgcaatggaaattattcaggataaaattaaatctgctccagctcgtcatgcgtattatgaagctatcgatcgtgaagtaagtgataaatggattgaactaatgcgtaaacatactgcagaatccctaaatgctggtgctaaatttattatgacttcatgtggtgaacgccttgaagatgattattgtggtaatgcagatgaacgtctaattgtcgctgctcaaattgttgcagaaacaattgcttctgattttaatcgttaattgctttattaaattagttataaaattaaatctcatttgaattgaaggaaattacatgaaactgtctaaagatactactgctctgctgaaaaatttcgctactattaactccggtattatgcttaaatcaggtcaatttattatgactcgcgcagttaatggtacaacttatgcggaagcaaatatttctgacgttattgattttgatgttgcaatttacgatttgaacggttttctcggtattctgtctctagttaacgatgatgcagaaatttcccagtcagaagatggaaatattaaaattgctgatgcccgttcaacaattttttggccagcagccgatccgagtacagtagttgctcctaataaaccaattccattcccggtagcatctgttgttactgaaattaaagctgaagaccttcaacagctgctgcgtgtatctcgtggtctgcagattgatacaattgctatcacagtaaaagaaggtaaaatcgtaattaatggttttaacaaagtagaagattctgctttgacccgcgttaaatattctttgactcttggtgattatgatggtgaaaatacatttaatttcattatcaatatggcaaatatgaaaatgcaaccaggaaattataaacttctgctctgggcaaaaggtaaacaaggtgctgctaaatttgaaggtgaacacgcgaattatgtagtagctcttgaagctgattctacccacgatttttaataaagggcttcggccctttataatttacactaaaacttgaatgaggaaattatgattactgtaaatgaaaaagaacacattcttgaacagaaatatcgtccatctactatcgatgaatgtattcttcccgcctttgataaagaaacctttaaatctattacaagtaaaggtaagattccgcatattattcttcattctccttctccaggaacaggcaaaacaactgtagcaaaagcattgtgtcatgacgtaaatgctgatatgatgtttgtgaatgggtcagattgtaaaattgatttcgttcgtggtcctttgactaattttgccagtgcagcttcatttgatggtcgtcaaaaagtaatcgttattgatgaatttgaccgttcagggttagcagagtctcagcgacatcttcgttcctttatggaagcttatagttcaaactgtagtattattattactgctaacaatattgatggtattattaaaccgcttcagtcacgctgtcgtgttattacgttcggtcaaccgaccgatgaagataaaattgaaatgatgaagcagatgattcgtcgattgactgaaatctgcaagcatgaaggaattgctatagctgatatgaaagttgtagcagctttggttaaaaagaattttcctgattttcgtaaaactattggtgagctcgatagttattcatctaaaggtgttttggatgctggtattttatcactggttactaacgatcgtggtgctattgatgatgttcttgagtctctcaaaaataaagatgttaaacagctcagagctttagcaccaaaatatgcagctgattattcgtggttcgtaggtaaacttgccgaagaaatctatacacgcgtaactccgcaaagtattattcgtatgtatgaaattgttggtgaaaataaccagtatcacggaattgcggctaatactgaattacatttagcatatcttttcattcaattagcatgcgaaatgcagtggaagtgatatgagcttatttgaagatgatattcaattaaacgagcatcaagttgcttggtattcaaaagattggacagctgtccaatctgctgctgattcttttaaggaaaaagctgaaaatgaattttttgaaataattggagctattaataataaaactaaatgctctattgttcaaaaagattattcaaaatacatggttgagaatgcattatcacaatttcctgaatgcatgccggcagtgtatgcaatgaatttaataggttctggattaagtgatgaagcccattttaattatctgatggctgctgttcctcggggtaaaagatatggtaaatgggcaaaactggttgaagattctactgaagtattgattattaagttacttgctaagcggtatcaagttaatacaaatgatgcaattaactataaatcaattcttgctaaaaatggaaaacttcctttagtattaaaagaactaaaaggtttagtcacggatgattttttaaaagaagtgactaagaacgtaaaagaacagaaacaactcaaaaaactagcattggaatggtaaaatgattgaaattactcttaaaaaacctgaagattttctgaaagtaaaagaaactttgactcgtatgggaattgctaataacaaagataaagttctgtatcagtcctgtcatattctccagaaaaaaggactatactatatcgttcattttaaagaaatgcttcgtatggatggtcgccaagttgaaatgacagaagaagatgaaattcgtcgtgattcgattgcgtggctgttagaagattggggactgattgaaatcgctccaggtcaaagaacttttatgaaagatttaactaataacttccgagttatttcttttaaacaaaaacatgaatggaaactcgttcctaaatatacgattggtaattaatatgactgctataactccgcaagaatacatggcgtctcttaaagaaaaatacaatctttctgcgacagaaacactttttgatttaccagaaaacctccaactaaaatttcaggtagaatttcaaaaattaattcacccagaacaaaaacactttactgcagtcgttaagtcaattgatgcagatggattgacaattttcacccgacaaatagtactaatttaagcaaggggcttcggccccttatttggagtataatatatcaagagcctaataactcgggctataaactaaggaatatctatgaaagaattttatatctctatcgaaacagtcggaaacaacattgttgagcgttatattgatgaaaacggaaaggagcgtactcgtgaagtagaatatcttccgactatgtttaggcattgtaaggaagagtcaaaatacaaagacatctatggtaaaaactgcgctcctcaaaaattttcatcaatgaaagatgcacgagactggatgaagcgaatggaagacatcggtctcgaagctctcggtatgaacgattttaaactcgcttatatcagtgatacatacggttcagaaattgtttatgaccgaaaatttgttcgtgtagctaactgcgacattgaggttaccggtgataaatttcctgacccaatgaaagcagaatatgaaattgatgctatcactcattatgattcaattgatgatcgtttttacgtctttgatttgttgaattcaatgtatggctcagtatcaaaatgggatgcaaaattagctgctaagcttgactgtgaaggtggtgatgaagttcctcaagaaattcttgaccgagtaatttatatgccatttgataatgagcgtgatatgctcatggaatatattaatctctgggaacagaaacgacctgctatttttactggttggaatattgagggatttgacgttccgtatatcatgaatcgtgttaaaatggttctcggcgaacgcagtatgaaacgcttttctccaatcggtcgagtaaaatctaaactaattcaaaacatgtacggtagcaaagaaatttattctattgatggcgtatctattcttgattatttagatttgtataagaaattcgcgtttactaatttgccatcattctctttggaatcagttgctcagcacgaaaccaaaaaaggtaaattaccgtacgatggtcctattaataaacttcgtgagactaatcatcaacgatacattagttataacatcattgacgtagaatcagttcaagcaattgataaaattcgtgggtttatcgatctggttttaagtatgtcttattatgctaaaatgcctttttctggcgtaatgagtcctattaaaacttgggatgctattatttttaactcactgaaaggtgaacataaggttattcctcagcaaggttcacacgttaaacaaagttttccgggtgcatttgtgtttgaacctaaaccgattgctcgtcggtatattatgagttttgacttaacttctctgtatccgagtattattcgtcaggttaacattagtcctgagactattcgtggtcagtttaaagttcatccaattcatgaatatatcgcaggaactgctcctaagccaagtgatgaatattcttgttctccgaatggatggatgtatgataagcatcaagaaggtatcattccaaaggaaatcgctaaagtatttttccagcgtaaagactggaaaaagaaaatgttcgctgaagaaatgaatgccgaagctattaaaaaaattattatgaaaggcgcagggacttgttcaactaaaccggaagttgaacgatatgttaagttcagtgatgatttcttaaatgaactaacgaattacaccgaatctgttcttaatagtttgattgaagaatgtgaaaaagctgctacacttgctaatacaaatcagctgaaccgtaaaattcttattaacagtctttatggtgctcttggtaatattcatttccgttactatgatttgcgaaatgctactgctatcacaattttcggccaagttggtattcaatggattgctcgtaaaattaatgaatatctgaataaagtgtgtggaactaatggtgaagacttcatcgcagctggtgacactgattcggtatatgtttgtgtagataaagttattgaaaaagtaggtcttgaccgctttaaagaacaaaatgatttagttgaattcatgaatcagttcggtaagaaaaagatggaaccgatgattgatgttgcatatcgtgagttatgtgattatatgaataaccgcgagcatctgatgcatatggaccgtgaagcaatttcttgccctccacttggttcaaagggtgtcggtggtttttggaaagcgaaaaagcgttatgctttgaatgtttatgatatggaagataagcgatttgctgaaccgcacttaaaaattatgggtatggaaactcaacagagttcaacaccaaaagcagtacaagaagctctcgaagaaagtattcgtcgtattctccaggaaggtgaagagtctgtccaagaatattacaagaactttgagaaagaatatcgtcaacttgactataaagttattgctgaagtaaaaactgcgaacgatatagcgaaatacgatgataaaggttggccaggatttaaatgcccgttccatattcgtggtgtgttaacttatcgtcgagctgttagcggtttaggtgtagctccaattttggatggaaataaagtaatggttcttccattacgtgaaggaaacccatttggtgataagtgtattgcttggccatcgggaacagaacttccaaaggaaattcgttctgacgtactatcttggattgactactcaactttgttccaaaaatcgtttgttaaaccgcttgcaggtatgtgtgaatcggcaggtatggactatgaagaaaaagcttcgttagacttcctgtttggctgatagaataaatctagggacctccgggtccctttttcatacaagtaatataaatctatacttgtgaaaaacagatgattctgggtctttagaattcattgaaaattttttcacaaaactgtttacatcactgttcttccatggtactatacaactatcaactgatacggatttggagaatgaaatgaaaattgtttatggttgcttagcagtttgtttagttgcattagcaacaattccatttattaatgttgaaaatgatattcagactcctattgaatctagcgttattattcatatgaatgggaaagtatcaactaaaattggtgataatcttcatatgaatactaacggatctttaggtgttcaattagggaatacatgtgtgagcactacaggtgtaattactacttgcatttgaggaaattattatgaaaatcactattttgattattgcattaggtcttactggttgtgtagctcaaggaccggtagtaaatcagtctgatgtaggaaaaattgtaaactgttcaagcaaattttataatcctaacgtcaagtgttataaagaagctccaaaacagacagtagaacaaatgcaggcgaattttgacgaagctattcgcccagatgaatctgctcaagcatatcgtaattcagatgtaattacacgcgaagaaaaaattgaaaattattgcgctgaactttgggcaaattgggctaataattaccaatggcgtacaggtaaaaatgctccgatggagtatgtggtgaattcttataattcatgcgtaaaaaatttgactaagtgaggaaaatatggaaactttagtagcaggttcaatttttatggttttagtttcaggcgtgttggctattattatatacatgcttccatggttcattgccttgatgcgtgggtcaaaatcgacagtaggaatctttttcacatctttgctgtttaactggtcaattatcggttggtttattacatttatttggtcaattgctggtgaaactaaaaagtctgcacagccaaatcaagtaattatcatcagagagaaagaatgaaaagcaaaattatagcagtgttgcttttaatcttgatggttataataagtatatactatagcgtaacagttcctgttatgattccaactcttatcatagggtggggtttattactgttacaatttaaatatgaatgcatcaattgaggtttaaatgattaatgactctatgacagttgaagaaatccgtcttcatttaggacttgcattaaaggaaaaagatttcgtaattgataaaactggtgttaaaactattgaaattattggcgcatcatttgtagcagatgaaccctttatttttggtgctcttaatgacgaatacattcagcgtgaacttgaatggtacaagtctcaaagcctgtttgttaaagatattccaggtgaaacaccaaagatttggcaacaggtagcatcttctaaaggcgaaattaactcgaattatggttgggctatttggtcagaagataactatgcccagtatgatatgtgcttagctgaacttggtcaaaatcctgattctcgacgtggtatcatgatttatactcgtccatccatgcaatttgactacaataaagatggtatgtcagatttcatgtgcacgaatacagtacaatacttgattcgtgacaagaaaatcaatgcagttgttagcatgcgctcaaatgacgtggtcttcggattccgtaatgactatgcatggcaaaaatacgtactagataaattagtatctgatttgaatgcaggcgattcaactcgtcagtataaagcaggttctattatatggaatgttggaagtcttcatgtatattcccgtcatttttacttggttgatcattggtggaatactggcgaaactcatattatgaaaaaagattataatggtgagtggaaatgattcaatttgtaattccaagctatcaacgcgtaggggcagtttctgcccttgatatgtttccgactgattatgaacctcatattgtagtgcgtgaacatgaagaaaaagcttattatgacgcttacgggtctagagctaaaattataaccattcctgatgatgtaaatggaattgccggaactcgtaaagcaattactgatatgtatgcaggtcaacgaatctggatgattgacgatgatactacgattcgtatgagctcaatgcgaaaaagagatgatcgtcgctgtgtagataaaattaatcagttaactcgtgaacagttctatgaattgattcaatacgttgaagatgccatggattgcgggtattatcatggtcatgctcgtttaccaatttttaaaattacttcgtcttggggtaattatcgtgaaaattcatatggattcacgaatacatggtatgacctcggaaaacttacgacagaacaaattgggtatggaaaaattgatttatgcgaagatatgtatgcatttctcaatttaattaatcaaggttatccgcatttggccttgttcaaatatctggttgtatctggaaaagcacaggctccaggtgggtgtagttcaattcgcagtaattctaaacataatagagcgcttgagcaaattaatagagagtttccagagcaagctcgttggaaaacatctaatattgaaaagcgaaaatcgttgggtgaagaagacgagccattaaaggttcttcgtatgtgtgtttcgcgtaaagaaaaatcagaagcatttcataagtttaatgctattcatccaatagcagttgattaatgcctaaatttattgtgttataattactttatctttaaccagtgaggaaaatataatgatgcctatggaaaaaatgaatgtctattgcagatttaaaatcccgtttgattaaagcttccacttctaaaatgactgctgaactgactacatctaaattctttaatgaaaaggatgtaattcgcacaaaaatcccaatgcttaatatcgctatttctggtgcgattgatggtggtatgcagtctggtttaactatttttgcaggtccttctaaacactttaaatcaaatatgtctttaactatggttgcagcgtatttgaacaaatatcctgacgcggtttgtctattttatgatagcgaatttggtattactccagcttatttgcgatccatgggtgttgacccggaacgagtaattcatacgccaattcagtcagttgaacaactgaaaattgatatggtgaatcagcttgaagctattgagcgtggtgaaaaagttattgttttcatcgactcaattggtaatatggcttctaagaaagaaactgaagatgccttgaatgaaaaatctgtggcagatatgactcgtgctaaatcgctgaagtcattattccgtattgttactccttattttagcattaaaaatattccatgtgttgcggttaaccatacaattgaaacaattgaaatgtttagtaaaaccgtgatgacaggtggtacaggcgtaatgtattcggctgatactgtattcattatcggtaagcgtcagattaaagatggttctgatcttcaggggtatcaatttgttctaaatgtagaaaaatctcgtaccgttaaagaaaaaagtaaattctttattgatgttaaatttgacggtggtatcgatccttattctggattgttagatatggctctagaattaggatttgtagtaaaacctaaaaatggttggtatgctcgtgaatttcttgatgaagaaaccggtgagatgattcgcgaagaaaaatcttggcgtgcaaaagataccaactgtactacattctggggtcctttatttaagcatcaaccattccgagatgctattaaacgtgcttatcaattaggtgctattgatagtaatgaaattgttgaagctgaagttgatgaattaattaactcaaaggttgaaaaatttaaatctccagaaagtaaaagtaaatcagctgctgatttagaaactgacctagatcagttaagtgatatggaagaatttaatgaataaagatgatttagatttagatctagaaattatcgatgaatccccctcttcggagggggaagaagaaagaaaagaacgtctttttaatgaatctcttaagataattaaatccgctatggaaaatgttatccaggagattgtcattaaactagaagatggttctacacatatagtgtatgtaactaaactggattgggttgatggaaaggttgtaatggactttgctgttcttgaccaagaaagaaaagctgagttagctcctcatgtagaaaaatgtattacaatgcaactacaagatgcatttaataaaaggtcaaagaaaaaatttaaattcttttaaggagtaagtgtggtagaaattattctttctcatctcatatttgatcaagcttatttttcaaaagtttggccatatatggattcagaatattttgaaagtggtccagctaaaaatacgtttaaattaattaaatctcatgtcaatgagtatcatagcgttccatctattaatgcgttaaatgttgcattagaaaatagttcatttactgaaacagaatattctggtgtaaaaacacttatttcaaaactagctgattctcctgaagaccacagctggttagtaaaagaaacagaaaaatatgttcagcaaagggcgatgtttaatgctacgtctaaaataattgaaattcaaactaatgctgagcttcctccggaaaaacgaaataagaaaatgccagatgtaggtgctattcctgacatcatgcggcaagcattatctatttcatttgatagttacgttggccatgattggatggatgactacgaagcacgttggctatcttatatgaataaagctcgtaaggttccatttagactcaaaattctgaataaaattactaaaggcggagctgagactggaacactgaacgttttaatggctggtgttaacgttggtaagtcattaggattgtgttcattagcagcagattatttgcagcttggacataatgttctttacatttccatggaaatggcagaagaagtctgtgctaagcgtattgatgctaatatgcttgatgtttctcttgatgacattgatgatggacatatttcttacgctgagtataaaggaaaaatggaaaaatggcgtgagaaatctactctcggtcgtttaattgttaaacagtatcctactggtggagcagatgctaacacattcaggtctctcttgaatgaattgaaactcaagaagaattttgttccaacaatcattattgtcgactatttgggtatttgtaaatcgtgccgcattcgagtttattcagaaaatagttacacaactgttaaagctattgcagaggaattacgtgctctggctgttgaaactgaaactgttctttggactgcagcacaggtcggtaagcaagcttgggactcttctgatgttaacatgagtgatatcgcagaatctgctggtcttccagcgacagctgattttatgctcgcggtcattgaaaccgaggagttagcagctgctgaacaacaactcattaagcaaatcaaatcacgatatggtgataagaataaatggaataagtttttaatgggtgttcaaaaaggaaaccagaaatgggtagaaattgagcaagattctactccaactgaagtgaatgaagtagcaggttcacagcagattcaggctgagcagaatcgctatcaaagaaatgaatcgactcgagctcagttagatgctttggcgaatgaattaaaattttagtttacaagctgacaggactatggtatagtagtcttgttggttaaacgaggagattgttatggaattagtaaaggtagtttttatggggtggtttaagaatgaaagcatgtttactaaagaaatcacaatgatgaaagatgacgtacagtgggctactacccaatatgctgaagttaataaagcgctagttaaagctttcattgatgacaagaaagtgtgtgaagtggattgccgaggataatatgcatatagttttatttaagcctactccgtataacgttaggaaaaatactcaattcaaagcacttatcgcagatacgtgggaattggtgttagatattccatcagaagaaagccctccatttggtcgagtggaatttattaagtttgctgtgcgccctactaagcgacagattcgtcaatgtaaaagatactttcgtaaaattgtcaagctagagaaacagtttgtaacatgcgattatgcagaagttttaaaataactgtttacttttgttggaaattgagatactatataaacataaactactgaggagattatcatgaaaaaatttatctttgctacaatttttgctttagcttcttgtgctgctcagcctgctatggcaggttatgataaagatttgtgtgaatggtctatgactgcagatcagactgaggttgaaacccagattgaagcagatattatgaatatcgttgagcgcgatcgtcctgaaatgaaagctgaagtgcaaaagcagcttaaatctggtggtgtaatgcagtataattatgttctatattgcgataaaaacttcaataataaaaatatcgtaaccgaaatcacaggcgaataatatgatttattatatgcacaaaaatccaccgtttaaatacggtaaatttcctgatgcacaatgttataatataacgcctgatgaaaataaccgtggatatcttattggcacaatttttgtaattgttaaagataacgaaatcgttgcctgggcagattttaaaggtacaacatatgatgttaatccggtgcctttcacatattacaatttaatggatttggcatacgattataattggtttaatcatgacactttggctcatattgaaggtgtaggatttgatatttcatattcggaatacactttaagccctatgagtcgagcccataaagaacctgaatatttttcatttaggaaacgtgtaaactttaaacgcagcacagagtatgtcggtggaatctttgttaaagataatcgaattattcgtattaattatcctttgagcgttagtcaaaaagatattgatgttgatttagatttcactgaaaataatattaataatattgcttctgtgtattttggtatcgatcacaaaattgtaatatgtggatatgaattaccgtttgaagaacagcctaaagtaaaagtttctattgacgatcaaatttttaatgcttttatgaatagaggttaatatgaaaacatataaagaatttatcaaagaagatatggtcgctggagattcaggtggtaatcctgaaaatatctccactggaacaacgtcaggcgttgtagtaaataaaggtcctgagcagattcctaaaaagaaaaaagaggaatctaaagaaaaagaagagtaaaatgtcatcaataccttggattgataatgagtttgcataccgtgcattagctcatttacctaaatttacacaagtaaataatagttcaacttttaaattacggtttagatgcccagtttgtggagattcaaaaaccgaccagaataaagctcgtggatggtattatggtgataataatgaaggaaatattcattgttataactgtaactatcatgcgccaatcggaatatatttaaaggagtttgaacctgatttatatcgtgagtatatctttgaaataagaaaagaaaaaggtaaaagtcgtccagtagaaaaacctaaagaacttcctaagcaacctgagaagaaaataattaaatctcttccgtcatgtgttagattagataaactgacggaagaccatccaattataaaatatgtaaaagctcgttgtattccaaaggataaatggaaatatctttggtttacaactgaatggcctaaattagttaatagcatagctccaggaacatataaaaaggaaatttctgaacctcgtcttgttattccaatttataatgctaatggaaaagctgagtcttttcaaggacgcgcattaaagaaagatgctcctcaaaaatatatcaccatcaaagcttatcctgaggcaacaaaaatttatggagtcgaacgagtcaaagatggtgatgtatatgttctagaaggacctatagattcactttttattgaaaatggtatagctattacgggtggtcaattagacctagaaattgttccatttaaagatagacgtgtgtgggtcttagataatgaacctcgtcatcctgatacaattaagcgaatgactaaattagtcaatgcaggagaaagagttatgttttgggataaatctccctggaaatcaaaagatgttaatgatatgattagaaaggaaggtgcaacccctgagcaaattatggaatatatgaaaaataatattgcccagggattaatggctaaaatgcggctatctaaatatgccaagatttaaattagcccaactaaagcaaatgctaaatctacgaatgtatcaagagtaactactggaatattaacaccatgcgcaattgcaattggtgataaaataaagttccagagtaaaattcctaccatagcagaaatagtaaaagctatacgttttttattaccttttatggcattaacaagtgccattaatttttgtaccatatgtcctccttattgctttatatatttattgtataattaatctactaatccatgaattgaaaggaaaaataatggcatactttaacgaatgttcacaactgatcgaaggcgctgataaagctcaaaatgaatactgggatattctcggtgatgaaaaagaccctctgcaagttatgcttgatatgcagaaatctttgcaagttcgtttagctaaagataaacctgaatataaccgccatcctgatgatttggctactgccggtgaagttgttgattggctacgtaatcagaaagactatattgatgatgaattccgtgaacttctgacttctctcggtggtatgagcaatggtgaaaaagatgcatctgctgtatggaaaccttggaagtcgcagcatggtgaacgtcgtgaaactctaattactgatttgtctccacaagaccagttggaaattaaatttgaaatgattgatattcttcatttcgttctgaatatgttccaaggtcttggtcttactgctgaagaaatctttaaactttactacctgaagaacgcagaaaatttcgctcgtcaagaccgaggttattaagagcttcatcttaaaagccgcgagaatttattataaataatcatgtaatttaaataaaaggagaattacatggctagtactcgcggttatgttaatattaaaacatttgagcaaaaattagatggaaataagaaaattgaaggaaaggaaatttctgtagctttccctctttattctgacgttcacaaaatttctggcgctcattaccagatattcccttcagaaaaagcagcatattctacagtatatgaagaaaatcaacgtgctgcatggattactgcaaacgaagatttatggaaagtaactggtgaataaattcaaggactccttcgggagtcctttttttcatttaaatggtttacatatcaaaatgagtatggtataatagaattatcttatagaggagagcactatgttaaatcgttggattaaaccaaatgaagatttagatattatcatttcacggcatgtaatgaagaaatatgaattgcaaccatggtctacagaagttgttgtgcattcatttatgatgtacgcagatggttctgtcgaatttaacgcagagattcggtatgattatggtgataagcaagtcgaattcaaaagaggctttttgtaatgtttatctttaattggtttaaaaatttctttacagattttttctctacaactcccggagaaggtgtagttcctatttcaaatgactacctccctttaactgtagttgaatatgtttatatgggagatggaacagtagaagcagttactatgacgtatgaagaagcccaagaatattataaaaatccttggcgctggtcaacacctactacatcatctaatgcgcagaatacacagtctaattctgattcatatgatactaatgttcctgttcatgtatggacaggtgattcatgtggaagttcttgtgattctagttgttcatctacatcttgtgattgaggaaaattatggaagcgattttgtttgaaatgtatattagcagtaataacatgtcatttgctaaagatgttccaattactgtagccgtagtgattgataagggttattgtaaccctatgtatctcgtagaaaatttcgtttcaatgccagttccagaagatgctgaaataaaacttaaaaagattggtattattgaaactgtgccaaatagtccgtttagagcaattgaagcatttactaaatccgaatacattaatgtcagcgcagaacaatataatgataaccctttatctttttattcgtatgattcagtatatgactggaaaatagataaaggaaataaatttataattgcgagtgaagatgctttatcatactttatttattatgtatggaataatttaaatcctaatttgctaaaaattcatgaatttgacgatgctcctactattgttttaggtaaaacaaatgaaagttctgaagaagatgcttgaatggttcagtagaccaaactcaatgtatattgatgatggttgggttgaacaggcaaataaagaaatgcagaacgaatccgaagaatggatgaaatcaatgattagtgctgagaaagaaaagaaattagaacgctcagcgcttaaattgatgagagacatctatggggataaatcatgaacaagaatatgacgttagaagaggctaaggataaagcaaatgaagccttagatttgcttcttaaaatcggtagtaaaatgatggaagaaaatgagaaatatatccaggaaaacaaaattcctgatggtccattagtaggcaagaggaaatcgcatgattgaagtagcaaaacattattcaatagaatttatgtctaaagaaggtaaatcagtaaatacacttgataaaaattgctcgttaattattcctttagcagaaaatccggatattttaattaaagatataaaagaaagaaaatatccagaaaatgttattctaattataaagcatactgaagatattttgcagaatacagattcaccattttcttcttctgaagctttaactattaaaggctataaaagagctcacgaatatggtctttttgacctgtttgacctgtttgaagatgataaagttaaattggcgagtcagccttctaaaagtaaaacattcattattgaagatattaaagacataaacgcatttgttaagatggtctgggctcattttgatgttggactacgttggagaatgtccgaagaagaaagaaagattgttgaagctaatcgtcactttggtttttatcgctaggaattaatatggatttatttgagatgttagaagataatcattctacgaataaccagaatgattctagtgattataagaaagagtaccgtatagtattacagaattatggaattgaagccccagatgctcttctagaagaactagcttcataccatcttgaccctccgccctgggctccctgggcaaaataattcaaaaagttgtttactttcctttctaacagtgatatgatagcttctgaagtatatggaggctatcatgattattaatcttgcagatgttgaacagttatctataaaagctgaaagtgttgattttcaatatgatatgtataaaaaggtctgtgaaaaatttactgactttgaacagtcaattctttggcaatgtatggaagctaaaaagaatgaagctcttcatcggcaattgaataaaatcgttaaaaagcatttaactaaatcaccttatcaattatatcgtggtatatcaaaatcaacagaagaacttattaaagatttacaagttggagaagtgttttcaacgaatagagtagattcatttactactagtttgctcacagcatgttctttttcttacgctgaatattccactgaaataatatttcgcttaaaaactgataaagcttttaattattctgaccacatcagcgatattatactttcttctccaaatactgagtttaagtatacatatgaagatactgatggattagattcagaacgtactgataacttaatgatgattgtacgtgaacaagaatggatgattccaattggaaagtataaaataacttctatttcaaaagaaaaattacacgattcatttggaacatttaaagtgtatgatattgaggtagttgaatgaaatactcagtaatgcaactaaaagattttaaaataaaatcaatggatgcatccgtgcgtgcttctattcgtgaagaattactttctgaagggtttaatttatctgaaattgaacttttaattcactgtattactaataagccagatgaccatacttggttaaatgaaataatcaaatctcgtttggttccaaatgataaacctctttggagaggtgttccagttgagactaagcaggcgttaaatcaaggaattgatattattacatttgataaagtcgtatcagcttcatatgataaaaatatagctctacattttgcttctggtttagaatataacacacaagttatttttgaattcaaagctcctatggtattcaatttccaggagtatgctataaaagctctacgctgtaaagaatataatccaagctttaaatttccagatagccatcgctatcgtaatatggaattagtttcagatgaacaagaagtaatgataccagctggaagtgtatttagaattgcagatagatatgagtataaaaagtattcaacatacactatctatactctcgattttgaaggatttaatctataatggaaggacttagattcattataccatgaaatttttaaagcatttttacataaagttgtttacaagccaaggtaaaaatgttatagtatagttagtcaaccgtccgtaagatgtgagaaaaatatgaaactgcataatatgtccaaaaatcaaattcgtaaaattacacgtcgtttagagcatactcaggcatctgcaaaaagacgttctaaagattttaacttagacttcaattacattaagaacattttagatcagaaagtttgcgcttactcgggagaaccttttgataatcgtattgaaggagagaaattatcattagaacgttttgataataacgttggatacattaaagggaatgttattgcagtaaagaaaaagtataatacatttcgttctgattatactttagaagagttgattgaaaagcgtgatttatttgctttgcgaattggtcgttcatctgcgaaaaaggttcataaactaaatttagatgaaaagaaatgggctaaaatcaaaaagacttataatcaaattaaagctatacagaaaaaacgtgaaaaccgaattgaacacatttctcagctttctaaatcaaaacaaacctctgacattaagctaacgattgtagcactcaaagctcgtattgatggttctcgtatagcagaaggcgctgaagttgttaaattgaacgttcttcttaaaggctcggattggaaaactgtgaaaaagttgtcagaagcagaaatgcaatatgatatgtgtgataaaattattcaaggtgtagagcggtatcaaaacttgtcttttattgataaacttaaactgaaaagaggatacccgctaaattgttcaatttttaaacttatccgaggataatatggtttatgtatacgcgatagtttatagggacaaagacggatttactgcgccagttccgcttgatgaacatcgtcctgctgtattttttgaatggaagattgctgataaagtatttaccactcttaaagagcagtatcaactagctttaggtaagggaattccaagattagttgagactccgcgtaagttttggtttaataaaatagaagttaaacatgttaagcctgacgtagacacgcaaagattatatcaacgaattctagatactgggcgtattgttagtattccaattgcaggtaatttacgatgacatttgatgatttgaccgaaggtcaaaaaagcgcctttgatactgttatgaaggctattaaagaaaagaaacatcatgtaactattaatggacctgctggtactggtaagactactcttactaagttcatcattgaagccttaatatctacgggcgaaactggcattattttagcagctcctactcatgcagctaaaaagattctttcaaaattatcagggaaagaagcgagtactattcatagtattcttaaaattaaccccgtaacatatgaagaaaatgtcctttttgaacagaaggaagtaccagatttagctaaatgcagagtattaatctgtgacgaagtgtcaatgtatgatagaaaactatttaaaattctgctttcaaccattccaccttggtgtacaataattggaataggtgataataagcaaattagacctgttgacccaggagaaaacactgcttatatcagtccattctttacgcacaaagacttttatcagtgtgaactcactgaagttaaacgtagtaatgctcctattattgatgtagctactgacgttcgtaacggtaagtggatttatgataaagttgttgacggtcatggagtacgtggatttaccggtgattccgctttacgtgattttatggtaaattatttttcaatcgttaaatcactagatgatttgtttgaaaatcgcgtaatggcatttacgaataaatctgtcgataagttaaatagcatcattcgtaaaaagatttttgaaactgataaagattttattgtcggtgaaattattgtaatgcaggaaccattaattaaaacgtataaaattgatggaaagcctgtgtcagaaattatttttaataacggacaattagttcgtattatagaagcagagtatacatcaacctttgttaaagctcgtggtgtttctggagaatacttaattcgtcattgggacttgacagtagaaacttatggcgatgatgaatactatcgtgaaaagattaaaataatttcatccgatgaagagctgtataagtttaatctatttttaggtaaaacagcagaaacttataaaaattggaataagggtggaaaagctccatggagtgatttttgggatgctaaatcacagtttagtaaagtgaaagcacttcctgcatcaacattccataaagctcagggcatgtctgtagaccgtgctttcatttatacgccttgcattcattatgcagatgctgaattggcgcagcagcttctttatgttggtgttacccgtggtcgttatgatgtgttttatgtgtgaggatatatgattagcatcaattcaaaatatttacatcgtctaatagatggtataaggaagcatactaataagcaagataatcttaatgttatggtaacaggagctgagctcctcaataagctttatcttataagtgatactatattagcaattaaacgaattgaaaaacaatcatatcatagtaatacagatacggtaattacattagatgaaagtgtctgtaaattactgattaaatttgaggaagctattcgtggaaataactaaagatcagttttatctgcttcaagataaagtgagcgaaatttatgaaattgctcatggtaaaaatcgtgaaactgtaaaaattgaatctagtaagttaatgcttcaattggaagaaattgaacgagatttaattgctctagaattcttttgtggtgaagtgaaaactgttacaatcagtgattatgttttaggcgaaattagccatctttataaggcgattattaatgattgaattaagttggtgtcagtttaaatctcttatgacaaatgttaaagctgtcattgagaaaaatccaggacctgataatgttactattcgtgaaaaagctttaaagatagtatacagtcttgaagagatgcaaaaagatattgaatctatggcaaaatttattgatgaacctattaataaagtttatatccaagattatactgtaggccaaattcgcgatttagcgaggaaagtttaatgtttgattttattatagattttgaaacaatgggaagcggtgaaaaagcagctgttattgatttggctgtaattgcttttgaccctaacccagaagtcgttgaaacattcgatgaattagtttcacgtggcattaaaatcaaatttgatttgaaaagccaaaaaggacaccgtctttttactaaaagcactatcgaatggtggaagaatcaatcccctgaagctcgaaaaaatattgcaccatcagatgaagatgtaagcactatcgacggtattgcaaaatttaatgattacatcaatgcacataatatcgatccttggaaatctcaaggctggtgccgtggaatgtcgtttgattttccaattttagtcgatctcattcgtgatattcaacgtcttaatggcgtttctgagaatgagcttgacacatttaagttagaaccatgtaagttctggaatcagcgtgatattcgtaccagaattgaagcacttctgcttgttcgtgatatgaccacatgtcctcttccaaaaggaaccttagatggattcgttgcacatgattctattcatgactgcgcgaaagacatcctgatgatgaagtatgctttgcgatacgccatgggtctcgaagatgctccgtcagaggaagagtgcgatcctctgtctcttccaacaaaacgataaaaagttgtttacttccttggatagttgtggtattataacaccatagctactgaggataataaaatgaaaatttatcgtgttgaatcatcttttagtattcttaattatgaagatgctataacaatgcgtcgaaatctttgtgttcaaataacgccgtacaggagtataatagattcatggagcgaagagtggctattacacgtgggttatgacagacctaattttatgcatcatagcgataataaaagaattcctttaccacacgaagataaactattagttaaaaacgctaatatagtaattaatactaagttcaagaaagattatgttggagtagaatatcatattccaggatggtttatagctctttatcattttgctttcgctagtgaatatgatatgatgagatggttcacacgagaagagcgtgaagaattagcttctaaaggattttatctcgctatatatgaagttcctgaagatgaagttatcattggtgggcatcaagtaatgttccgtaaatcccatgctgaacttgtagattttattgaaatgagataattatgaaatttaattataatcctgaatacacaccgaatcctgtagataaaccgtttgatatggatatagcaagcatgtacggcactcttattaaaccattagaaattaaggaaacatttatgactgctcggaccatcgaaattggcaaaatctacaaactggttgaaactgaaattaaaactactgaactaagtttgggttataaagcattgactagtgtttttggtgaaggcgagtttgtggttaaaagtttttcaaaaagtaactggcacgataagaataaagcttacgtgattcgagcacaacgcttagataatgatgaagtaattaaaactatagtctttgaagcagagcttatcctctttcaagaatgcgatcctactgaccttctaactcgtgctgtagctatcaagaccccatttatttcggtctgtggttgggtaactgaccagtggattgaagatggtgttgaacttctgaatgttgttcatgcaggtgattttagtgtagtacctcgtagtgcggtggtagctattttaaattaatagtttacaaactcttgggaccagagtataatggtcccgcggagtataaaatctttttaacaagtgagagataactatgattattaatattggtgaattagctcgtgtatctgataaatcccgttctaaagcagcaggaaaattggtcgaaattgtaagcattcagcttaagcatggtgttaaagatgaagattctgaagtaaaagttcgtatcattcctaaagatggaaagtctaaacctcagtttggttatgttcgcgcgaaatttcttgaatctgcgtttttgaaagctgttcccgctaaagtaattgaaacgattgatacttcgcatgtaggtgtagactttaagtggaaactcggtcaagctattaagtttgttgctccttatgaattcgaatttactgaagatgaggaaggggttgttcaaaaacaccgtactcgtgctatgtgcgcatacattaccgatcagtgggtagaagacggtgttaagctgtacaacgcggtatttttaggaacatacaaagtcattcctgaaagttggattaagcactatagcaaagctcgctgtgcataaagtttaaaatttttttcataaaactatatacatcagtagttgattatggtactatatcaatatcaactactgatacagaaaacaacttggagaataaaatggaaaacttaatcatcatcgaacaatctttcaatgattatggtacagcttacggttatcgtgcgataatggaagattctcgtggatgtgttatcgatattactgaatgtaaagatttactgcagcttttgaagattgttcgtaaaaattgggattgtgaaaacattaaagctcgtgttgtaacggaagaagaaactgtttttcatgatgtaaaatttgccaaaggtgctgctactcttctgaaacgcatcgctccactgttcaattaatgaggaaattgtaatgaaacgtaaaattgttcagaactgcactaatgatgaatttgaagatgtattatttgacccagatttggtagtagttcaaaaggaacacactgttaagtttactcacttgacttcggtttatgtgtatgaaaaagtcggtgataaacaaccaatttatggtgtatttcgtgaaattactgaagatggcacaacttattggaaggaaatttattaatggctattaaatttgaagttaataaatggtatcaatttaaaaataaacaagctcaagaaaattttattaaagaccatactgataacggaatctatgcgcggcgtttaggtatgcatccttttaaaattttagatgttgaccatcttgggcgtcctactaaaattgtgacatctactggcacagttggatacgcaacaggcggtgatatccttgatgaaaactttatctggctctccacgaatgaagctgggttcttcgatgaagtgggaaatccatatcaggctgccgaagagcaggaagaacctgcaccagtaactgatacatctgattttcctttaatgaaagtcactattgaaaataatgaacaggcatggtccttgtatcagatgttgaaagctcattttaaggaataattatgccgatgtatgattataaatgccaatccgaagattgtgagcatgaatatgaaaaaattaaaaagatttctgaacgagaaaatgatgtttgccctaaatgtcatcgtttgtctactcgtcgggcttctgctcctaagcatgtgaatggtggattttacgacttacttaaaggataattatgtttaaaatcggtaagaagtatcgtattcgcgaaggcgaagaaaagaaatatctaatgtctgctatttataggaatggttctattaatgctgtaatatctacaagcgaatttatcgttgaagatatgaaaggtcgcaatgttacgatgattagtacagcaactagcagaaatgctggaaaaattcttcacagtctgcggagtgaagttttaatttatgatgaagaatttgacttcttcgaagaagtccccgaaaattttgattttgaatgcactatcactatgaaatctggcgaccctctttcttttacagttaaagatgaaagaagccgtttaagaattattagtctccttcaagccattaaatttgagtgaaattatgaaatatgttaatcgttctatcgcggcattagtattagcagtatctttagtaggatgtactgatgctgataatgcaaccaaagttttatcttcaagtgggtttactaatattgaaatcactggatacaattggtttggttgctctgaaaatgatttccaacatactggatttcgtgctattggacctaccgggcagaaagtagaaggaacagtatgttctgggctgttctttaaggattcgactattcgttttaaataaaaggccttcgggcctttagctttatgattaccggagtataatattcccgaaaccaaacgaggataagtgatgattaagaatgaaattaaaattctgagcgatattgaacatatcaaaaagcgtagcggcatgtacattggttcttcagctaatgaaatgcatgagcgctttctgtttggtaaatgggaaagtgttcagtatgtacctggtcttgttaagcttattgatgaaattatcgataactcagtagatgaaggtattcgtactaagtttaaattcgcgaataaaattaatgttactattaaaaacaatcaagtaacagttgaagataacggtcgtggtattccacaagcgatggttaaaacacctaccggcgaagaaattcctggtccggtagctgcttggactattccaaaagctggtggtaacttcggtgatgataaagaacgcgtcactggtggtatgaacggtgttggttctagcttgacaaacattttttctgtgatgtttgtcggtgaaactggtgatggtcaaaataatattgtagttcgttgttcaaatggcatggaaaataaatcatgggaagatattcctggaaaatggaaaggaactcgtgttactttcattcctgattttatgtcatttgaaactaatgagctgtcccaagtttatcttgacattacactagatcgtctccagacacttgctgtagtttatcctgatattcaatttacctttaatggtaaaaaggttcagggtaattttaagaaatatgcacgccaatatgatgagcatgctattgttcaagagcaagaaaattgttctattgcggttggtcgttcaccggatggttttcgtcaattaacttacgtgaataacattcacactaagaatggtggccatcacattgattgtgttatggatgatatttgtgaagaccttattccacaaatcaaacgtaagttcaaaattgatgtaactaaagcacgtgttaaagaatgtttgactatcgttatgtttgttcgtgatatgaaaaacatgcgatttgattctcaaactaaagagcgtttgacttctccatttggtgaaattcgtagtcatattcaacttgatgctaaaaagatttcacgcgccattctaaataatgaagcaattttgatgccaattattgaagcagcattagctcgtaaattggcggcagaaaaagcagcagaaactaaagcagctaaaaaggcttctaaagctaaggttcataaacatattaaagcgaatctttgcggtaaagatgctgacactacgttgttcttaaccgagggtgattctgctatcggatatcttattgatgttcgcgataaagaacttcatggtggttatccattgcgtggtaaagttcttaatagctggggtatgtcatatgccgatatgcttaaaaacaaagaactgtttgatatttgcgcaatcactggtctagttcttggtgaaaaagctgaaaacttgaattatcgtaatattgctattatgactgatgctgaccatgatggtctaggaagcatttatccttctctgcttggattttttagtaattggccagaactgtttgaacaggggcgaattcgctttgtcaaaactcctgtaatcatcgctcaggtcggtaaaaaacaagaatggttttatacagtcgctgaatatgagagtgccaaagatgttctacctaaacatagcatccgttatattaaaggacttggctctttggaaaaatctgaatatcgtgagatgattcaaaatccagtatatgatgttgttaaacttcctgagaattggaaagagctttttgaaatgctcatgggagataatgctgaccttcgcaaagaatggatgagccagtagtttactttaccacaaggatgtggtataattaattgggcaaatgaggatattgga

SEQ ID NO: 9 - DNA, 354341 bp, Unknown
  Giant Phage
aaagtatataaaaatatttcaatgtacttaaatgaagattaccacttccaacaaacaacgattgaagatgttctattcagtactgaagaattgaaagaactatattattggtataagaaatttacaacttgacattatcgtggatttatcctacactgtaagataatgatgaatagaggataaatttatgagtttagatttacacaatgaactaaaatattatttcgatttggatatatcacatttgaaccaacacgtcaattatatgactagtactatttggtggtctgatgagtttgatgaaccaaaaatccaactttgtggtgatttgtccgttttgaggttgtatgcccttgattcggaaatgaatatcaagatcacatacataccatacacaaacaaacttattgtaaacaccctaaacccagttacagtattgaaaatttctgatttggacacgatacagtcagatgaatcactattccaacgttctttgattgatgatatgggtggtattttatatgaagatattgtacaattgaagaagatgtatagtgaattgttagaaattaaaaacacagtaattgtggggagttgatatggtaagtttacttgatattgataataccagtctagtactggtaaaaaaaggtgtaattcccaattctacaaaaattgattatgcagttattgaaacaaatattggaaatatctggtatgactccgaaagggatattgtgattagctgcgtagacagtgaccgtgctgagtgttgtagggttggtcatgacgggcaatttattttcgaattccgttactggaaagatgctaaattccatcatgagcatgtttcaattacaggtgtgtattgcaccgaagaatcgttcttcatggatagtactgttaatgattttggttcagttacatttgagtactataaaaaagtatacaacgtatccagagaagtaatgcgaatcatcagaaatgctgagggtcaagattaacatgactactatatatgacattctaggtgacttgaataaaaatatagataatgattttgttattgttggaaccacacaaaatataattcatcttccattgggtacaccagataggttaatttttaatatatacggaaaaacactgacatacctacacaatggtatggttatattggtacttgatattaaagaaaatacaatacgatatgcatatgacttcaacgtttattggtcaagaacccatagtattgatattgaggaagatgaactatttcaattgtcgttaatcgagaaaaatgtaataggagttaccgaaattggcattgttaaaaaagcattagaatatgtaaatagcaaattaaatggtgagctatgatgaaaatcgatgaaataaaaaatcattttgaaattgcattgtcttgtaaatttgatggctcttatgttcctgatccagaagagataattagaatttccacatcgttttcggaagagtacaatgttcttattgagaaaacatatgacagtactgaactcgcattttacaataagaattcacgaacaacaacatttatattattatataacacaacatcggatataatagaaattataacatgtaaaacaagcaaagatatacattatgagactatctcaaatgtgagttattgctcaactgaagaaggatactttcaggaatctcttgttaaaaatttaacagttagttattctgatttaagcactataatcaattgtgttgaaaagctaaatgatttcgttctatctatgtttgatatcacagagcaaaacccgaaggtaatcaaatgctaaatccaggacagttttttcatttacttggtattacacctataccggatttaatcagtgaaacgaaccaatatcgtgatataggaattgtatctatggaatacgattcacctgactttaaatgttacgtaacatatgatttggtagcctatgagtcagaaactgagataaaaaaaccatcatacatttttgtgttcatatataatgattatagtggtgatctactcaatgatgttcatattgacacatttgaaatatgtgataatattataacagatgattcatcatgtacatttgatttatcagaaaacagtactgaagaggcactttttcagttgagtacagttagtaacactgtactaactcttgatgacattgagaaatttaaagaacagcttgacgcagtacgtgagatgttctataatcattatccagaaatcgagttcaattaactaaaggtatcaaaatgactaaagtagttcgtaaacgccacatgatgaacatggatgaatttcgcacctttgacaaataccgtactatgtttcgtatgctgtcacagggccgtccaatcgtcattgtaacggagaattacatgtcacctgagatgatgttcggtaattatgaaaaggtcttcatgttgtacgtgaagcgtaaattgctaacgattaagaccttagctgaagctacagatgaagatatggatggtgataatacatttaccatgtgaggaaatatatggcagaaaaaccaaaagaaccattggaccgtgatgatgatttttacgacgaacgatatggggaatcagatgagtgaacatcgtgcagtacttaaaaagattttaaatgaacttggtgatgagtttaatgttactgaagaagaatatcaatgttggaagaaggattttgaactccttgctgagtatgataaagtcttcaatatgattggtgtcattagccagtacttacttggtggtggtcgagccagtgcttcaattcttgcatctgcgatcatctgtacttctcgatggtgcgatgaaaaaagtctggaagatttctaaataagatgctataatgtattatagtaccttaacaatataaaaaggattttatatgaaacctatcagagtactgtcactttttaatggaatgagcgttggatatatggcattggcagatgcaggtattccagttgaaaaatattactcatctgaaattgacaagtacgcaattgctgaatcttccgagaattttcctgatattatccagttaggtgatgtgactaagtggaaagaatgggatattgagtgggataagatagatttactcatgggaggattcccatgtcaagcctggtctgttgctggtaagcaaggtggcttgaatgatatacgtggacagttatttttggttatggttgacatttttgagcacatcaaaagtgtaaatccaaacttgcaatttctgttcgagaatgttaaaatgaaggaagatttcaaagaatacattaatagtattttaggaatcacaccagtactgataaattcccagcattatacgcctcacttcaggcagagatactactggtgcagtactgataagctttttataccacctgcattatcaaatgcccctaaacttcaagatatcattgaagatggttggtacactgacagaaccgcttcgtactgtatagatgctaactattttaagggtggtgattgtaaccagtactttaataaatcaagacgacagttggtgtttcgtgacccaacgattaatcgtcaatatctattggagaatggtaaaagaaatattgactatagacacttaagtgtagtagaatgttgtaaattacagggtattcctgtagatttctttaaagtgtctagtaagacacaagcatacaaaatgcttgggaatggatggactatgccagttatatcacacttactaagagagatattcttttgaacatgaagaactaccccacctatactgaacgtgtaatgaaatttcaacgtcagtcatcaaaggaagaattagaatttaatttgtactatcctaatattggtgatgaggtattctattgttctcatacaaagaatggaactttacttaaatccggtaaaggtattattgttgatatgattagcactttcaaaggtaaacttaatgtaatgtacaaagtacaagattcaagtactgagtgcattcatgaagtgatgcataatatacctgcatatccaaaggattttgttcagctaatatctcgaagggagaaacctatgttttattgtggttatgacaaactaaccaaacaaattattcctaatactatgggaaaatttaaaagtgatgttaaaactgaacttaataagaaattaggttcatcatgggaaactgaaaacgaattcatcgaaattcgtttgattgaagttactatactcgattaattacagatccacgctatgcgtggatttttcataggtgcatatatgatagttccttatgttaaaattattaataatatccttgattcgtgggaagatgttattactggtaaaaagaacccaatgccagtacacgcactaaccggaagactacaattcagaacgtcaaacaaaactgaaacttttaataatcatgatgttcacattactataaaatcacctgtacgtattgtaattaaaaaaaatcaagatgatgaattgacattatctattggtagtgataaaatcattttgagtaatttatccgaagaagaattctttcaacgtagtactatcatcgacatgaaagatttcacatatgaatcattggttgaactcaatgcacgtttcaacgatattcaggaacgattgcgaccaatcctccgcaaagaagaagaagcatggaatgaaagtgtaagaaagatgcaagaaatgttgaaagaaaatattaacaatctgggtaaagctacaatggaatttggtaaatcttttaaactgaacttttcaaaggatcgtaaatgaaaattgataatttgattcatgtcttagggactttacataaaatattattacatcttaacgagatgaataaactaggttataatgtccataatgtatttgaacctacatttaaatataactcaatcactggagatggtaattacataatcgaatatacatatgaaaccgatccagacttctatcctcttacgttgagaatttatccaacaaatccgataggaattcacgacatatcatcaatttcacttgatccagatggtgaaacgagtattgaatacaataatgattcaaaaccagaattttacattgatgacattaaaaagttgttcaatgatgaatatgttttccaacaaagtactgtgcatgatgttggtagtactactgggcaattttggaatacatgttattatcatatgattgaaatttgtaaattactaaaaggtgttgaataatgaaatactgcattgaagtacattacactacaggtgatactgaaaattgttatgacgttcttaatacaattgatattcaatggtcttctaaagaggaagcagttgctgctttacagtgcctaaaagagcattgggtgttttatatgaagcaagataattgctatacaaaagaacacgaaacgatcatggaaaatgctaaacaaaaagagtggtttgacccaatatcaccagaatattcattcttggttaaagttggcgatgtgactgttccattacgaacaccgtggaacggctactttgaaactcttcataatgcacgagttgtcgctgttgataaccctgaacaaatcgatttcgattcattggactggaaaaaactatgacagtactgcaccgattgaagaaggttaagcatccagttgtatatgaggactggaaacgacagaagttgctgggtgatttttattacccaaaatctaaagttcttgcgaattcaagatgtacatattgcacacataatgataaagatacagtatttgtcgaaatgggtttccatccatcaaacacaatgttcactactaaccaaacgttttacaaatttcatatacaaaaagattcatttactgttatgattataaaacatttagttgaagatctggcattcagtgaagaacgagtacctttatcattagtggatattccttataataatttagaggaaatgtacttccaacagttgacagtacaagaaaactttggtatgataggacttcaagagttagagatgattaagcaaattcgtgatatctactttaaggagtaactatgccagtacgtaacagtacttcacgctttacgcttcaacagaaagcagatcttttgaatatggcaaacaaagattctaattattactatctagtactcggtggttcagttgaaaagattgacctacgtgagtgtatgaaataacaaaaaggggactaaaatgagtctacgtgaatcatgggaacaatttaaagaagagattggttatcgtggtgtcaaaatcgaaccaatcaatcgcaccgaaagcatcaaagctagtactaatggcactacctatgatcgttatgatgaaaagtatggtttacattctaaaccaaaggatactgagtaatggtgtatactaatatttttactggtattatgcgtaagtttgttaatggtactggatatgtatccaatgacaacggtagaacatgggtaaaaaataatacgtccgaatctttagtgaaaagtcttccgtattataaagcttgacacatgaaaatggagtatgtataatactcctatattaatcaaatgaggatatacgaaatggctggtgttgataaaatttgtgaattcagtggcgattatgaaggttacgaaatgtacaagtccaagcgtaatcacattcaagttctgtcaaagtaccgtaaagaattccgaggacacaaagcaacattgtatgtttttgagaatggatattctgaagttttcacaagtggtgggtatagtacagctaacatggcacatatcaacccaaacccaactgaagatgattggaatagtggtaacgcttttcgtatttcaattttgaataaaatgaatcgttacgaccgttattgtacattctttgaaaatatttcagaatacaagcaagcattaaagaaatataatcaacgcttactaatgaattatgattacattcttcatgttcctactgtaccaggtcaggttaatggtctgtatacgaacagtacacatgatttaactgcggtgaagcgtcgcctcaaacgtatgttgggttgtggtaatttaacaatcaaggttatgcgtaatgaatcaatgtataactttttaaatgtactacactacacattgaaggataataatggaaacgattaagtttatgtttgaggtgtttgttgcattcatcttatgtgctgtatctattgctattgctttaatcccagtaatcgtttaccaagttaatggtggtacagacccaacagttgatctgtttcttcgttgcgtgggattctgcatatggttggcgatgtttatgtactatatgcatcgtgaggattgattatgtcattggaaaaagtaattatttctgaattccgaaagtacatcattgattgtgatagagatacccagcgtaagttcaatgagtatcttgacaaatatccatatttgatgtttaatccatttgaaactcaatccgatgttaatcttggattttacattgggtttacacaacgaattctacaacaatatgagatgaaacagccagaggtttgggtagaaactgattcgaatgagacgaatgttttttatctgtactcttattatgcggaaattgttagttcaatgacgctagaagggtatctattcgtcaaaacatctgatattgaaaaaatatacatagaacctgtatctttggatatggttgcccagcttccaacagttcaatatttggatgcaaatgagttgacatattcggtgtttgagtaccttaaccgagacgatttaactcaagaaattgagaatatggtttcaaaatataccacaactcttatatctaatggttcacttagaatagaactgatttacgacgatactagtactaatgcagtacgaggaactcgaattggaaaagttactatacgtgttgtccacaatgatgtagtacttggttatatttcgaaacgtggtcatgacttgtgtttgattaacacatatgttattgaacgaaaagaatggaacgatttaatgcaaaaaatcgtagacggaagtggaattcgtgatataatgtgtaatgaggtagtgacgatgaatcctgacattgactgtgatgtatatttcccagttcctggatttactctacgtaattttggcacattaaagggtacaaaatgaaaattttagaagtcttacttgaaaaggatgcatccagcactctttatgttggtaatgagttcagtcctgatccaattgatatgatgcagcgtattcaaacactgacccaatcaatttcagttaaacaacctttcctaaaagaattggaaattcactgcgataaagatatggaacaacatgataatgttatttctgatatcaaaagtctattgacaaagaatggatatgtggagtataatccttctatcgtaatcgttatccctgactttatgaaaggaacattgtaatgactaaagaagaaatgaaatctcgcctaagcgaacttaagaaagaacgaaaactagtccgtttggactgggacattcttaacaaaaaagatgagcaatcatatgctaactggagttccgataaagttcgcaatgaccgttccaaagaagacgctaaacagtttatggcattgaccaaacgtttatcttcactgaatagtgaaattacaggtcttcaaaaggaaattatttcaattcttcaagtggagatcaactcactgtatgaataaacatgaagtgattcattttgatggtaagatttatgtaccaaacaatgatagtactgaatcttattatctaatcaatgcaattatgtcagaaacacaaacatgttgccgtcagcgtccaggtgagtatgagttcagtcagaccattggttattatcgtcatactgaacttgataaatttacaatcgattctaaaaaagttattgacgttctcacgaagaacggatataatgaatccgaatcaaacgaaacagagttaccagtcgtgaaatttgttctaaaaaaataattaatttttgggacaacgctgaaaagcatgatataatgtatattatcggcagatgtaaaaatgcaaaccattcctcaatgatgagggtttttcataaaaaagaaataaaagggtattaaaaatggctaaagaaactaacgcacaagtactagatatcaccgacttcgaccgcactgtgaactacattcagttccagattcatcaagctgaagaagctctcgcagtattccacggtactggtgcaaggccaatccgttttgctcatctaattgcatggaagaaaagtctacaagaagaactttctgaactgcgtaaagcaaaccgtaagtaattgatttcccgcctcatcaatgttgatggggcttttttaataaaatacaaactgaggatatattaatgagtgttgaatattggtttttgtttatatgtcttggtacactagtactgattacattgggcttaatcttcaatacggtaatcagtggtagtaattacttcaagtcctttcaacttctaatgtcagctatgcagtacagtgacgaggcagaagaaaccactacgttgattttgaataaacttgaagctaacttactggttgctaaaatttcttcgtgtaatacaaatattgtattttatgcatcacccgtggacattaatgggtacgaaatgagttaccagccagccgttgctgaaatttttattggttctaaatattatgcatatggatatatccgaaagtattatactgaagcaaaagccgagctaacaaagaaacgaccgtcaattaagacattaaagcgtatcatcgcactagaaaagaaactacgaggtgatgtgacaaaaaatgattcacccactgtagtaaatacaaagaaaaaaaataacgtagtggagttggattaatggacgcagataaatcaaacagtattcttattgatgtacaaacgaagttattagatgttatggaaatcatcaaagatttaccacaaggatatcagtttaaagttcgtgaaatgttatcttgtgcagaaacggttgtgtctatgtacaatgatgtgcagcatggaattatccctgaaattcttcaagatggtctaaatattaacacaaagattccagcacaagagcctgaagaggttgttcagcctgaaccagaacctcctatacgtaaagtactggatctatctggtatcaaaattaacatctaaaatacattcaataggagaagtaatgagtaatcaaaaaattgacttagtagtaaaacttcaagagattcaagaactagcgaaatcccttgatgaaaaacgtgcagcagcagttgattcactgtgtgcaacaattctgactgtttttgcagattacgaaaagaaatctgattaaacattactttatacccagtctagtactgggtatttttttaaggaaataaaatgaccgaatctgaactacgtgaaatgatagatttcatttatgaaatggtgaaagataaaaataacattaatacaattacttctggtccaagacaaattggtaaccaaatgacatattctttatctttgtggataaaccagaactacaaagttgattgtttgtatttccgtcctgatattgatgcttattattttgtcaatcatgatgcattaatgaaaccaaataagcgtccagttgatgatacctttgtgacacacccattttacctggctgattccgaagaagatgagtttcaaaaaaacacaacgttaagcccaggtgaaatatgcatcccttacacactaaaagataaaatgatttacatcacagaagttatgaaaacctgctggtaagtgcaatgaaactctgatataatacaaataatgataataggaggatatatggaatttattaattttgatatttctaaggccaaagaattatttgtaagaaatgaagtttatgatatcatgttacataacggtactgtacaagaagatgttgtattgttttcgtttgatggtgaaaatctcaaaactatatataaattcagcaacttagatggtgacttttgggaaaccagtgctgttaaaatgtatagaattaaaaaggagcattaatatgccaattcgtggtgtaccagaaccattaattgaagttattaagcatgttcgcattggagatcgagaagttaatcttcgccgtaataacattttttactttaaaacttcagaaatgagttctgtacagattgtcattggtacatctattaagatcactcgcgtacttgatggtagtactgacttcgttgaatataatgtacttactaataaagtaacgcatatatataaatggagtgggtataaaactattaagtatgaatttgacttagctagaactgaagaagaacgatttatgctgagtactatcaatccagcaaactatcctgaccttgatgcatttttgctaattttaaaattgtataatgaagcaaatcagaaagccaaagattatgatagaatcatgtatgaacgccgaaaagaacgtgcacaaaaaagttatgatctgtatgatagcccatacgtgaaatatagtaaggggtcgaaatgaataacgaggttcaaattgtcattactccacctatacaaagtctggatgtatccattagtgattttttggaaaaatactatgaatggtttaatgaagattcagtaatttataaccattcattgcctgatggtttcgttgagcttattgaattaaatgccaaatcactatacttctgtgttgaatacaatgattatatgacagatgaagcatatcgttttcgttgtacattgtatcctaaccatttttccattggttataaagactatcagtactgcaccacaaactatagtgtagaggaagaatttcagtacaatttactttatcctgatttagattatacgattgcagtactgttgactaaaatcatggatttttataaagataaatataatgcagcctaagacatttgatgagtggtttaatctacactataatataaatgcagcagatatatactattttaagcttgaattgtatatatcattgcgtaacccaatcgagtactataacaacattatcaattgtgatgattttggtacatattttagtatagcagttatggataaaataagatgacacataaagaatggttggatgatctaaaattcaaacatgatcattttggcgttggtgtacgccaaggtcattatgatgtgttaaaagataaacaacttttcaaatcatttgtacttgatgaggatagtaatcactggttcatctatgagcttgcggttagagacaaaaaaattgactagtactgatatatatgctattcttttgttttaaacaggagaacaataatgctcattacgcatgtaccggaaagtattactgagattttaagtaaaattaatgttaatgaatttgaacgaacagttcgaaaacaaggtacttatcactataagcacaaagatggtgaacatcaaataagcttagatcagaattatcaaactctaacaattaaaatggttactcgctggaattttattcgtaaagatactattatctgtgattttggtaaaagactacttagaaaatgtttctctgaaacaaatggtatctatccaaacccgaatagaattttcacatatcaatacatcacagatgaagatgtacattttcaagagagtttggtatgtgataataagtactttcccgcattttcagataatttgaagttaaaagaactatataactatttcttaaacgacaatattctgtgggatgaagaattaaaacaacgacagatagaacgtgaaaagaaaaaagtctggactggttcacattggatgcaacgtaaatgacacatgaagaatggatgtctattatgaaagaacgatatgatctgtttgggaatggatttcgtgatggtcattacgatattttacgagacaaacatcagttcgatttatatgtactagatgaggatggaaatcgatggttcatatatgagcttgcatttagggattagaagatatattatgagagtaattattaatccagctaaaagttttatgacatcagtttacggtgctgatgatattatccgaatgttaccacgtattgaaattgatggaattgaagtgagaaaatacggtaatatatattatgtagtagattccaatggtaacaggatcagtgatagcttattcttcagtactaaagaaatggaacacctaattgtaattgattaacaaaaagcggcatcgcaaggtgcgaggtgaaacttccgatttccaccgctggtcgattcgatttcgacatgccgctcaaaatttacattgacaacttcagtatttttttgctataatcacttcagataaataaacctacgaggaatccaaagtgactaaagcagaacttgtagcattattggaatcatatcccgatgatgcatgtattgaagttgttcatagtgcgagacattttgacattgaagatgtagtacgttataatgataaaggtgtactcatcatggaactatgtattggtgaaatgaaaacagtacccgaatcagaaaaacgtaaaaatagtaaaccgtaaggaaaataaaatggaatctactctattagaagttattaactcattaaacgctggcgacaacgtacaagtactccttcagggataccgtgtaaaaggttcagtagttttagttaatgacaccactgttgttgtaactgaaactaacccgtttgacagtaatgaacttgctaatatccatattgatattaaaagtattattggtgttggtgtaactaaaccacaagaataacaattgttattggggattactatgcattttgaaaaattcaatacaaatcgtaacacacgcattgacgttctttatgaaacacaagactcaataagcattcgtacacgtagtggtgatgtatatcatgactgtactattggttgggaacagggaagaacacgtagtgcagaattcgataactatcgcttctaccaaggggacaccacaatctggcctgaagacgtagcagatattgcgattgaagatgaacataaagatgaatttataaaatttaatcccgaaaccgaatcataaatattggaacagactataaagatgtgatataattattagtactggtgaagtggcagagtggtttaatgcaacggtcttgaaaaccgtcgagggtgaaagtcctccgtgagttcaaatctcaccttcaccgccaaaatccgggcgtatctcaacggtcttctaaaccgtcgttaatcgagtaactggagtatgcaggttcgagtcctgtcgcctgggccaattttaattaaaggttaaaccatgacgcatgaagaatggatgaatgacattaattttagatattcgggtatcggtagttggcgaaaatatcattgggaaatcatatcagacccagcagaatacgataaacttataaatgatgaagtgtatccgtggttctttattgaaataatggtacgattatgacacatgaagaatggatgaatgacattaattttagatattcgggtatcggtaaatggctaaagtatcattgggaattcatttcagagccacatctgtatgataaacttatcaacgatccagcatatgaaatgtacttaattgaactactggtacgaatatgacacatgaagagtggatgaaacgccaaaaaataaagtggaatccttattatctaccattagattctagaatgtgggatgttatacgtgttaagtgtatgtacaaagcatatttaagtactgaactcgacgaagaagtactgatgcatatcgtgcaccgatgatgaaaaagcttgactaaatagttcagtactgtataatgtttgtatcttaacttatatggcaacttgatatgtttagtgaatatgaagaagcaataaaacacaacattgaagattcacataacttccaattttataattgggatgaactaatgaaattgtacttacagtgggttgaagatgaagaaacttctgaacaacgaactgttatgttaaacatttcgttacgtaaagaccttagttcaattagtgttgaagttatgacatcttcaacttatgcagaagaagatcataatccctatgtttcaggtacttcccctgtaccaaagactgaagaagaatattttcaaacgagtactgtacaagaaccattattcacttatgagttctataagtacttgattggtgaattcaaaaaaatgcgaattaattcttgactaaatagttcagtactgatataatgaattccacaatcagacgtatatggtgtaagttacgtcgatgcaatccagaacaagatctctggtactctaggaagtggtgaatgttaacctagacgggtttgataattggacgataggcaattattacttgactagcaggttgaaactagaggtgacagtccttcaccaaactggaaaaccggatggacttttatttaaaagggtaaggcgtggaaatatgtttacagaagttgcttttagtagcctgtaagtcccacgtcaagatagccgaaaggtaagttaaaacgggtggttataaagctgaattaacagcagcgtttaaaagcgtcaccatccatttttttttaattaaagttggtgatatgagtgttaaagacatttcaaagtatgaagagtttcttaaatcatttttgaattcagaattaacgacagaccataccaataactggtgtcaagataatcctggaattcgcattttcaatggatatggcgaatcatttcttataaatgacgatgaaattgtttttgaatcatttgaagaaataaaaaggacaaataacactttacgtgatataataaatagtataaatgctcaatacattaccttccagctaagtgctgatgaagaagatgaatttcagaaacgcacagtatatgaaaatgtgtttccacatgaattaaattctgtaatatttgaagtgttggataaggttttttctgaaaatagtacttgactaaatagttcagtactgataaaataaacaaatacggaagggtggcagagcggttgattgcactcgcctactaagcgagcaagtgttagaaataacgcttcgtgggttcaaatcccacctctttcgcaaatttcggtcccgttgcctagcgtccgaaggcagccgactcataatcggtcacagttaatgacacaccactggttagaatccagtcgggaccaccaataagactctgtagttcagcaggtagaacggttgactgttaatcaatatgtcgggggttcaaatccctccagagtcgcataaacaatgagaggtataaatggcatatttcttgattcaaagcgatgcagatgatgaattaatcgctaaaactaaaattgacattgatgattaccgaacagtactggaagctatccattactatgatgttcgacacaaaggtaatcgtgaacaaattaagaactggattgaatcgggtgagtacaaggttgaatctttatctatttcaggtgatgaaatggaagaagatggtttctttacagaaacaatgtacttaactattgaaaataatttctaggaatttaaatgaaagccaaagacctaattaaaattttacagaataatccagaagcagatattcttattcatgttacaccttgtgatgactctgctattagtaactgcctatctgctcattcatatcaagcaggggacaccgatattgaagaggatggtgaagattggtcggattcatttgatgaagatggaaaactattagtaccagtcatcattctctcttaaaataaatgtagacggtcgtattcagtactgaatcactaggggaggttgtgattcccgattcagtagcttataaagcagttccgtgtgtgcctatacattacaactagtgcacatttaaaacctagacgtaggatgtaagtattcagttctgaatagctgaaggacttattatggtacaatacagtgagaggtacttcgagtatgctcagttcacctttagctaaaatggtcactgtaggatattgttgcaacagtatccagtactactttttaattgacataacatcatttgggtgtataatgaagcgtaaacagaatcttagtaagaaactacaaccgacaatgacgaaagaacagttgtcaacatttatcaacgcagcattagataaaggtaagagtaaaaatgaaagtaagtgaagaaactgctaaacagcttgaagaactttgtagtgctgcacctatgccgacacttggcttaatcaagttgatgcgtcgaaataagcaaaattcaaaaaataaataatacagtaagatgacctcccctccatatcatgagagtatagagaattgttggttatcttactttttaaacaaatagcctcaatagcaaaattggtaatgcacacgatttgtaatcgtgagatttttccgttcgagtcggaattggggcacaaataagttcaagtctgttacataacactaaatactatataatacttatataggacatggatgttatgaaagagattatgtacaatctatacaaaaataaaaaatcaaagttatctactaaagatatcaatgaatgtaaagaattaccttcttataacacattactgttaaagtatggttttacattatctgaacttaataaagaatttcgtgaaagatattataatgaaaacccaaaactttgtttaatgtgcaacaaatcaataccactatgtaaaggatttgaagagaagaaattttgcaatcaatcttgtgctgccagttataacaacaaaggttataacagacatactggtgaaattgtcaaagatcagtactgtttatcatgtaatacatttctccctaaaggaaaaaccgataggaagtattgtgatttgaaatgtcacaaacagcaccaatatgacacttatgttcatgcctggctttcaggtaataaaattggttgcactggtaagacttgccaaattagtaattatgtgagaagatatctacatgaaacacgcggaactgcatgtgaagagtgtggatgggataaacgtcatccaacagatggtgcagtactgacagaagttgagcacattgatggtgatgctacaaataatgacctaccaaatttaaaaatcctttgccctaattgtcattcgatgacaccaacattcagagcaaggaacaagaactccgcaaggaatcgtaaataattttttaaggtacaatatgacatacaacattgttaaaatggtgaactacgtattaaaaaacaacgcatggtcactgcatgatgtacaattagaagatattggtgaagttagagttttttgctatgatgacgatttgaacgaaactactgatttgagtaaatgttttaatatttttcttggttatgaaatcaataatcatttttattcatttgatgtgtattttgaacgagttaaaatcagaattgctaatgtaaatagtgattattatgacactagaattgaattgaattttgacgatattgatactgaagaaaaattctttcagtactgtctcgtaaacgatctaaatggattgacatttgaggacattaatgctatacttaaagttcaaagattaattccagaagaggttctaaatccgtttaatgattagtttaataactcatataatgcaagatgttcgtaagaatctttatactggtaattttgatgatcctaacataaaaatattatgttatgatggattcacactggtacatccatcagaatctaataatatatacatagcatatacttctcctaatattttgtatcaatttgatttatatagtacaatggctaagataacattagatgtttctaaggagccaatttttatagcagtacgtgattttgagtacacagaagagtcattattccagtactcaatgataaatgacattggtgacttgacattagaagagataaatgttatagttggtatgtgtcgtttgattaatccataactcggagcttaatatgtttttgaatttgttatgcttatttggtcgtacattggttcttgctattattcatacacctggtattcgtaattatgtttcttatgaatttaagaaaaattaccacaacaatactgaagttcgtgcaactaagatgtgcaaagacttcaatggagatgttccaccattcaagaagtacgaggatgaataatggaatttattgttgcacctgatgaactaaaaacattcacgttccgagacaataacaattatccttatacaaatcattcattgaattcattgcatgttatatcaatcattgcatctgaatacagagacaatccatgtattgattttaaaaccactgatggtgaatatacatgggtagttccgaacgataaatacagttatcagggtgcagtggagatccgcgactcgattctaaagcaaatcgaagatggacatactcatcctaaactaaacattcagtactgaaatcgtttaaccggatagcttctagtcggtgctgaattcctccttttgtctagaagctatcactcttttaaagtataatgatatcaccctcatggttcattatattcgttaccctctaacagtatctttttattcctctttgatactgtattttagaagttgatatttttacttctactgtgttatacttaaggctgattcattatgaatcggccttttttcttgtggggattaatgtaatgaataaagaagttattagtttaattgatgagtatatcaaccaaacatatcgtttgatatttttaaatgaatttgagtccagaacaacgtattattctggtgaatatgagataatgactggatcatttcttaacggatacatggagtttttagaacaaagcgataatgttttcatttccatatctgaaaaacatggtgatgattatgttattgatgtatggcctaataaagtagagattgacactacacagaaaatcgtaattgatgtggatgaatcgttgtatgatttaactgaagatatgtacatgcaactaaatttcgtatacgacctaactaacataagttattctaatctaagtaaattattttatatttcaggtgtactacataaaaacgtacaacaaaataaaggataaacatttaaatgttgacaattgacaacataaatggtatctttgaaattgccagaaccctacgaggaagatgatatggtcaaaattttaagtgacaatgcggttgatattgtcattgatgtacttgaaaacagtaatacatttgagaagaaacacagtactgtatacttcggtaaagattgctggttgagctatatatctgataaatcgtttgtaattcgtgttgaaacgggtgatattggatttacgatacatgcggcacataccaaaactgataaacaaatcactgttattgctgacacgccaagtatctgggatagaattgatgattgtgaacactacacgtcaacattctatgatacagaagaagaacatttcatggatagtactgtcaaagaattagctattccatttaaacttatgaaagctgcaagagattttattttaaaatacaaaaaaataggagttgatgatgcaatttaatggtaaggtttctaaagtaggtttagtttttgaaaattgtgagttcattgagattgatgtaaagaatgttttatggatgcatattgctgacgtgaaaactctttgtagtcgtttttccaacggtctaactattagtactggtattggtgagttcggtattgcattgcgtagtgatactccatcggatttcatggataactctacactgttagaccgtttaaaaatgcgtgatgttacacacgtttatctttatgatactaatggtgttgaacagcgttatgtagttgaatgggctaattataaccttagtgatcaatattcagtaaaccagcgtgttcaactcacccctggtggtaatattgtgtttgttagttcaactggtaaattaatcagtgtagatgatgaaagtattgatctattcacttcatataactaatacgagataatatgaaaacaatcaaaacacatttcaaagatacatggacagaagtaagtactggtaatattcaagatattttatacagtactgaaactattcatgtctatgatgaagagacagcagccgagcagttaaaggcattgcatcgtagtgtaggtgaacacaccgagtacggtgtcaaacatactcgtgaattggtaagtactgaagatattgacacccgcactgtaaatctatcaaaagaagaaatgtttgattttattctaaacaatactttaacaattcaaccagatggatcactatacagtaaaacagatggtacacaagttagtaaaaagtacaatgtgaccatcaatgatacggtgatgtctggatatgatttggttgatgcaatcaacgagtacgtttctatgcagaggttgaaatgattaatctgatatattttacaattatttgttgcattactattgtactttgtcgtctaattcatgtatactcatatcataaagcgttgagaatcgaacaagagatttacaacgaaaaccgtgagccagagccagagaagctaccccgctcaccatatgcattgaagcgtgagatgcattcggagagtaagaagtggggttatgcaataaccaagcatggttatatctacactgctgcaaatggctattttcaaattcaccatgatctttcagttgcgattggaattttatgggaaatggaggatataggtggttatgagcgtactaaatttccaaacttacaaaatgatccaggaacttcatgaagaacatgatataattgtagatgtagaaaagaaggaagttgttatgaagaagcaagcatatcgcatcttagacaacttctatcttaaggcatttataatgaagttctgtgcagacgagcacttaacaggacgtgttatacgcaaggagtcgtagatggacatgagttcaacaattcagtacttgagcgagaattttgtcaaaatcatttcacgtggtggtatgattgtgcatcctgaaactgaagatatgtatatcattcgttttgatgcaaattcttatgatcaagtacttgttgtttcgaaattagtaggttataatgaagtcgttcagttctgctgtaccgagttcggtatctatattaaagatacagaaaccaatgagatttcacattatttttatcacacactgatgggtactaaagattttggattgaaattcaatgatttagtacaatgtcactatatgtttaaaacatacccagcatctgggaaataaggagtaacaatatgagcaacattttcttcaaaaccatttccttcaaaaaagaatcttactcttacgcttatgtagatggtaaagtactcaatatcgttctagatggtgttgatgtgcctgttcaatttaccagtcatcaagaagcgattgagggtgctcaagagcttaacagcttactaaatggtattgagaagaaacctgaagttaaatctgaccttgatttattggttgacaaaattaaaagtggtgaactattatcaattctagaccagtgtaatgaaaaattacgtggtgttgttggtgatgtacgtactacagttcaagatcgtctacttgagcaagcattcaaagaagttactaagaaaactgaagaacgtgttgaaggtatgattaaaaacattgatgacgttctcactcatatgttcaccaagccatatgaatcaagtactgattctgaagagaaacaagaagaaccagtagaacgcaccaagccatctattgttactaaagttaaacatagttttggttcactggatgatgtatttggctttacaaatgtacgtgttagtactgatgaaaagccagaagttgatgaaatgctaattggtgacatgacaactggacaactcaaaaaagagattgatacctttgttaatgaactaattagttctgaacgtgctgaaaatatgtttagcagtatttcagctaacttcggtaaagaagcaactgagcaagcagtacaggcattcaaagatttgatttacactgttgcaattgctaatccagaacaaacactggaagaagttctacgtaaaaacttcaaataagatatagataaaagaaaagccactacattgtagtggcttttttgctatgcgttataaccaacaatgactacagtacagccaaatggttcaacaacttttaatacaacattatcatctgcatctagttcaacttcacttagtacaacgtgattgtcttcagcatagacttgaacttgtgggaggattttaccatgttcactggcaggaatggacagtgtgtacatagaatcaccatcatctacccaatcactatcggtatacgtgttgtgatatggagtggtgtgtaaggttttaccaataatactcaatgagattggagcatcatcagtttggtacacagtaatattaccgctaggatctacaatgaggtctactccaatttggaataaatcaccactgtatgcttgtagagcaagatactcaccacgctcatgcacagtagctggtacagttgccatgtacataccatcggacgtgtactcaaactgagatagaagtactgaagtaacgaagtcaatatcttcgccgctttctagtatatcaaattctatagttttggtattatatatgtcagaagtgagtatgatggttcctttaccggattgagtaattggatcaactggaatactaaaaacatcatcaattatttcagtagtgaagtactctgttccatcaggaagaataacggtaatacgcattccagtcgtatcaatggctgaacctgcgttgaataggcgaccacctaccaaatcatcacctacgaacgttgggaacataaggatgttgtctatatctctatctataatcccgcattcaggggtgtacatattatatagtgtttgtgaactacctagaattgttttgtgcaaaagaaacttataaacaaacccagtaggatctgattcaagtttagcatctgagtatcctcttacgaaaaaagagttctttcttatttcacttaggatttggtcattagttttgttgtagtttaattgatatccttgtatatcctttgttgtaatttgtactttacgataaattacattacttacaggatcaagtaaatcatataatctatggcttctctgacgatagattcgaacatttttgagtttagtcccatcgttgagaattgcaccatcgactacatatccacattcaccgaacttatatcgtccagcagcagcaatcgatcttgacattcatccctccattggtataattattataacgtatttattctagataggtaaaaaagcaccttgactgagttgtgtttttgacgtatacttaaatggaatatcaataaggggattttatgagtgttgtagaaaaacgtttagtactgaaaaatggtaaaatgactgttaagctatacaaagatgaagctgattcttttatggctaaagcaattgagaaatccgaacgatataaaattcttgcacctgcaagtaaatcgccgtatgggtttaatcacgctcacagtcattttgttggtatggtatgtgaacatgcttcatttgtactttttaatgaaattgaaaactattcaggtattgcacttaacatcgatccagcgttccaaagtgatggtcgtgatggtgaatgtgatatcaaagtaaacaacttaagaattgaagtgaaaggcatcaagtacaaatcgtggacagactttggtccatgtgttagtactcgacagttaaaaaatatacagaaaaaagctgacgttattctgtgggtattgtataatgagaaaaagcaagaattcacatttgagggattcaactatgtaaaagacattagttcgattccagttgtgctaacaggtgtaccagggcgaccaatgattgaaaatcacccagtactgagtattattaaaccacttcaggagttaccattatgattcaggcaactgtatatcaagatattaatgaagaatttaattctaaaattgcatttttatcctttcccgtattgccagctattggtgctacgttgaatcttacaatctgtggctttgaaaaatactatgaagtactagatattgagtactgtgcagatgtttattcatgcaacagtgagattgctattcctgtgcaaatcgacattattgtaaaagaggtttgattatgtttaaacactttctagtaatcactgctgttgtattcagtacttcctgctttgttgcaccagtacatgcggaagaccagcgtcaaacaatcaagacgattggaacagggaaagcccaaccaaaacgtactgctgaagaatacatgcctgagatgcgtgaacgttaccgccagcaataccgtgaaaaacatgctaatgataagcctatcaaaaagcataaatggaatgtagtcaaatcgccatcgttttgtgctgggtatgctaaggttaaggatgaacagcacaacaagcagtactataaagatatgtacacattctatgattcgaggatctcggatgatgacatgatggctgctaaggttgataaagaagaatttcttcagggttatgacatgaccgatgatgacaagatcatggaatgtgttgaagtatatgaaaaatacagaggttttgaatgacacttttgctgattctaggtttattagtgtcatatttcatttttcttaacatcttctctgatgcatcacattttgcatatgcttcagctattgcaaaacacgaagggataaagaagtatattcctgcattgttattctcatatatgtaccatccaaggtactttacactaggtgtgtttgacaagtatgtatacgacgaaaaagcactcaatgaaattgaatactttgtaagaactcatgctaataacaatccaaaatcattaattaactttactgataatcgtaaacgtgttagtattagaactgacttgtatcctaccagtcactttcatctaggcgattgtagtgtgtacagggttagatacgaaaacttactgttaccaccatcacatataagatacatagaaaaatacttgttgaaatgtgttgactccaaatagtaaatggcagtataatagcttcgtaccgcaataactgacaagaggatttaacgatggacgtattagctactcaattcaaacgcaacgcagaagaacgtgaaggttacctaagtatcagtgaagtagttgaagatggattcaagcagtacattttcaacagtgcaattaaactgaagccaacaaaagattcaccggatcgcagcttcaccaagtggattgcattctgggaagagtcaccaattgcaatcgaaatgactgtcattactacagtactggaaactggttacatcaaagcaattgtagttgataagaaagttcgtactcttgatgaaatcgggacatacccagcacgtaactctaaagtatttgggtgtttagttgatggtaagtttatgattgaaaaagatgctaagaactatgtaattgataaactacaaaccagtgctactaaacaggaagtcgtagaccagaacgcagtggatgctattaaaaaggcatggggactgaaataatgttcacacttagcaatgcaaagtatctatttcttattgctattattggttgggttatggctccagtgcttaatgcactggggtttccagacggacataaacttgtaaatgtttcaggtgtaatccagggcatttcatggtattcattgattatattttctatatgtattcatacatttgcacgtgattgccgtcgtctgctttttgttaaagtattcggtactaagagatatagttttgtgtttacatttattttaataccatgtattatctatgcttttgtatttgattactatacttatctgtgggtgtgtggttctatgtttgttatgttggaatatacaagaactgttcaaaactcatatgctgatgagtattatgatcttgaagttaaacgaaaattaacggagctaaacaaatgaggggatacaataagatttgtatttttgtatttttagtttgtgcaatcaatacatttggatattactgtactgaaaacaacatttcatatggtttaaatcctttgtggtttacaattgccaatgtagcacaaattggtattgctgttatgtctgcacttatgttctgtccaattgtcactatggatactgatcatgaaaggcttggatttatccgtgatactggagacgaaccttatagtagattgattgtgttgtatccatttattgttattttaggtactaacatccaacttgggtctttatctaatagtgttacttcagcagccattacagtctttgcattcacattttttatggtacacaaatcagtactcaaatggcacatcaccaaaatggcagagaaaggtacggaaaacagttgacgtgagttattgagtcatatataattattacatcaaaactgggaaatggtaaggaacttatgaacatcgataaggtcaaagaacttagtgaagcactaattaagaacgaagaagcttgtgaagaacttcgcagtactatcaaagttgagtacgcacgtcttcaagctatgcttcaggaatccgaatgggttgtaactaaatccatcgaagctatctataaggatatcgaatcccttttcaataagaaaagcaagtttgaatctgattcatataacaaacgtaaagagttatctactgcacttggtatctaaaagtatttgacttaaccaataacatggagtacaatgtgctcctaatttaattatcagctaaaaaggaaaacattatgaaatctattctcgttgcagttaacctggttgcttccccatcttttaacttcaaacaagttgttgctgataatctgaagaagatctgtccaaacgctgaattgactttctgtgtgtttgattcagaaaaagtaactaaagttgatctaaactatcttttgaacgaagtacaaagtatttctggtgaaagtagtttggaagtactgaatacggttgctgatgactatgatgatacactggtaatttcggagaaattctaaatccaatgcttagatttatacattacttaatcagtaagttctttggttattatactattgaaggtaaagctacgcttgcacataaaatctttgtagcattatgtgtgggtgattatgacgtattgaataagcactgtaaatctaaagcatgtattgacataatggcacttcgtatctatgagtgtcagttcaatagatataatttttaccagtacagatatgataaagatgattttgatagcattaaaatgctaaagaatttatgtaataataaaaagaatatgcatatatctgaatttgttgcattgtatttttatttaaaaagttcattatacatgaatacacttcaacgcttcgatcctggaattaatgtattcaacgataaagaattttatatctatgataaatttttagataaggtttaatatgacgactgtttatattgataaacgcttgggagtattacttactgattcaaaagtgacatcaactgagcaacgttcatttttgaacctattcccgttgaagccaaaacttagttatggcgtagtttcacaaaaaacattgtatgtacacgaccgactgtttagtgcttgcggtgaggttagtgaaattaacaaagtactgagatacttgatttcacaagagactgtgataccagaccgcaaggcgagttgtcactgtgttcttgtgtcaaaagattacatcattcacttaatcgttaataagggtaagtttaccaagaagattgattatctccataatgattatacattctttatgggtagtggtggtgaatacatgcttgatgcagcagtacatgaagagtataatactcttcttgataaggtatttgataccttcatggatgttcataaccatgatatctataccgatgataatattaatgtataccgtttttgatttcattcattaggagaagtaagtgaaaaagcttgatttaaatgcaatttctgaagaagtactggatgagtgttttgctagtgaagaagtcaacgtattagaggctcttgattccgtcgaagaagaagaacatgacggtcacaagtttgagaaaccaaaaacaggtatcagcttaactcgccctaaagggataacgaatgaaatgctcatccaagcagtgcgtgatggtattgacgttgaaaagaacattgaccttttggttcgctacaactatccaatggtagtaagtgttgcacgtaagtgtacatgttttatcccatttgaagataagatttcttatggtgttgaaggtttaatgcgagcaattcatacgttcgacactaccaaaaatgttaagttcattacatatgcaacaacaactgtgtacatgacaatctataacgaaagtgcagatgctaattatctagtgcatttcccacgttatatgagtgttaataacatttatgtgaaacgttgtgtagaagagtatcaaatgaaacatggtaaatacccaactcctgagatggtgtcaaaagagactggtattgagattcaacacgttaagaattgtctaacttacaataacacttatgtagcattgaatatgaaaatgagtaatgattcagaaagtacattatctgacattgttacttcagttgaacctgattacaacttaggcgtagaaactgtcagtaccccactggtacaaagtattgcagaaatgatgagtaacctatctgccaaagaccgtgaattgattgaacgtgtacatggtattggttcttattctgaaccagaaacgctacgagaaatcattgagagtggttttgaagatgagaagggtaaggtcatgactgctcgttcttcattgcaccgtaagtactctgaagcaatggaacgacttcgtaagatggttaagacaaaaggttatgagttcgaagatttttaagattaaagggttgacttcggtcagccctttttttatgggacaaatttattaatggtgatacaatgatctatgtacaatcacaatgacagtactggtactgacaatcttcccctacttcacttgaaaatgtaaaggatagatgagcttttcattgtagcgaacagcaaaagaaacccgttagatgtgggcatagtttgaacccctcacggcaatgcggctgtataaagaaccacgttaggatagctggtggttcctcgatagacatataaggataacaccttacgaattatctaagggagagttatcgaattttgtacaggaaagttgcgtccaaaatttgagtactcacattaagtatttgattgcatagatacttaatgaagatacactatgtttaaaagtgtagaccgtcatatgaaactgaagtagagagaaacaggatgacccgctttcgcactcgttatgagtaatcttcaatgcaatagctctgataccatcagcgtcaaatttccctccgtgcgggggggaagaaaaatcccttcctcaaatcccgtcaatattaaaagtccttgacagttatgattcattcgcgtagaatacgtagtattagaagcgaacagacatctcgaagagatggatgattaaccactaaggaatatctaatgaattcagtaatctttttaattattgctctttcaccacaatctggtgtacaaatcaccccaatgaattcaatgaatcaatgcattgcagtacgtgacagtacgtatgaacaagtaaacagcgtttcacttagaacagttggtgaagaattaatgtggtgttacaatagtaatactaaagaaaaactaattgttggacaaacagaatgagttatggtgttcgttttgagattcgttctattgttatcaatgacgagaaacaagcatcgttggatgacgatatacgagaactatatctatcatgtatccgtgcaaaatctgaagcagatgcattatcacaaatgattggttttaatttctttcatggatactatttggtacgagttatcgaagttaaaaaagtcacttttgagtgtcttgctggagaaatataaaatgagcactatagatgaattgattcgccggaattcaaaatactacgaaccatcagaaattgtcggcaacattactaaatctgagttcggaccaaatactcgaaaactcattcatgtaatgtcacgtgatggctttaaatgtgattgttgtggtgaatccaatgtggtattcactttacataagcacagtactaaagaccgttataaattcagaccttatgtacttaaagggaaacgccttgtacgcatgacgttagaccataatgtactagactgtcttcagggcggtaatgataaagagaacatgactgcattgtgtgaggattgtaacgcattacgccagcataagtttgctgagtacagtgagtttaagcactggtatcataacgcagatcgttccatcgagcctgacgttaactactgcttcattgagtacattaagaatgcaaaagatacatacattctaaaatcaatgtcacctattacagtgttccctgagaatctattcagtactatgcagcgtgattttaaacgtggtatcattaatgcattcaaacatttagacaaaggtatcaagcactttgaggtgcaatgcttaaatgaaggaatgaatcgtttagtacaaatttacatgaaatcatttataggtgttgacaccgcacgtctaccagtatataattactttattgaaagcgaagaaggtgaatcacttcgtgattatggtgaaagatttaataataaagttttcactgcaatcgcaaacgagattcattactataaaccatatgtaatttaattagaggatatatcatgcaaatcatcattcttatcgtaggtatcattcttggtgtatatggtcactcctggatgaacgagaagttccctaatacccgtcctgagtattgcagtactaatgtattccagaatagtgataaaccaaaggatagtattggtaagaaactggacaaagtacttgacgtaatcaacgaataagggtaaagtatgtttaaatcaaatacaaatgttggtaagaaggttcaattacttgaggatgtatccactatgagtggaaccttcactaaaggtcacatcatgactattattgccgaaacatcccgtgggtgggatttggaagatgctgatggtaatcgcatccttgaggctggattctatggtcatcgtgaatataaaatcgttgattaaggatacaacatgactttagagattgtctttggtattgttagcttagtcgtctgtgtgggttggtttgggtatctgatgatttttagtgattaatacttgacataagatatcagtactgtataatgtttatatcaaacgaaatccactttaacaaatgataggaaatattatgtctttttctaaagaagaacgtgaccttattaaaaaagcaatttggttttatgctaatgaagggaagtgcgatgaagaaaaagcacgtgaactgtgtaatatccttgagaagaaacaagaactgaaagtgtatcgtatccgtgatttggatgaaggggatcgtattgtcctagctgaaacaaaagaagaagcagaacaaatcttcactgataaaaacgaaaatccacattggatggaagaagtctgtgaagtaaaaaaaaggtacttatatcgattgactgtactgaataatagcagtataatgtttatatcaaagggaatgcagtgaaaggaaagacagcataatcgtactcgtcactgcgtttccacccttttaaattaaatgaggaattaactatgtttcaaactaacactcaaggttttgtaatcatcgatttgaaccaaaacagcggttactggatgaaacctactgacgcatgtatgcagtttgattttttaggttacaggattagtgtaagtactggtgcttctgtactgcgtggtggttgtatcgttgaacatctggtaactgatccagaaggtcgtgagtatgaaatcgcaggttcagtacaagatgccattatgtttgtatgtcagcgtgaaatgaatagttcgaattcaaatgcactgactcatgctctttctcaagaagtggaggttcgttaatgaaatatatcgtagcagtactcgttgcatttttactcactgcatgtgacgcttcaacaaaagaacgcacaagtgattttattctccctattgaattacaagaagcaggatgtaagatttatcgtatgcaaaaggacggtgctggtgtaaccttgtatacagtttattgccctaatgcaaataccagtactggatacagcagcggtaaaacacgaatcaatacttcagtgattaatggagtacaacaatgagccttgatacaacccgtgcaacagatttattaactcgtatgaataatgaagaatttcttgctgaaataaagtacaagcttgaaaaactggcacgaagtgctgaagtaattgaagttgaaggtcacttaccaatggaccaattccatacgttcaacgaagatatggtttattatccaaatgaaatttggattgagtgggagtcatggactaacaaaactctacgcattgaaggttattgtgtgaattatgaatctgaacctggtgatgttacaaaaactctctccatttggtgtacaaaaacacatgaactcgttgaggtgaatttgaattatatgaaaggtttccgttggggtgatgttcaatgattaaaaaactattgacagttgtctttgtattctgtacaatgtttcttacagcatgtaatgatgacggcaggtttagtgcaaaagacttagttcgtcaggattgtacattcacaggtaagtcttttattaacgagtatgaaatatgtacacaatcaggtcgtatctgtggtggttgggaaaaacgtcaggagcgattgtatgtatatgaatgccctggtcatctcaacaaagtactaagcacacacaaacttgtttatgataaggttgaataatgactaccaatgaaatgatgcaggttatttgggataaaggttgtgatattaaaatcactagtactgatgttcgtgtattcaaaactgaatatatggagtacttggaccttgatacttataataatattgtatcaattgaacacaaaggtgcagtactggaaacaattgacgtagtactgaagaaagctaccgacctattaggagcggcagtgtgaataacaaagagtgggaagagtaccgtaagaagtgcagggagtttgataaagaactaactggtacagtgaatgcagtaatgtgggtatctgtaattattgcagttcttgcgttgggtgctattattattaataaattattctaaggcgaatatcatgtttactttatatctcgcagtagttctcaccaatggtgaaatcactcgtactattggtgaaggtgtatataaaacaccagaccagtgctactctgcaactcattggcctcgtgatagtggtgatgaaacacgcactgaattcaaatgcatgaaagtaaaaggtgattttgttaaccttaaagtcattgaggcgaaataatggatattaatgagttgttaatcttattgtttaatcgtggaaatgatgtaagacgttctgaatatcaagacaaaattcacattgaaactgataaatgttatggtaaaacaactcatgagattttgaagcccaatggtaaacgatatgccgatgtatgtttttatgaacgtagtgatggtagtgaaataatcagtactgaaattgtgttttatgatagatcctcggtaggttcgtatgaaatagaacttatatattgtcctggttcagaaacacacaataaacgtcagatattatatgatgtttattcacctccaggtgtagctgaatattttgttattgattacagtactgaagaaagtgtgtttcaacagagcttgattcataacttccagttgaatgacccaaatgtaccaaagttgttcaaactactcgatactatcgatgttgattttgaatttgttatgtgcattagaacttccttgatcgatgaatttatggaactacttaatatatgaatcgttactacattgtgtatgagcatgtatctgagtttaataatgtacgtggttataagaaagaagtacagaagattgatgtatttgttcgtgcattaagtccaacacatgcactatttaaattgtttgatgaagtaactaagtacaacacaccaaaaacacaacgctatattgaaaccgtacatagtgtaatactcactgaatatgatggagaatgacaaatgaatttatatctagttgaagggtcagtacaagtatccaagcaagacggagaagggtatcgtttttcacatgtagaatattttaagtacgtagtaaaggccgatggtcagtacgacgcagaaattcaggttgaagaatcattccgtaagaagaatgatattggtaaatttgaataccaagacttacaattcactgtatggcctagtattaatgactaagatgtggtggtgtcatggtgtctacaatgtctatgaatatggtagattcaaaatgagcagcacctatgccagacgtgttaatgcgaaaaaccaagttgatgctgcttgtgagattgtagagtggtatgcagagttcaatgcaattgaatatatgtacgaaatagttacaataaatgttgtacaaattgacacgtctctgatacaataactacatcaaaaaacaactgcaactgaggatactatgttagtaaatcttaatttcatcacttctcctgattgggcattgcgtggtgtttctttaaactttaaagaaactaatttcgactacattggtgattgtactttagttaatgctacatttgatcctcatcatcctttttgggctgaaattcatgatcctaatgtaaacaatagtacatctgttatgactattgtacagacgaaacatacaggtatcctcgcaggttacagaccagaacatgcgattgaacacttcactgattatgatgtagtagatgcgtatccaatgatccatgaagatggaagtttatacacgtcagaagacttccgtgctatctttaatagtactgatgacattctaccaagtggtcgtccacgccctgagtcttatcttatgcactcgtcttatggtgtagcagatacgcttgaacagattttgacgaagtacaagaaccttattgaaggtccagaagaaattgtcttgtgctatcatccagtactgaagtctgaccaaccagagagtggtgggtggcgttggcataagaatggtgagtacatcggtactaagcgtagtaaagaacgctttgagtacttgtatgatgagccagatgttgaggttgttttatgttataattttcttaaggtgaaaaagaaatgtatctagtattgagttttgtagtcgcattattgtttatgttctaccctacactagtagcaatagccactaaacgaaagctggtggatatcactactgtattcttgctaaatgtggcactcgttctagtgtctattatcattcccgtgagctttacggttattgacatggcatctgtattactattcgtcttcagttatcttatgcttattgaagaaaaacctgttgacaaatgtttgtagtactgtataatggttcttgtagtctgaaacttaacacttaaacttgaggatataaaacatgttatcagttctaatttcaattcctgctctaattctgttatgggttatggttttcgaattcttcattaaagacgaaaccgagcgtgatgagtttcgtgagttgtttatgttagactcacccattgtacgaatcttcttcgttgtagtacttatttcagtactgtcatggttagtaagttttgtattaccaattggaccatttgtttcaattatgaatttagttgagaacattgttggtattgtatggtttactaatgcattgtttgctggtaaagtttccatttggtttgatatcttgaaagataaactaactagtaagaagtaacgttcaaaaagtctctaatagtattaaatacttctgtacaaataatatgtgcagaagtattgctcgttagaggttataatgaaaaaatatataagaatgataatggtgtttgtagtattcatgctttattcaaggttcagtacagccgtacctgcttaccttgattgtatgggaaacgatggaacatggcatgtactttctaatgacccacaaaatggaaacaatattgtcgtagatgatgaggtttaccgtttcagggccgagagtttgattgggaataaaaaggtatcgacatataaatcagatgctggtataatagcaaatgtaatattgatagtggaccccaagacaaaggatggggatatttacatagtcatttatcaagattcgtcgaataaacgcgatcaggacattgataaattgaatattcattgtgaactgtaaggtataacaaatgataaacgatgtaatgctttatgtattaattactccgattcttattaactcagtaataactatttcaatggcattatttggtatagcagcaattgtttatgctgttagtactggaaagtatactttaattagtaaggttgattcatggttcgcatctgatagtgtaccatattcagctagtatgattacgattggtattctaatcgttgcatttacactgcactgtattggttttattaatacaagtattttttcagtttttattggtctatcattatatccatcactttggtacttgatttatgtaaccgatgtttggtataataactacaagcagtacaaagtgaagaaatccattttatccaaaggaaacaaatcatgaaagtaattttgttttttgtttgtatgattatatgtggtatgtcttatgcagaaccattacctggactagtctgtactgaaggtgatattaaacacatttaccaaggtgatagcgatgaccatactatcgtttatatcgacggtgaagtgtataattttgttaaagaacataccgtaggtgacattagttttacgcagtactcgaacgatactgatcccaatatgcttgcatttcttcaagttgatgtatatgaagatagtaatggcgaacagtatgttaaacttgtgatgatgcgtaaggcagcaaaacaggcaacattcggtggcttgtgtaaatatgaggactaaacatatgttgatttatcaatgtggtaacattcgtgttatgcagcatccctacttacaaatctttgatgtgcagcagtatatggaaggtgatgacccaagaacctatggtcgtaagtatgattacttcactgtaaagcagtgtcataacatcaaagaagtacgacaattagttcaagaacttcaaaataaaggttgacttcggtcagccttttttgttataattatttcatcaaatactggggattttaattatgtacgtatatcgttttgaacttaaattcagttatattgaacctaacttagatccagcaaaaacagtaggtccgttcgcacggtactcttcacgatacagtactaaaaatggatttgaccgtttgtgcatgaccacgccttcgcaattccaaccagaaccaactgaagatggaatctattcaatcaaacgtggctgggcatttggttgtcagagtttgaatgatttgtttaagttctttactatggacttgggtaaattacatcgtgcagggtttgctgtatcagtatatgaagttcctgataatcatgttgacattggtcgtagtcaggttcagtactattgtggtagtgccaatctggttcgtatcatgtcagtgagagaagcaaaggatgagtaccgccaaagtaaaagagtaatacatgaggctgtatatggataagactcaaatagaattaaaaaaatttgtatcgttttatctacccaatgacccacgttgtacacaatatgatgttgcatattacaatgcattgactacacagttaatgaagaaattcaaacagtgtttgactgtattcaatgatgatggtagacgtagatatagaatcattccaatgaatgatgaaaacgataactactttgactttgatgttgtttttagagcatacagtgatgatagaataaaattaaattatgagcaaataatgcttgacctcagtgttatctgtgttataattactcacatagccgaacttgatggtttaaaagaatggtattaacttagaggataatcatgaagcttaaattacaatacaatggttttactttgcgtaacgacactgagtttgtcaatcgttcaccaggtgctgagttgtttttgcgagagatgaacattcctttcgtcatcactactgttggtgaccgtgaagtgctacaatacgcagagcatccagttattgatgttccgtggtattctgagcatatgtacatggatatggcccgtcgctacgactgtaagttcgtagttgaaggtgataaaattacagtccaattcaaataaggtaacttaaaatgatcagtacttcagtaaatgcaagcatcgtggcagacgtagaaatggttaaagaatgtacagacgaaacccttcgcaacatgtacatcaatgatttgatttcagagtacggaagtcgtggtgttcatgagtttgttcgcctaagcggtgaattgatgaagaatcgcattcgtatgaagcttaatgtgcatccaaaagcatgggcgtttacaatgaagtacgctgaagatattgttgcgttgcgtcgcaatgatgtgtataatcgtttacacaatggtacattaaaggactaaattataggaatccgtaaaaggattcctgttcttgtttataaggtaataaaatgaaatatctagtactagtactgctattcttgagtactgttgtatgtgctaaaccaaagtatcatgtagtgtgtatcaacgagatggaaggatatactgaaacatataagaaccatattgttgaagttgtagcccaaggttcctatgggaccatcatcttccttaagaacaatgtgattgttcagtacaaaaaagatttaaattgtaaagtgactaaaaattgatctagatcaatttttcagatattctctgtaaataatagcagtacagaacattattttacggaggtgtaatatggaaactataatcatcatatgtgcgttgtttgcatttttggtaatgtggtcaccaacattcattgcatataaaatgaaaaataaaaatgcagaagcaattatgtacgtaaacttatgttgcatactaacttatggaatacttttattctttactgaatttacattaatcccagtagtagtttgttcatcaatgtttatttggttgtttctgctttatgaatctattaaaaaataaaagatatagggttggtataataccaacccttttactttatgtggggtttaattaatgaatagaaaaggtaagtttaaagtatcaaagaagaacaaaagttctagatttagacctataactttaacttttaaggctaaagaagaattaactgcacttagtaaaaagataatttcatctaagattaaagtatcatacgtaaattcggtaaaatttcaaaaggttaaaccacaagacaaactcatttcacttatatttaaacgtaatgattttgagatattagtagatgattatagagcctataatgctggattcattcatgtcacttgtaataccgaactaactgagttggaacatttgacatgtatcataagtgtagataacggtgtggtgaagtacaattttttacattttaccaatatcaataatggaatgggtgtacaatccagacctatagtacctacatgtgatgtgactaatttagcaaagctcaatgaagaagaatattttcaagaaagcattgtaactgagcatttagatgctataatagcaacttacaaagaatgcatatgggttttgaatgcgataaagcccaaattgtgtttaatgaatgtcgttcgtgatttataactggagatgtagtatgggttggattaacgttaatagcattgaactaaatgagcaagacatatttgcctttgttaatttggtagagaatattgctattaaaggtcgtctgtttagttcatcggacggtaaaaaatggatctctcttatgaacgacaatggcgagatttatgacgttatacaactacctcattgggcttataagaatacatctgatgatgtgatggctgctgttatgcgtgagtttgaaaagctacctggtggtgatattaagaacatcgtattcaatgcagaacgcatgaactacacaccagagcagcttcaacagttggcaattgctgcctatcaagctgccattaagaaacctgaatgtgtgatattaaagtacacaccggacttgaagttaacactagaagatatggattcctttatcttcagttcagaacttaaacagtactgatttgactttggaacaaccatttcatatgtgatataatcttaagtgtctgtggaaataaacagcacatgaagtataaatattaaagtaatttatctctttaaggagtatgaaatggttgataaatggaataagaaagatccatcgcatgatgtggatatttctggaattgataatgcacataagcataagtatcttgattcactaggtctactaaagcctgaccaaagtcttgcacatgatcgtccttcacgcgaaaaagctttcagtttagaatcactaggccatgaattgaatcgtgtatttgaagatcatccaatttatgtacgtgatatcattgagaaacttaaagtgactcctaaagagcacttcaaggcaacagtacatgcagcattccgtgcactacatgaagcactaaagaaaactcataaccttcgcaagattcatgatgacatcgtgaactctattgaaggcgaaaaacataagtttaaaaaataattaaaaggggttgacttcagtcagccctttgtcgtataatattttcatcaagtgatacaaaatacaaacaacgtgaggtattaaattatgcaaggtactaaattcatcattgctgccctaatcgctgctgttgtagtgggtacagtatgttattcaattgacacctatatcaatacacctagtgttgaacaaaccaaataagggatatcatggctgaaacattatcactatatgcgttagtactgttatttgtcggatttcttccctcactcattacagccattcgtgttgttaaacatgaagctgcattgattgtatgtagtattgggtcgaacattctattgtatttctttttgacaaacactattgtactgttcgctttctttatcatgattctgtgggtacttgtaattctcggattcttcatttggtcattggttgatcctaagaaaaaaacaggagaagtgaaatgaaattaattattgtaatgatgatgtttttggctttcccagtactggctactcctaatctggactgcacactgttgcgttcagatggtgacacacttgaaatcaacacatatgaactctttggtccaagtgtagtggagaatgaaaccacctacaatttcaaagctattgactttgaaggtaatgttccagtactaactacaatgactattgacaaaactactttactcggacgaatcaccacacaacgcggagaaagtaaaacattcacagcgaaagctgactgtaactactaatggtatagtacagtgaaaatagggttgacttcggtcaaccttttctttatactataaatatagtcatagagaataaacaatatgaaatctatggagagaaatcaaatgccaggtcaatttactgataaaaatggcgggaacatggcaggtcactctgataaatggagtgaacgcaatcgtcgtcaaaatagctaccaagcaggacaggggtcacgtggttcacgtaatcaagggacaggtttagctggtaaggcaaacgcagaagcaggtgaagttaagagtactgagaacatgactgagctagaaaagctacgttatgttaactcattaggtcttcttaacgcaacacagaaacaacgccttgctgatatggaacgtgctgagaaagaacaagcagttcctaaagaagaaccaaaaccagaagctcctaaagcagctaaccctgttaaagagttatctgataacttaggtaagatctttgctaacaaaccacagttgattcagggtattgtcaaagcactacaggcagttcctaaagaagaactcaaaggtaaagcacaagctgtacttgatgcaatgaaaggtaataagagcactgaacctactgaagtattcagtactatcatgcgtgcacttgaaggtacacacaaagaagattccaaagaacctgaacagggtgaagcaagtcttgatggtattcttaaaacttttgataatattggtaaagcagaccgtgctaatgcccagcaagtcaagaatgtactggctaaacttgaaaaccgtttagaaggtaaagacgataaggttaagctcgtatcagatgcagtcaacagtgcacttaaatcttatgtacaaggtgagaaaagtcgcttcgtaacagctatggatgctgcattcaacactatgaaaaagtatgaagcagaacatggtgagaaagtgacacctgatggatatctactacgtaaagatgaagaaggtgcagttgaacagaaagatgttgagcctgagcaagaagatctacctgataccgttgatatggatggatacattcatcgtcctgagatggaagagtttgggtcagataaagaaggttttgaacatgcaatggcagtatataaagcattagttaaaaatccagattatgctaaccgttttgttgacgagtttgatagtgcatggaataactacaaagagaaaggttatgatttccctgctgaagctgcattctttgaacttggtaaactattagctaaacatggaattgacgttggttcatctgattccgaaggtatggaagaagaacatcttgaaatgaccgataaatcaattcatgaacttcaaaagctaatgatgtggatatccgagattggtaaaaaagcaggtgctgatagtaaaagtatcaacaaaaacattagttggattaaagataatgttggtaacaatgctcgtaaacttcaaaaggcttgggctgatttagtaaatggtgcagatgatgttgacattgaatcaccagaagcatatgagtatgcactaactacacttgataactcattcaaagagtacgaccgtggtgttggaaaggataaaaaataaacatttaaaaggttgacttcggtcaacctttttttgtaaatattgtagagggttttataagaggtaatgcaatgtttaaatatgttttattttcacttgtattgtttactgatatagtttatagtactgaataccagtgctccattgctagacaggagtttagaaacggtgagttctataccaagtcttacactagaggattggtacatgacaataataaaactatagggttcaatgcatttgataacaaagatcgatatacgtctggaatactatctgaacgtaagtcggatatactaggtatcgagcgtgaattccggtgacacggttgcaatgtgtaatgatattgagagtactaagaaagtatatactaatggtgaaaatacttttagattccacaatcttactaccaatgaaagtttatacttctacaactgtaaagagttcattaaacctgtggataactcatgtgatatgccggagccaaaagctgctgtatgtgaggaaccacaatccaaagctgacaaagattcaaaagataagaaagacaaagctgacaaatcggataaaaaagaaaacaaaaagaaagctaaagatgataaagataaaaagtcccctaagccaaatccatttgaaaagccaaagaatgaaaagccaaaaccagacatgacatgtaaaatataaaagaaaagggttgacttcggtcggccctttttgctataatcatttcatcaactactggaggtaaacatgttaaaagttattttccgttctatcagttcattacttcttatgattagttcagtttgttatgcaaatgaagtatctgatttatttgagaagaattacccaactgcacaagagatgggtgttttaaaatgcaagctaacttcgtacaacatcatcggcagtaaacttgtactggaacatgaacgtagtacaccaatccctctagtagaagaaggcagtacctttagcttcaagtacggggtgaacgtaacatctggtgtaatgaacaatgttgatgcagagactggttcaacatggagtactagcggtaaagatgtgtttcatcgtatgcgtgaaaatggtaaactgaagtacgtatatgaaagttcattcatgaaacgtgtattcattataaaaaattgtgtaccagcataaggaacaacatcatgcgttcatttgaaaacttaatcggtaaacttcgcttacaagaaattgaagctgatgtgaaggaattatctgaaactaagagttacattcatttagatgaactgtttattaagtacggtgagattggttttaagtcattatttgtttttgtcatgaaggtgcatagtttaaagtactttgatttgagttcaaaagacggacaaccaaatctgtattacatgtattatcttaagaacatagacgaagctaatacattattcttagaatatatgtagggggtaaaaatggaacatcattttgaattaattaataaggtatcattttatatagtatcgttagtttgggtgtattacatgtttggttacattattgcattcttccgatacacgaccttgtatcaacgcatatactacgatgcaccaatttcatttttgatgttctgtgcatgtacgtgggggataattgaagcactggtatgtggatatagtacggacgaattaaatctcgtatcggtgttgacattactaacaattgctactatgatagctacagttccaatatttttgctctttaaactgcttcatcgcatcgatgagtggcgtaataaaatccctgaaaagtaaggattgataatgattttttacactaatgcgtttgcttatgccgttgcatcaatctacattgtgtacttcttatttggtggagtactgtacttctttaagtacaaaacattgtttaaccgaatgtatccaaatcatccaattgtagtagtacttttgattatttctgttgctcacatcattgtagaaacaataatgggtattagtgcagtacattacagtctaggtactattgtgattattactatgatcatcgcatacattttagtaatgggttctggtttatttgggaatgtagcaatgaaattgtataatcgaattaaaaccttacgtgataatctaccggagcgttgagatgtataatttaaatttaatatcatatatcataacaacactgtttactttctatgcctttgttggtatactcctactgtactttaaattttataaactctttgaccgtttttatccgtcattagaacatgaattcttattggtgatgtacatctgtctaacgtttatgtctacatttttcactgcatctgatggtatcattggtattaaagctgaagaaccaaatgggagtacgcttgttgcctttattctggtaggatttttcagtacttatattacctttatttcaggatgtaccgtgattgattatcttgtgaaattacgagataaaatgccaaatcgataggggattgctatgtttgcattgcgtaataaaaatacaaaagagattctatgtatctcaacagtatgggattgtgcaggaagtgaaatgattctcgaagaaggttcaggtgattgtgtttatgttgttcaggatcgtcgcgaactggaatcattacttgacgaatttaatgctggtggaaatcctaaaagtactcaattccctgagatcaggaatccagcaccaccaggctcttatgaaattctacaactgtgggagatggataagtaatgcgtcaaatgcacaaagtaaccgagctaaacaagcgtctgattaaacagtcaatgtttgaggataaagagtcttactataacttcaaacgtgctgtagaggctgctatccacattcagaagcttaaagatagtggatgtattattctcgaaaatggttctgacgttgttactgatgacttcagtgtagcgtttgatgtttcacctgatggttcgctatcaatgccacgcttagggactggtgacatgactgtgtgggtaggtttcactatggggaatgtaccaggcacggtgtatgtagatgatgctgagttgaaagaaagcttcaaaaacttatcgcatcttgaaccacaatacgcacatgaaatgaatttattttgagttgacaaactcattcagtactgtataatgtttatcaaggggatgaacttctcatccccacaatcgaggaattgtcatgattacttttaagaaaactgctaaccacatccatgagatctacattaacggtcacaaagctggccttcttcgtttactcgcccatcatccgaatattaccgtatctgataatgaacctaaagattggcgtgtatttttctttggaaagtacagtgattttcaagtatcaaacctgaagaacattcgttcagtatgcacgttaactgaaattaaagaaaagttaaccaaagcattgaaaactaatccagatagtgttcttccacctgataactttgtagagaaaggatatgccttagctcatttcaaagatggtactattcaatctatcagtactgaatatgaatatcaatggactgagtacttcacttatggatcgcgtaatacattgatggcttcacgtagtaaattggaagaagtactgactcgtatgaatgaacgcgagcgtcaattttatgacaaaccagaaatgtggagttcaacttacattgaccgtattgactatgttattatgactccaatctttgacactgcttactatgattctttgaaataaggataacttatatgaaactacgtactcgtaatcgactgatggatgcactgtaccatgaacagctttcactgaatgaagtgaagcgtcagttaatgtacacatatctgttacccgctcgcattgcaaaacaacgtgctaaagaattgctgaaagaagcaatcgagtactgggaatctgattcgtactaattgtcacgttaattaagtgaggcgataaatgaaaattttattagttctaatactactaattgttttaccatttacgttagtatctcctgaacttgcatggaatgtgtttgtgtacttactatgtactattgtagtaaatggtatcttgttcttagttctattcataaatggaataggacacggtggaggatggaccagtactgctgatattgtacataaaaccactatgtctttatttgtagtgtggaatttattctggacttggtttgtgttcttctaattaaaaaatatgaatatagatttgaaaggtgcaacacgaactgtcatactcattggggaatatgctatcaagattccaacctttaaaagttggaagctattcttaacagggatgatagctaacctcaatgaacgttcttggatgcagtactccaagcgtagtgatagtggtatctgccctacgttgtggtcatcatgtactggactagtaactgtacagaaacgttgtaagccagtacaacataggggtttattttgggtggagttgtgtgctttagcattggattcagagttgagtactgacttcttctattcagatgcgaagccagaaaactttgggtatctgtgtggtaagttggttaaacttgattatggagattaatatgtacgcattgtataataaagaaaagaaacgatttgctaaggttgaaatttcgattgatacatttgacatgttggagtactgtattgtaacggatttatatgctaacttgtattacgttcttgatgacgtatcagtactgcaacgattgcttgagaattccaaaagccaatgccagggcatctatgatggttcatcttatgaaacacctgagtgttcctacggctatctggacgggtatgagattgtgaagttggggattgttgaataaatggattaaacaatgaagaagtgtatcacgtgtaatattgaaaaagacattagtgaatttggtataagaagtgatactgggaaacatagaaatacatgcaaaggttgtagtaatattactagtaagaaaaccagaaataaaaaactgatgtcaaaaaacttgaagaaatcaaaagaaaaaataaagatttcatgaccagagttaaatcattttatggttgtagtatttgtatgatgaagtatccagaatgtttagactttcaccatcttgaccctaataccaaagaacatacaccaagttctatgttcagtaaaagtcgagaatctatcaaagatgaaattcgaaagtgtgtaattctttgttctaatcaccatcgcatggtacatgctggtagattatgtttaattgaaagaaaaaagggttgacttcggtcagccctttttgctataatcatttcatcgaaacgagaggatgaatacatgacacgcattaacttagtacacgttaaagaacttgctgaccaacatctgatggctgaatatcgtgaactcccacgtgtgtttggtgctgtacaaaaacatgttcaagcacgtaagcgagtccgtgatttcaaaattaacagtacttacctgttaggttcaggtcatgtaacattcttctacaacaagttattgtacttacagaagcgtcatattgatattgttaacgaatgtttgcgtcgtggtatgaagattcaaaacactgaagtaaacgacattagcggattccctgctgagttttgtaatgactacgtaccatcggagtcagagattaaaatgtctcgtgagcgtttgattgagaagctacagatgaagcctacgtggtataaatttactgacgttgaacgcccacagtatgttaaagatatgcaggacgtaagtagtaatatagaatctagtactgatatgttcgacgaaattgaagaacaaatcaaagatgaaatgaataattattaaaggaaagggttgacttcggtcagccctttttgctataattattttatcgaaatgagaggtaatacatgaaactatcttttatacgtttagcagaattcttcggtactgatattattactttacaacaaattgcagacaatacttcattaagtacacaagaagtacttgacttagatgtaattcagtgcgataatacttccattgatttcaaagaaggtcttgtcgaaaaagataagattcaagctaagattaatggtgctggacgggttcagtactgaaaaggagtattgagtaatgtttgaaaagtactatttaaatgaagatggtgagaaagtttatattattgaagaattatgtactaaatttgagtacatgaaaatagaaaatgttcctgtaaaaaataaaaaaactatcgttagaattgatgaaattaaactaaaagccattgaaaaagaagatactatttttggcttacagatatcaaacagtaatcaattttttggactagaaaagaataaagttctgtttagatgtggaacatgcagcactttatgtacaagttcactgaaaagttatcttatctctggtggatgtcagatatgtggtaagaagaaaagaaaagagtaccaaaacactatcaaaatatctgaatctgatgcattaaaagaaatacaaaaagagtgtaaacgcgaatctattacatttatcaaatttgaaggtgaatttactacaaaattcaaatctaaattttggtacaaatgtaaaaacaaccatactcgtttatgtgagaacatttatgattttcttaatggtcataattgtgttgaatgtcgtgattacagctcggcaaaaaagattcgtttgaatattctagtagtcaaatatgaaatagataaaagaaacgcagtttgtaataatacctttattggatttgtgggaggtgtttatgaaacatcaaaaacaaaattacatttacagtgtaatgattgtaataacccattttatccatcatatcataactatatatcatctgagtcttcatgtcctacctgttcatcaggtgagagtaagaatttagttgatattgatggtatgttagaagatgataccataaaagagaaacgcttcattgattgtaagttcaaaaagccattaccttttgatcgatttattgaaagtaaacgaatccttctggaatatgatggagtacaacattttcaatcaatcaaattatggggcggcaaaagtgcttttgaacaaagaaagataaaagacgcaataaaaactgagtacgccatcaacaacggttacaacttcattaggattgcatactatgaagaccacgttgcagtactgaaatcttttctaaaacttatcgaagataatccagaaaagcaaatcgtacagatctatggtgatgtacaaatcttagacaagaaataacaatacaaaagggttgacttcggtcagccctttttgctataattatttcatcaactgatgaggataacgaaatgaccagagaagcacgtagcattcaaatccagaaaaacttcaactccatgatggttgctcttgagtgtttgctcgatgatagcagtactgtaaaaagtatggttgtcagcggtgcacctggtgttggtaagacttacaccctgtcacaacgcctccagaaagctcatgacgcagcagaatggaacgtagccactatcagtggtaagatgactactcttgctctgtatgaagttctgtacaagaatcgtcacagcactaacgtattagtactggatgatatggacagcatctttgattcagaagacggtatgaacctgctcaaagcagtactggacagcggtaaacgtactgtgtcttacatgactagctctaagtacttaactaccaacggtatccctaacagctttgattttaacggtcgtatcgtattcattactaacaaagatttagcactgaatgctaaagctaaaaccaaaatgtctgctcactatgctgctcttatgtctcgctctgtgtatgttgacttacagatccagactaaaagcgatatcatgattcacattgaaaacgtaatgaacaagaccaacatcctgtcaactaaaggtgttaatagtaatggtagcaaagcaatcctgaattggatgctgaaacatgaagatgcacttcgtgctccttcactgcgtatgcctctgttgatttcagcagtatacaacaacaatccgtatgattgggaagagcagtgcgaaaacttgttccttgagaaaatttaattacatgtattgacagtactaccatagtgtagtactataacttaatattcaccaccggagatacgatatgcttgagttttttaattcagatacaatgcttagtattactttgatttatctgtttggttttttcttttatcatgcactagttgtagtactatggtattttaaaaagaaaatcgttttcaaactgtatcctgatggaaacatttcactacttcttttcactattatccaaggtatgtttgcaattgttggtcttatcgcacacttaatttattgtgctaatccacagttgaactcaatatcacaatatattgtattccttggattactaatttgggtgctgatatacttgtttaatctcatcattaatggtagagcaaaaattcgtggggacttctaatgtttgaatcttatcttgagtttttaaagagtagttctgttgcacattcaattgcagggattattctaacaggttatgtaacattttgggtagttatgtttctaggatggtattttaaacgacaattctataagcgtaatggtgaagattttatgaattctttcattaatcaatcgttgtttgcatcaacattgatagcatgtattgtagcaacactcacaggaaaggtactgccagcattctccgcagtttacggtacattgggtatgatatgtgtagttttttacttgaccattaaactttgttgtgttatgattgaacttcgaaacaagataccggaggaatgatggaatattttttacacttactgccgtggtatatgaaagttagtactatgtactatattcttagtgctggattctactttctgatgtggttcttcaaacgaccaatttcagtattcatctctgataacatgctgcaattaaaattacacgcatggtttggtatggcgatgttcatgcctattattcactactcaatgattagtagagggttccgttccaatggtgaaccaattatattagtattctattggggttcaactattgcatatgtaagtttgttgttgttcccagtcgttcataaattacgtgctaaagttcctgatgcgaggtactaatggatatcgtaacattgatttacacgctttattcattctattttattatgtgttgggttggatttttatttgtattgaagatgtttgattatgttgaaaaacagataaaagaattttgtattccttttattgggtcaaccataattagtattacttgtttgtattatttggtatgtgatccacctgttaatacagcaatgattgacttcatgttattaccaacaactgttatttttttatgtagtctgatgccaccgattagtcgtgggctaaccgaatttagacgcaatcaaaagcgtaaacgagggatgtgatggaaattgcacttattatattaactgctatgttgtttattagtacaattgttattattggcaagttcttctgtgtatccttcttggaaaccgtatacgatgaaattgctgatgactatgaattacatgcaggattttttactacgtattggattagtttattactacttatcactgtatggattttacatatattcaaatggggtatggtagatggtgatccagtactggcaattatctgtgtagtgtttggtctactcggtggtgctgtccataatctgatggtaatttggcaaaccgtacaatatgtattagttccacattttcagagaatgcaccaaagcatcaaataccgcaaacgaggataacatgaataatattgaattatcttttattggtcaattaatggtaatggcgtatacatttatcttctcactgaatgcattcgtgtgcattgggaagtacttccataagcgaccattatcaaatatatatgatgtaatacaaaggagatatagtccagcatatactgtgttgagtacagcattcaattttggttttattctaatgctggtttcattattaacatcgagttcgaattttataacatttggtattatggtatgttcactaacactgtgtgtggttattctctgtgcatccgttgagttgctggcatggatgtataataagatttccgaaatccatgagcgtttaggtaagaggaactaaaatgagttatcgtgaaatattttcgatcattactattattgtgtttagtttaggttctttgatttggttattgtattacttctgtgtaaccccagtatataatatgctaaattcagtaaaatctgacgttggtattgtttcttttattatcttcatggcatattatatgctaagtatcacaggtttggttttggttgttatctttgaccttgggccgaatcaagatggtatggagatgtgggaattgataacgatgtttgcatgtatgatacctgcatttggtgtatgtgctggtgtattttatgggttgtgtaaaggtgtgaactacttaaaaaatatccacaatactattcgtaaaaaacgtatgttataataaaaaatccagtactattatagtactggattaattttaattatctaagccaccaattacactgaactgtgtggtaacgtctgaactattatctatgtaagttcttctaccaacataatatagttgtccttttgcttgaataaaagttacggtccctgtattgaatgttgtaatatcattgtatgtaatgtcaggtggtagtgctgctgataacgcagtaactttacttaatgcagcactagtactaccatttataccagcagcaatactaccagtaccatagaacttattatctttaccaatgaatacgttggctgatgcttgtgtagctgatgttattgccttaccaatttggaatgcggttcctatggtgtatggtgtgctcctggctgcgtctatgctttgtgtatatccatcccctagctgaccattaactttgtcaccacatgagtatagagtaccattgaggctgtatatgatcccacggttagagaagctaacagcttctgcattagtccatactggtgcggtgtatgagtttacacgactagcggtagttcctagacctagtataccatatgtgttatcaccacatccaaaccattgcccagaactgttttgatagaacactgaacgttctgttgattccatgcgtacagcatccacagcaccacttttaacgaacgaagtggatgaggatgtagtaccagtacccaatgcaccataagtgtttgtaccaatcgcatagattgatcctagtggtgtcataacacgtatacagttatatcccaattgaactttacattcaaataggttgtcccatatttcaggaacagcagaaaataaatttgtaatttcgaaccatgatgttgtcgaaccagttaatcctatactgcttttgtttcctaaaatgaaaacagttttgtccttcttaattatccatgatgatagaaagcctatctcacagctatgaacatttgattcgatttgggtaatataatacttaacggtgttatcacccataaatgccgcagcaccggatgcaaaaaggtttccagtttgtttatttaaaatgtagttattgtttccatatacactaacatcataagaactttcttgtttttcgttcccataatcaaataacaatacgaaaggtaacatgataaaatctccttgtgttatactttatttaatcattttataatgtacaattttacagcgatttaattgaggtactcatgaataaaagaagtaagttctatcaagaatatttcactaaacagaaacgattcacaaaaaaatactttacatcatcccaccgaccagttgcaagttacaaacgtcctaatactaactatcttactggtggcaagtttagtgcaaagttcgaattacttatgcgtgaaaagaatatcaagatgcattacgcagagacaagaaaaaactcatcaattatttgttctgattttcttgagtacggttgcttaacttataaattcaatgatgtatatttgtatattgatgttgattgtaacagtactcgtatgtttgagatttcaattcacccaaatcacaaccgttatataaacattaacttggttgacaaagtactgattggtatatctagtactgatggtggtggatttgaatttattgcttcaaaatatgatgaagatttcgtactttacccagtacttgatgatgtgaaagatattctcaattcattaaaaggaagtcaatacaaattatctgaagaacagctatttcagtactcacttattcatgatgatatcgagatatacttagagtgtgcgagaatcttggagtatctttataatgaactaacaacaactggtaaagtgactgcattcacattatataatatgtaaaagaaaagccagtacatagtactggcattatattaaactggtggagaattatatggctcaaatttataagttgtcgtagcagtaccagaaatggcgttgttagctagtatgtacatagtcctgtagtcgattaccactacagtaatactaccaccaaaagcatagtctgttatgttattagtgttgaatggtaaattagatgaactggtccatgtattagctgttgtgctatttgtaccattggaataacctacactagatgcaccagttgtccataagtttccatcattgaacaaggagacatggttagttgtatatgatttattaggtatagaactatcaattggtgtattccaaactttagtaacccatgttgtaactgctgtattattagtaacgccattacctaatgaaccatttattggtatacctcttatataagaagtgttagtactagggtcaacatatccaaatgtatatgtatcaaatgcaaattgaaaacaatcagaactcggtaatgtgtacagtaatgtatatgaagacgtgtttattgatgaatttgtaccgttcacgccttggtataaaataccactagccaatatttgattattattttttgttatagtgttcattgatggatatgttttcacatcacgcacatcattagtcacatatgtttgtgttgataatgcaacgttactaccattacctataacccctgtatttgcaccactcccataaagtgaaccatcattcaaaagaaccattgtaacattaccatttcccgtaattgttttaatattactaacatccaccgcagcaaatacagttgatgttaaatcagtgaaacgtgtataatgtgatgttgtgccattgattggtgtcgcaaaaccagaatacaaaattctattttctttggtaataaggaatgtgccagtaacaccatttgaatggatatcaacaatattatcgcccattaatacccaatcacttacgaatgttgttgtaccagtacccaacccatatgttgtattgtatccacgtccatacactctaccatcactgagtaatgttaccacacattgaccaccaccaccaaggataactttttggatagtactctttatttttatattcccgaacttaaccattcttgcaaaaggtaacataattccctcctttattctttatactatatttaataaaaaagaaaagccagtactggagtactggcattatcttaaaattgtggcagttgatattcagttaaggtccatgttccagtaactgttccattcggggacatccctgtgtagtataatttgtccccagcgtatacaaataatgcattgtcattggcagcaaccatcgaagtttctggatcaaatactacagaaattggtaattgtgattgaacaaatactgacgcattggtagttgaattgttaccgagttgtccatagctattataccctgttccaaaaatacgacttccatttctatacaataatcccctaggattttgtgaatatgttggtataaattcaaaatcagaaacactagttaactgtaaataagtactttgtggtgttaatgatgtcttattagtattagatagtacaccatttcctaattgtccgtgaattttgtgaccctagtccatatagtggataagtattatctacattaagaactatacccaacatattgttatgtgaaattatatcaacggggtactgtcctgtaggaaaactatactttgtccaagtcgttaatgtggctgtcgctgccccagttaacaaagtgccagtgctggtcgaaccacatcgccatgctgaattatcattcttaattatccaagtcggactattgaaaaatgaactaacctttttaacattaatattaacctgtgtaaatgatgtaagttgagatgaactactacccaactcataggttgaattatcacctattgcataaagaatactatcatttgttagtaaaaacatattacgaacattaggatatatatccttgatattatccatatcaaaacctgaaaaataagacgtacactcaacaaatgtagtactttgaactgaacttgatgtacctgtccaaaggttccaacctgcataataaaatttattatcattagtctgaactaagctatatgaagcgttccttgtgcaccagaaatttttcacattttgcattaagcgaacccatttggtttgtgtagtagtatttccaagtccgaaaataccagcattgtttccacctataccccacaaatcaccactcttatacagaagcatcaatgtattgttggtaaacgccgatggtgcttgcatcttaattacaatatctgcacgttcaggtgctttatttccgtacttaaccattcttgcaaaaggtaacatatttcctcctttattcattatactatatttaatcaaaaagaaaagccagtatcaagtactagctttttgatatacatacttcatatacccaatttaattggctcatattgaaatagtgtaggattggagtcagggtagttcaccacttctgttcctggatatgcaccatacccgttgaatgcacctgaaccatatactataccatctgtgctaattaatgtagaataattgtttcccataccaactgacagtactgtcattgttgttgtgccttctggtaggtttataacctgctctctgaaactattaccagaagctgaaggaacactaaatcctaatctaccattgctactattagtagatccagttgcataacgtgtacctgtactcaaatcctgaatccaacacgatggtccttgaccctctggatcagtccagtatctaaaattggcactatcgtatgtaaagggaagaactgctaatctgttagttccctgggaacctgaagtatacgtcaatccatacaatggagtaagcaaaccacgaacatataatccagtactcttggtgtataacaatgagccgcctgaaccatctgaattgattgaaaggatatcagtatcacctatatttgtgaataccttaatatcagatgaaccagatgttaatccataattaccacagaaccaagctgtgttatcgttctttaacacaacaactgtttcataagaacaggttaccacatctttacagttagtattgatttgtacaaattcacctatcttcccagttagggtattattaccaaactgtccacggttatttgaacccatagcatataatattccagtactattcaatgcgtatattgtactagttcctggtgtttcacggcgtgtaattgcaatctttgtaatagttcctaatgtgctgaaaaatgaactcacatcaacgaaacttgtttgtgaacctaatccaaattgacttaaattccccgccgccatatatgttccatcattcattagacatatagtatatgctggatgacagtatatcatagctacatttataagaactaagctaggtactccaccaacaatagaagtgtttggtataccaaaacgatactcattgtttgacccatatgcaaataacttaccatcagtagttaaaaataaatgccctaatccataagtattaatcttgcggataccagcgggtggtggtatcttattcccgtacttaaccattcttgcaaaaggtaacatatttccctcctttattcattatattatatttaatacaaataagaaagccagtatcaagtactggcatataatctaagcagaaggcatgtcgttcatcttaataaatgaaaattgtgtaccagtagatgtagtttgatccgtgaaataggaattactcccagcccagtacaattcattattgactatacaatatataacagaactcgaactctgtgaaaacacacgacttatatttgtaggttcagttccagtactgaactgaactccccccaactgtgaacttggtattacagtagttggtctacctaaaccattaacacccgcaccaccaccacatgtatataccccagtactatcagttgatatattaacataaccatttccggcattttcaaatagtatttcacttggaaccacaccaaatccggtaagatctattttcctgaatgtagtgtaaaccgtagaaccaccaacgcctctaccgccataatcattagaaccagccatatagatactatacccagaacttcctaaacataataactgtacgttgtcatataatatttgcatagatataacgttatcaggaatactcaattcagtaaatgtagttaaagaagaacttccaagattactaccaaccgatgttccacatctgtagtacttaccgccctttatataatggaacgatgaaccacctaacttatgtgctcctatttcacttacaccagtatctataagaataggagatacaactttgttattaacacctaactctgatctactgttcataccgaacccatataaactaccatctttcatcaatattagtgaactacctgacgtacccgctgacgtaaattctatattttttatttgcaatacgtcaatacctacaaataatgaagttacttcagtccagttaacatatgaaccactagcaccaaaatatccacccatgtatagtcctgcacaatataacttattatcaacagtctttattaatgtaccggatacacacgcccaaaaatcatcaacttcatagggtacatgtacccatccacctaatacatcattagcatcccctgtacctaatttgtagttagaaccagaaccacgcatatacatattacctgtactataaagtaatccaacatgtaattgactaccatccaatttttttatttcaggtaaagttggtttaatattcccgtacttaaccattctagcaaaaggtaacataattcctcctttattcattatactatatttaatacaaaaaagaaagaccagtatcaagtactggcctatattttagactgaattgttaggataatatctcccacgtccccatattattcgcacagcaccaccaccagcagccgtataagaagaattatcccatatactaccaccaccaccatacctcttaccagcaccaccactaccagcaccaccattatatgaaccaccgtagctaccaccaataccattagcaccttgaacaatgataccagtaccaccacccgtaccaatgaacgaggtactatagaatgtaccacccccaccgccgccgccagcaccattttcaccagtgattgcatctccgttaccacctttaccagtgtagccaccagcaccaccaccaatgactgcaccaccacttacaccagtgttgccaccattaccaccaccatcattaatagcgttagcagcttttccacctagtccaccaaccgtatatgcaccagtgaagctaacacatagtttttcagttccacggtataaaccgttttcaactgctgtagtagtgttggaatgtgtaagagaaacacttaagtactcaccaccagaaactggaatattattacgccacgataagccgccaccagcaccacgttgaccacccggtgaaataacacatactgatatttcggtaacgccagcaggaactgtaaattgtgttgttcctattgccgtgattaattgttcaccatgtggcttatattcaattttattcccgtacttaaccattctagcaaaaggtaacataattccctcctttattcattatactatatttaatacaaaaaagaaaagccagtatcaagtactggcataatgtcaataagtattccaaggtaatggtgtcttcctaaatccatacctggttgtgctcgcaccatcaccagcaatgtatctacctataccacattggtataactctgtactactacatatagcaccacctatagtaccactactccactgaattatattagaatatgttattggtaaatcactacatttagtatatacagcaacggtagaagtaccactaataccaccaaacatacttcggttagcaccagtgtaatatataccatctggactcataaatgcagaggtgtaagttgtactgcaatccactggacttcttattgtattaagatcgcctgggtatgtcctgacaccaaaggtgtatacattaccatcagttgtaataccattacctaactgtccactgttttgtccaccacatgtaagcaacaatgcagaaccagaaacaattgcagtagcattatacgaagtacccattgcaatagaagcaccagacaatagttttggagtaacaatagctgttgtattaccctggcctaattcaccattgatatttcgtccccatgcgtatatagaagtcgtatccaatcgacatagtactgaaccataactaaacgtatatcgcatgtcaattaccgcagaaggcaaattaaccttagttgcaacactaataacaccaccagtaacaccactgtttgcgttcatgttacgaccatatgcatataaagaaccatctgaagttttaatatgcatcataccatctgtacaatataatgcatctatactctccaccgcaaccggacccatactggtagttatatcggtccacccaagcgtggtagtgctagaaattaagttatttccggcgtatagtattctattattattagtaactacaactgtatatctggcagtaacaccaattaatcgaacatcagtatatatcttagaccacgcacctaatgaattgatgtttgcatccaaaaagcccaactgcccatctgtattgtatccgataccccatacatcacctgcactgtccaataacacttcatgtgaaaatccaatcttaaaatcttttattgtaggaactaccggaactggtgcaatattcccgtacttaaccattctagcaaaaggtaacataattcccctcctttattcattatactatatttaatacaaaaagaaaagccagtactcaagtactggcattatgttattttggtaaatcaattttagtaaagactgcaacatcctcgcttgcccctgggatggcgtaataagaaccagtactatatacatctccgtcttttgttaatattgaagttaaaccatcactaaaaagaacatcactaatctcactaactgaaacaggtaattgtaaattagtagcactatatattgcaccagtttgagaattgtttaatcctaaaccacggtttgaacctacacccttctgatatgtactagtaattataatttgtgtagcagtatttaatgcaggtgaattcgtcataaacaacggagaactattcggcaaagtacttgcaggaactgcacgaaatgtagttgtatctgaactaagaaagtttggcgtttgaccacatacgaaatatgatgtaccattatagtaattaaatgcattaccacctatagctgcatctattactccagtactacgtaatccccacgtgttaatttgtgttcggttccccgtgccatgctgacccctgtcattccacccagtactatataatctattatctacactaatatacatactgtcatttgcattcgtcattactttacgcacattagtagcacattgagttaatgtgtaaattgatgatgaaccaatacctaaagcaccacgatatccattagcccctgcaccatagagtactgaactagtgctaagtacaaatattaaaccatacgaacatactatatcagcaatttcatttaccgctaagacactcgtaaaccacgcagtcctatcaactaatacagtactgtaagaagtcccagtagaagacgaaaaccaataagtctcaccagtagtccatatagtattgtcactcttaataacaacaactgtacgatcaccagcaaaaaaattagtaactcctgtactcactaatctccatgaagatacagtgttggtattaccattaccagattcaccaccttgatttcttcctatgtaatataaatcatgtgaatcagtcaataagaattgaccctgtgtggaagcaccaactttaattatatttttaggaccaggtgcaacattcccatactccaacatccttacaaaaggtaacatatttctctccttaatttaataatgcccctggcaaatccactttgacgaattgtgcatatgctgaggaattttgatcaaagtttggtcccaatccataaaatgagctaatgccgtcttcatttgtgtatatgatataaacgttctttacatcatttccgcatataaatcgaatgtctttcgtttgtgttcccgctggaacattacgaaggttcacaacgccattacttgcattgttatcagccgacgcaattggtaattgattttgaccatattgaccacgcatattttttgcatctaaaccaaacacagtatctgataccgcaccaactttcaaaaatgaaccaaaactattattgaatgactttggaaatgtaccactataaacacttctcccatctgataataccgctgaactgaatttcccgctattcgatatggcaaattcattgtaaggaagtgtacccattttggtatatacagaatatgaattagtggaagtattatcaataatcttattaccattatatccaataccatactggtatccgtctgcatcttgaactatacacaaaggaccacttggggtttgtgtcaacgaaacaacacgttcaacttgtatatcaccaaatgtatttcttcgccatgttctatctattatagtactagtattacccaaagataatgccacactatataatagattgttttcagtaaaaatggcaacataatatgcgtggttaataacttgcttcatcccagcatcaataacttcctgtggaatatgatcagtaacatccaaccaatcaaggttagatgatgcaatatctggagtactgaatttgtcaaatctagttgagccacaaactagcactctatcatcatttgtcaaagccactgtgctagtctgcatattagaactgaatgatttaacattactaatgttagacttgtaccaacccttatcagcagcacccaccgtgaatccggttcccattgatccacttgtacttgtaccataagcccacatctcaccactatatgttagtgccatacagtggcttccatttgcttggaaatcctttataccagtgggagcaaccactgtattcccataatcaaacattctaacaaaaggtaacataactaaaatctccatataataattataatgtatttacaaaaaaataccagtacgtatttcagtactggtatcatttatggtaaaatgatagattgtaacgaactcatacccaatgctggaacactagcctgtggtgctggagaattcaattttggtgatgaaaccgcatatgacattcctgaacccaaatctggatcaaaaactacagcacaataattcccactatatataagtccattcttgtatccttgtgcactttgaatgcatttcgtgaacgtaccaatatctgtagtggcatttattaagttcctcccacgataaccgcaggtgtatatgaaattatcatcgcctatgtacatactagaatccccagaagaactacatagatacgacatataagcacgcatgtttttaggagcaactgacaatgtacctgcatagaatttattattcgaacccgtaatatcaccatcacccaatgcaccaaaacttccccagccagtaccgtaatatctcttatcactcaaaaatataatacagttgttattacacatcttgatttgatatatcaatgaaggatcaaccccagggaatgattcagtgaatgttagaacagccggatcagtactagcattacattgatgatatgtattagtaccagcggacaagattgttccattagctaacagaattctcgcagtaccagtaccagcagtacaagcaactgcacttcctgcacttccggtgtatatttgtctgaaagtaaagaaaccaacagttttacttccctgcccactccaaccagtattatcaactccacacgcccatactgaaccatcttgcatgatcatcattacaccaaagcgttctattgaaatataaacaatcttcgttgtatcaactgcactaaatctagaagttatatcagtccaaacctttacactcaccgccgtcgcaccgaaagtaggatcttcccctgctatcattatcctaccattgttagtcagatacattgtctgactataaccagtactacaaaacttaacactatcagtctctggaacttttaaccactcgttgtaacgtgttacgttagtgttattacctaactgataatagttattcatcccagatacatataacacaccatcctttattaaactataagtcgcactatagtcactacaggtataacgtgtaccaacaggtcgctcaacgacgttcccataatcaaacattctaacaaaaggtaacatgattttctcctatgattgccatatctgcgttggcattaatgttaatgttttaattacggaagtaccatccggtaagttaccacctgaaccgttaaagcccccacatgcatataatttataatctttagttataattattgttctggaccagtctttggacgccataagaacattgtcatatccaccctgtatcgcacttaaagaaaacgccccccacgaagtaattactgttgtatttcccgtcccttcttgaccatatgtattgatgcctgcactcctgacatatgatgggtattgagccataggtgcaccaattgttgagttacccatattactaggacacaggaaaccatcactaatattcactataacctgtgaattctgaactgtagttaattggtttgtagttgaagtagtaccattcccagcttgtccagaattgtttctaccactccagtacaccctaccggcagtgaaccaccaggtaacatcataagtagcacttatataatcgacgttggatcgtattaatttattagtaaaaacgtatgagctagtcccaccaccactttcaccaaagttatccttaccacaaaaccatgcttctttatttgttttgagatagtgcgtaccctgtaatgaacacgccaattgagaaacttcacccataccagtaacaactgttagtactggaatggaattttggttacctgttccacattcggcatttgcatttttaccacaaacaactactcttccatcgtgtagtaatattctagtactttcacctatatgtacactcttgattaaattagcgtgtacatttattttgttaaatgcggcagtaacatcagtccatgttctaaaataaccattaactggagttgcatctccataatcggggaatgctacagtattccctgtgaaatatattctattatccaagtcaatcatcaatgagccatgaacgcctaaccaaaaggctgcacagtgcgttgccagtactgtaaaagtagaaactgtcgattgattccctagacctaattggctcaagttattaccaccataaccgtatagtgtattcgtgggcttatgtagatacatagcattagtataatgttgctgtaaaacatcagtgaactcaactggatcaggaataggcagtttattcccgtatttaaccattcttgcaaaaggtaacatatttccctcctttattcattatactatatttaatcaaaaataaatgccagtacacagtactggcataatattatcggttaaatttaaaatctgttatgtgtgtccatgtatgatttaatggtgtactcattggtgtaaagccagcagggtctgacaaagctgtaccacgtgcgtacataaattgattgccagtacaatccattatagcataagaacgtgttgctgtgccacatttgaacccaactgcactacttggggtcggtaatacttcaaatataggtgcatttgaaccaccccccccatcttttgttccagatatgtacagaactccattagtatcaatgattaagttagtccaatatgcttgttctcgacctgcataaaaatatgttaaatcaccgggtacaaatggtaacgtacctttatatagtgtagtattaacatccactggtgctccagatacaccccatgaactcatatagtttctcccacttgcgtagaatgtagttcctttaccgtaaagtattaatgttgcttgacttgttcgcattgcattatattcaaactcaggatcatcagtagcgtccttaaaaatctgtgtccatgttgttatattaccagtagtcgtaacacccatttgataataataattatcaccagtagcatagaattctttagtgccagtttgtacaattgcattcccattagttaaccaaaaatctaatgtattagtcttgatcttggttggtgtgtaattcgccacggtatttccttttccgaaataaccattagcgttatttccatgaccccataaatcaccattagttgtgcgtaggaataatgtaccagtattgaatccaactttttctatagtacttatgtcaataccaacagcagtgtacttcgttgtaaaatcttgaaaagtactccaataattagatgaaccattaaacatggtttgtctaccagtgtacttcactttattatcgttagtgataagtaatgtcccccacactgacgcgaacattaacttaacattttccataacaaagtatggcttaccgtatgctgacgcggtagtgtttaaacctaatagttgtccatcattactacaaccccatacttcgccgttatccaaaagcatcaacatagtaggtttgccagatgatacatccaaaaagaaatcttttggtgttggtacaccaggtgtaatatttccataatcaaacattctaacaaaaggtaacatatttccctcctttattcattatactatatttaaccaaaaagaaaagccagtatcaagtactggcatagtattcaaaaaggtaaatcaatttgcttagtaataatagtatctaacggtattgaacacaatgagaaattctttccacccgtattttcaggattatatccattcatccatacattattaccttcgtaaaatgtattccagtataaagacccactatatcgtgtattcgaattgaacgatgtaaaattgaattcttgaaatgctgtaaaatatggaagggaacttgaactacttcccgtaaatggggtatgcccagttgctattagtttgtttgtatctgcattaattaaaaatacaacactagtcgaatagtccaacgaatcaggatgatatatattactcatatcacctatagtaaaaccaacatcaaaaactttactatgtgcaccactaccagcaaaagtagttccagttgcatatattttattatcagatgttatcattacaaaaccaacaccagaaacaaaactgcattttatatcataagatatatcatcaaacaacggaacaaatgtggttgcatcacccgatgttgctttaacttgaaagctgttatttgaacctgaaccatatacagttccatcgtttttaatcttaaacaatgtatcgccaaggtaaccgccaaatatattatccacattagtgtcaagtacagtccacgctgaaacataatttttatgtcctaaacctaatgtaccacttcgattccatcctcttccataaagtgttccgtctttcattaatataaatgctgtataaccacataacatttttttaatttgggtaacatctataccagtgaaatacacagcccagtcagtatatccttgttggaaagtattagaattcgtgaatgcatatgttgaacctgaaccatatattttatcacctttaataacaacggaaaacgatcctaaccataagtcatcaacttcagttgtgatttgttgaactgctcctaacgatacaaactgtgtacttaaacccgcattatagtttgaatcttcaccgtgtgcatatacagtgccatcttgcattagaaacatttcaagagtgtaactaacaacacttttctttatattattaacttcgattatattcccataatcaaacattctaacaaaaggtaacataattccctcctttattcattatactatatttaatcaaaaaaaagccagtatcaagtactggcattcaatttattgtaaaaaggacatatctacttctgtataattaagaacgttctgtccagaaataccacccattactactattgcaaggccacaataatataattttccagtatccgtaagtataagtgatccagatggactgcgtaccaaatcacacgaactattaaaagaagtataagaaggagtataggagtactgattattattattaccaacacctaattgcccaaacccattcgttccagaagcatatagaacttcatctgctttgacaatatgtgatgccatgttaccaacacaagtatatagagtataaactcctgaactcaataatgtcggagttttatattgtatatctgtagatgtagaagtaccacctgtaccaaattcgttcccatattgtgcaccgaactgtttaccacaagcgtacaaattattatccgatttgataaaaaatgtactctgataacttacattaaaatctataacatccgaagaaatcatcgtcaccccagtaatagaagtttgattacccgtgcccaactgatagtaatagttaaaaccacaaccccataaagtattatcttcttttaggtatatgttaccaactgcctttttaaccgaagttatagtatctatccttttgaatgtgttaaaagaattaatgtttgtaccatcaccaaatgatgataggttcgagttattgttcgctccacaacaatacaatgtaccatcgtttgttatcaaatttaccttcatatcataaaaactactcatgtactttatatcagaaacattaataccacttgatgttatccacgtagtacagtccgtccacaaagtttttctatcagttacaccagtgaatgccttcgtgttaccagtgataaaaacttttccagtacctttctcttcatacaattgacaatcactactgttatcttccaatagaactcgtttaacattctccgcacaaagaataaatttactcgatgctacacctgtaccagtaccccaattcgtcgcagaagatgcatacaacttatcagtataagtatcatgaagatacatagaatcactggaatatattttaaaacgcccttctttctcaggtataatattcccataatcaaacattctaacaaaaggtaacatattccctcccttattcattatactatatttaatacaaataagaaagccagtacagagtactggcatatcaattacgaaaaacgtggatcatcaagaacaaacactgtactacttggaccaccttgtgtggtgacagcactagtactgtaaagaaagttaccatccgtcatataagttctacgattcgtacaaataactcttactttattcatatcgatatcaggattaggtaatggacatgaagtatacactgatacatcagtacttgttcctatccccagcgtaccttcatttgtggttgaaccgctattcaacccactagcatatataccactgcttgtaataacaaaagtggcgtagaatggagaaccttcacctatatttaatttagttccaggtggttgtcttgccgcagcaaccgcaccatatgctttcccaccagatgtggcaagattaccaagagcaccatactgttgttgtccaccattatacactgtgttagtgccatcactgttagtgtggataccaatagaattatagttactgttgctatatactaacgcggcattcgaagtaactgtatttcgtgtatatactttatattgttgggtaaaattaccactagtggacgtaccctgtacagttccagtgtagtatatatatccgtctgtaccaatgaatgagtgcataacactacctgcaaaaattttttcgggagtaacacctgacggtattgttgattgtacaaatctacccactacatttgttgttgtattatttcccaattgaccggagtcaccataaccacttgaccatatggtattgttctcaagaagaacactaattgataatcttgataaagctatttctttaacatcactttctaatgtatcaaaaaatgaagtacaatttgtccaagtgttcactacgctagaactaacaccaatttgtttattatcaccagaactataataattcccatcatatgtttgtataagtataacagaactaccaacccatactttatcaactgaaccaaacgttcttgtccatgtggtaactatatccccgctattattacccaatccaaagcaaccactactatctacacctcgtacatataaatctcctgaagtcatcagaactgcacagaatgattgtgcacctttaacatctttaattggctctggttcaggtgcaacatttcccataatcaaacattctaacaaaaggtaacatatttccctccttattcattatatcatatttacctcctaaagaaaacccttgacaccctttcagtactgttgtacaatagaaggaatataaggagaactacacatgacaaatactcttaagtactacctcaatactctaaatgaactagagtacgggaagtttctcgcggatagttcgtggctaattgagctaaaaacacataacagtactggatgtaaccttatgctgaacaatgcacttgatacccttgtagtgagtattttacacagcaacatctgcggggatagcaataaacaattatcaaaaatattagtactggtggctctatgaacattgaacagtactacattgatgcactaccaacaaaaggtctacgagaaagcctactgtatacacaaaataattatataaacctcaaacattgtcctaaactcttgaactcgtacaggaataataaaataagaaatgctgtacaaggggtagaaagtatgcaatactattacatcctaacccttttaatcgagcactaatatgtataaagaattctactgtagtaagctgcacaaacaatacagagattcatttcccaatgaacctatggatatgaatagtcccttttataaatttgacttcagactggagacacgttatgcaatagaacatcaatttcctgaaactaagtacttatctatcatgaacctcatctttaagttctaaaagagtactatatgaaaacaataaacatacaccagtactacttagatattctccctaaagatgtacagttcatccttaaacaagaatacagtactttaaaaaaccttaaaagaaccgcaccgaatgtattaatcctgcaccaaataaatgtagttgataatattctacaaggtgtaccagggaccgagtactttaacataataaggctaattacattaccatgaatcatatattatactattaccaaaatctatccgacagggacaagtacacccacaactccaatgtatggtactacaaacgcggtagtataagagacaaacaacattacttctgtattgctataaaagaagcactaacaactaagtacacgtacagagcagtactgaaacttattgatatgtaaagagaatactatgagcattgaattgtacttaagtaaattacagcctggcgatagattcatctacaataagttcgaattcaactacaagaacgggagcaacaaatatcgtcgaggatacctatatacaagcacaagagatgcacaaaacgaaaagtacacatacagagaagtacttaaactaatctctatttgaggtaatatatgaatacatttgagtactatacaaataaactatctatgcctgaaagatctcatctctatgtgtggagaaatgcgtataaaagcggcaataaacttatacaaagaaattcccttacagtgtgtacaaatttaattaaagcagagtaccgcacatatattgaagtactcaaactgatagcaatataaggtactctatgcaagaattctatatctataacctccagcacaaagatagatacaactataataaattccaaaggtactacacagtcgggaacaaaagagataaaaaacgttatctactctcgtgtacagtagaagcacaaaacgaaaagtacaggtacagagaagtacttaaactaatctcaatctaaggtagacatgaacacttttgagtactacttcaataaactaaaccacatagaacaaagtatgcacaactcatttattcagcaccatcaatcatctgcatctggaattaaaaatatatcgattgagattatcactacccgtgtactgtcatctgaacgttatatgtatattgatgtactgaaactcatctctatgtaaggaataatatgcaagaatactatatagaacacataagcattaaagaccgtttcatgtacgacaccttcgtgaagtactacaacctggcaactaacagtactaaaaatattaatctcaatagctgcattcatcacgcactaacaaaagataatcccttcagggaaatcctcgctctcgcatctgtataaaggaaaccaaatgaaacttaatgcacacagcaaacaataccttaagcactttaagtacctcaacagtattcaagcagaatcttttacatctgcatatacgtatcacccaaatgtactaaagaaacgaaataaaaagaaaaaatccagaaatgttctcgtatctaagaacctcaaatcgtacttgaagaaaaataatatagctcttgcttttattaatatctataatactgatttaaaagtattgagtactaataccagcacaaaagcactaaagaatgcatctatctatatacacatggataatatcccgtgtactataattctatctttcgggaatgtatacttcttcgggaattgtaatagcacccatgatatcagtactgcacaattccaaatcggagatatgtactgcatgggttcagaaaaaatacacgataacatgcacttcttccaaaagcaacgtactaacgaaactgatacagtactgcaattcctcaaagaactacaaaacaaagaattaacaccagaagaagaattcatgtacagtactgtaatcgataatccagaactctataaaaacgcgtacaaactaacaaaacatgtacaggaacttatcagtactgataagaaatttcataacctcattacgtatattacaaactatgtataaagaatactacaaagataaaatcccaatgcatctccaacaccatataccaaaagaaccattgggtatcaaagatcacgcaaagataatgttccaacaatgtactaagtacacgctcatatacgatgataatccatatatgctgtactacgtagtaatgctaacattcaggtactaatatgcacaaatataaagaattctacctctcgtaccttaattccgatatagtaacatccaataccttcagtactaaaattatctataatgaattaatgaaagaatgtattaaaggtgctattaaccctaaagatacgtatgacttgtactatgcagtactaacccttgttttcacgaaataacacataatatgaataaccacaaagaatactacatagagaaactcccaatgcatctacaataccttgtaccatcagaaccattgggtatagaaaaagactacgaaaaagactatttcattaagtgcactaaatcctcgatatatattgaagactataatcgagtactgtatcacatccttttactaatatataagtactaatatgaacaaccacaaagaatactacacacaatttctccccagcatttttgaacactacgccagatacaaagtccccctggataacgatttggcagtactgggattcaataactgcatagaacgaagtatagaaaatagtagtagttatgaccaattatataacactatcctacttatattcaggtactaatatgaataaagaatactacaaagataaactcccaatgcatctccaacaccatataccaaacgttgcattgggcataaaagatgacgcaaaaacaatgttccaggaatgtactaagtacaccctaatgttcgaggatagaacatataaactgtattacatcctcgccctaatattcaagtactaaagaggccaatatgaacgaacagaaagaattctacaccaaatacctcagcaacgaagaacaaatgtttctaaggagtgtatcacctttaagtttagatacacaacacgccagatattgctttaataattgtatacgtagtactctagacgcattagaatacaataacaaaaatattatgtactcaggtgtaataggactaatattcttctatgaataactataaagaattctacttaagccatctggatctaaactcccaaatgcttataccacaaatcccaatagatatcaaggataagaaaaataccgaacagttcatttatcatacacagtgtgctatcaccccaaattacattccatatgaattgtactacattctcgccctaatatataggtactaatatgcatagagaatactatatacaatttgttaaagggaactacaaacacgccgtacccagaacccctttaaattctaatgacccaagtactatattcttgtttaatgacgcaatacgtacagtactcaatactaaagatgaacaggtgcagtacgtattcttacttttacttatatacagacactaactaatatgaataaagaacataaagacttctacataagaaaactaacattcgtccccgtaagaatatacaaagaatgcgacccaagattatacctatggcacttcaatgagtgcataaaagattctatataccctaagaactataaagaacaattgtgctcagtactaacactagtactatcatattaatagagataatactatgcataaagagtataaagacttctatataagtaaactaaaagaaaatgaacaaatatggattaacaatctaatccccctaccaatgactcaatacgaatttaatatatgtacagagattgttttaactagtaataatatctataatacgtactacttcttattaagagtactatatggtactttgaaataataaggtatactatgcagaacataaaaaactataaagagtactatataagtaaactaccaccgactgaccaagcatggattagatctataatagtactggcatttaatagatatgcatttaacagatgtaccgagattgctatagacccttataatattaaagagaatgtacagcataatcagtactactatatgttaatgcttatatataggaagtaattcaacatatagacaggggaagctccgcagggaaagcattggacaggctttaacatatgttatatatgttaaaattcagcctgctcgacgtctgaattgttaaaattcagcctggacaaatgcgatcactaggattctccccaggctaaaccccgtaatcatatgtagtcataagtaatcatatataaacatttaagtaatcatttataatcattgtagtgattagtattgagtactagagtgtaatagagtgtaatagagtgtaatagagtacaggaatgtgcacgtttaatcaagaacgtagcagtactgccccaaaagtattcagtactgaaggtgtcgatatcccactaagtaggcagaggaagtctgccgtactttttagtttccaagctccttttccatttttcaaattacatcaaatgtaatcaaaagtaatcacgcaatgattagtactgaattattactttcaccttaatttcaattacccctttacccttcggggtaaaattccattaccccttgaggctccagcaaaaagttggttagtactccatcctaaatctcgatcctaaaaattttggagtacctatgaaataaaagttggatcttcgaaagttgaaatttacgttgggacgtttatgatttgtgggatataatgatgtttgtagtcgggtagttctcaagaatatcagtactgaatggtgaaagaaagttattgactttatgattcagtactgtataatgttctacatagagagatgagttgctgcgaacaattcatttactctatctcctgtcgtgagacagtacagaaaagatagttcctcctgtggtggtacatctttttgaacctcatatgaaaatcgtaataacagtactgatattaacagaatggtgtcagtactgattttaatctaaagcattatgccaccagcacaagctggtggattccctctaacagtattcagtactacatgatggtcttcatcctcctagggtaacatagtgagggctatgatggcagtactgaatactccctttcaaaagatagatctatggtatagtactgacggattttgggtgtagttaccctggatggattttggacgtagagatgtctagccctccagaagcctggaagtaaagatggctatccatctagacggctaaacggctagatttctggatggctggatggttacacgtctggaagtatagacggctaaatcaaaattttattttgttttttccaatagttcccctaccgcgtggggatagtttccccgcagtatctggagttagatttttctgaatctggaatcattatcttataaactgggggcaatgtcaacggcctggacggatatttttaaaaattttttcagtactgaattttgggcgtaactatgcacccggtgggctagagtctttctcgacttgatgaaataattatagcagtactgaattataaaagcaatagcctaagtgtaaaaagttttaattaatttgcttgccatcctggggcgtactatggtactatgattcagtactgagaaagtgctttgacctgctagggtgcgggagtgtatcctttttaaaatttactgaattttgggcgtagttccgcacccctggggtatccgctttctcgcgtctatgtagtaattatacgcttttttagtactgagtcaatagctaaaaacaaaataattgaaaataatttaacgcgtttaaatggcccgtaaagccctggattgttgggagtggtgcaaatgtatagcttaggtgtattaatgcgttagaatgcgtctgaggccgttttaagggtatagtactgaataattgtactcactggattgattcagtactgaatgatagtactcctatatagaaagaaaactattttaaaagtatttgcagaaagtacttgcatactatgtttaagggcgtataatgttttacatcgagacgggggaaacgctcctaactcactttaataggaattaaaacgatggcgactcaaatcactaaaatcattgctaacctggttaactttcgcgaagagatgaaagatcttccggctgagactgtaaagattcatatttcagcttatcgggaattgattgcaatgttgccgcttaagcgtgaacagtacgccgctactgcaatgctggacgcaatgatacataagatgattcagactgatttaacgatggcttatcagtacatgggcgaaatgtttgcagtgtatagcaagccagtaccaggaatggaaagtacagaagtattgcacggcttaaacttaaaacaagatgcatgggataatatgcctcgtttcctggtatgggctgatagtggaaagatttacgaataagtttaataaagtacttgcaaactaagtttaaaagcgtataatgttttacatcaggtggggaatagttccccactatataagaggattaaaaaaatggctaaatcaaaaatgttcttaggtcacaaaaacaaaactcaatggaatgtaagcctttggattaataacgacgaatcattataccggttggcccaggactttattgccgctaacactaatcgtaatgatgcggcccgtcatatgatgctatttttagaacagactggacaagataaaacaccggacggctttaagtatagcactactgcgatccgtgcggcgatggttggaatgtaagagaatagattaaaagtactattgcacggtgatagtactttataatagatttcttttatacaacaacgataggggtaacagcatgaatattatatactttgcaacgcgtgaacttgctcggattgccgcacgccaggacggggcgacgtttaaagatatgggcgtacaatctgaacgtggtaaacgttgggccgtagtaaagcaaagtacagccagatccttacagtactggttagcggcgttaaaaagtcctgatagtgtatcgcgtcgagtggtagaaataaagcacgaccgcaagggcaaccgtgttactgtgtacagtactaaaaagattgcagtacttgaataaaagtacttgcaaagtaattatattaacgtataatactttatatcaggtggggaagtattccccactacataagaggatttaaaaatggctattatgtatatgaccgaagttaaaaccgtaaaagatactaccactaataaaactacttacttacagcggatctgcggtgtatggcaacgtatcagcaaatcaaagtactttaaattaacatcatatgccaatcgttcggattcattcagtactgaaataaaaggtaataaagtacaccaatacggcacttattattattatagcctggacgcgattgcagtataagtagtttacaaatctttacaattgccagtattgacttattttgtcagtactggcataatgtattcattggcagataagccgtagcccatagggtgcgggagtgtatctatagaaaaattagtttagtatagttacaattgtgcacccggtgggttagctgttgtcatggggtatattatgccagtacttgataatgctgtcaatactttttttactattcagtactgaaaactatttttaaaaagtacttgcaaactatgtttaaaggcgtataatgttttacatcaggacggggaacgaaataagtaacttcccgttaagtagcccaggagtaaggcacacgaaaaactcccctgataaaatagtttgacaaatgtttttaaaagcgtataatacttacatcaactactgaatgagagttacaaaatgaaaactatcactactactacttttgttatggctttttctgaactgaacgcagaacaacaagctgcggctatcgaactggttcgggaacgtgaaaaaaacttaaacgatgattatttttctgaaagtgaaattgaatactataaagaaacagtactaccggaatatggcattaatgacgctgaaatacaattcagtggtttttggtcgcagggtgacggtgcatcaatcagtactgaccacgttgacgcagtgaagtttttacgcaaggtaagagcattaactaagtatcgctcaatccgtcacctgctgaatgaagatgatttggcgatgagtgtaaagcgttctcactcccactactcgcatgagaatactgtaagcgggtacattgaatcggcttacactgatttaaccgcaaaacaagaaacgttagttaatgagcttgaggaactactcactgaaactattcgtgaattatcccgcaagttgtaccgtgatttagagaatgcatatgaggatcaattcactactgaaaacattacggcactgattgagggtaacgaatatcaattcaatgttattgatggcgtagtagaatcaatcgaatattaatttaaaaagtacttgcaaactaagtttaaaggcgtataatactttatatcgaggcggggagtggttccccgctcacactaaaagggtaacaaaatgaaaactttaaatatcacaactgcacatcaattggttcgggatgcgatggatcatgtgcaagatttcttccctgatgtaagtgtagtgacttatgaaaaaggtacttggacttattcaacaattaacggttatgagcctgattttgatgatctggaagaaatggaatttaattttgatctgctgaatgatgccgcccgtgaagtggaaaacgatgttcaatacattgatggagtagtcgcacctgatgccgtaaaaggattataaaagtacttgcaaactaagtttaaaggcgtataatactttatatcgaggcggggagtggttccccgctcaaacgaggattaaaaaatggctagtactaaaacttacaacgggcacaaaaacaaaactcattggaatgtttccttatggattaataacggtgagtcattgtatcggcttgctcaaagttgcatcgcacaaagtagaactaaagatattgctgcggaatgtatgtaccgcagattaaaagccaacggtactactacaacgccggacggattcaagtatagcactacggcgatccgtgctgcaatggttggaatgtaatattcagtactgtaacaatggcggggaatggttcccgcctttattgagggtttatctaatgagtaaagtaattaactatacagtactaagcaagtcattgtctataagtgagtgcaccaatggtttttggctgtacgatgaaacgcgtggcatgaatttagctatgcaggagaaaactgctgaggcggcatatcttaaagcactggaatactaccaggaacgtttgaaggaagtagaaaacaattatcaaaatttaaaagagaaagtagatcatttcgtcggtcaattcgttgacgatgacgatgacgggcactactgcgaccgttgcggatcttacagttaagtactaaggattatataatgagtgatttaattgaacgtatcaaagagcttgaagaaaaagaattgcagttaatcggcttacagaataaaatctttcatgatttggggagttttatcaatgcctgggatagtggcgatccagatgcgttacctgctaaccgcacggcaatgatcaatgatgtgcgtggtgtctttgattatgttttaaagcaattaaattaaaaaaagtacttgcaattagttttaagtactgtataatagtttacatcaagtggagaaatggttctccctggtaatgaggaaaataaaatggctaatatcactactctttcccaactggaagcactggttaaatctatgcgggaacatgccgacaaaatcggcgtacaagatccagccgtttgcttttgcgacgaattgaatgatgataccctggtaatagcagaagtccaggacgtttctaactattcctcgcgttacactggcggcgtagcaaataaaggtgacttctgtttataccttacaaaataacaacgcggggagataataactccccgttactttttcagtactgaatcatttaatagacggatctcggcacccggtgggttagtgactgtttcgtcttgatgtagtaattatgccagtactggatgcacttgtcaacaattattttccaaatactttttattaaaatactagacaatagtttttaaacgcgtataatgttttgcataggggagcggttcccctggtaactaaggaataagaaaatgcttgaacaaatcaaatcaacgacttcgaatgtaacgggaacggtagcacactttactagtgatgaatcgcggggcgtaccctattgtgctgtacatgtaaacactgagggtaactactggtttacggtttacggatcatattcatttggacggcccgggcatcaaaaaatcctggataaagtacagccaacgggtaaaaatatcactgctgaaatgttttataaaaaatcataaagtacttgataatagtttttagtactgtataatattttacatcgcaaggggaaacggtttcccctggtaactaaggataatcaaatgaaagtagcaatcatcgccctggctttatctgtttcctctttcgctgttaatgcgtcgttagatgtacctggtgataaattcattcagtgcaccgtagcaatgacagatgaaagtactggcgagattgtattaaaggatttagagatccagccggaagcatttaaaaacggcccgttccatgaagaagacgaaaacggtagcacaacaatttattatgatgccagtactaaacgtggttctgtcactgtaatggatactgagaaagtaacgcatacaggcgttattaactgcctataatacatcagtactgaatcactagcccactataagcagtgggcttttttgtagtatcgtagtactgagatactttgaaaatagttttaaaaaagtagttgacattaccgcagaaaagcgtagaatgtattacatcaagacggggagcactaagtagaccgccagtaagtcgaacgaaaaactggacacgtcgagaaaactttgatacactaataaacgtaaactaaactttaattgaggatttataaaatggctaatgtaaaatcattcatcaaagcactggtagcaaatgaaactaacgtcgcggctgagatcctggctgaactggataacgataccatgaaagcggtacgcaataattttaacatcgcgtacagtactgcgaaagaactacaagcaaataaagcggcagaaattgaagcggcaaaggcggcccgtgaagcagaactacaagcaacaatcgaaagtattcaggcggcagtagttggattggatctggaagtagttacagagatggcacaaaaagccctggcggttaagtatggggaagacaagccagaagtaaaagccaaaaaatggattcaggaacgcgtagcggtagtactggacaacggggaagaatatctgattccggtgcgtggtaactgcattgcggtagtactggacgcgattaactccagtggtatgactcgcgaggaatggatcgaagctcatcgcaaagttgaagcataacaattaaagtactgaatcactagcccactgtataagtgggcttttttgtgtttatcgtttaccagtccaccagcaccgcctagaatcgattctaacgcattaaactgattatctgatgcattgccctagctggtggcgttaaggctgtaagaacgcgattgagtgcgtttaaagtattttgcaaaaagtaataaaaagtacttgcacgattaagagattagcgtataatgttttacatcaaggcgaaacaccttaactaactgaggatataaagatgaatacttatgaactggattgtttcacgttacaagtaatgtcagtatgcagcaagaaagattggtcatcaaaggaatttaaagcagttattgcgtgtgcaaaacacggcaagactatcaatgaaacggcatcaatcattgataaactttaaaaaatagtttgacaatagttttaagtactgacataatacatacatcaactactgaataggaatcaaaacaatggctatcgtaatcactcgcgtatctggtactactggcaattcttctactgttgctgtaattactaataagaaaggtgcggaattacattttgcaatggatacctgggcggtgaatgagttcggtcagtgggctagtgtagaatacattgaaacctatcaagtgccaaccattagcttaacggatctcggcgtagatcgtatcctttgcctggatgaattaaattaaaaaagtacttgcaaagtaaatcgaataaagtataatacattacatcaaggggagaaatggttctccctgataatgaggaaactaaaatgaaaacttgtcaatgtggtaaaaaatctattactggtttaaagcggggcgttgcactttgccagtatcattataatttacaagtatggggtaaagaatgggccgaccaggtggaagcagcaaagaaagcaaaaagtaagtaaaaatattatcacagtactattgacatagtttgatagtactggcataatagattttatcaagacaactaagaggaaacaataatggctatcattactaaaatcaaagttaacaaatcactggttaaacttgaacaagtgaaagcaggttataaagtatcgtggtgcggtatgtatcggatgttcaccgatatagacaatgcaatcaagtactacactgacaccgttgcctcattcgttcgttctgatgtagtactggcagtacatgcacataaagcagcgaaagaaagtaagtaaaaatattatcacagtactattgacatagtttgatagtactggcataatagattttatcaagacaactaagaggaaattaaaatggctaatatcaacactatcgcaaaacaaaatatcaacctgtcttctgttgaagttgtacatattgccgctcggcgttggttccaggcttcatatggtaacacttatttctctttaagtgtagacgtagaaattgatggtaattttattgaagtagtaaacgtgccgttccaatatggatacggggatcactttgacactgtagcaatggaagaatttagcaaggttattaatatggaagataaagagtttttacgcggttcttatctttcccgtttttgccgtgacaataatatcactgtttacagttcggtaactgatgttaaacgcaaaaaagatctttaattagctttactttatgcagatactttgatatagtgtctgcataggggaaagaaattaaattaacttaagaggatagtataatgaaaaatatcagtactttaattgatgcaggtacacatgttcggcggtctatggttgcaaccagtactacaaaacaagtagcgagcggttatcttgtatttgtgcacgatggtaaactcctggaacgttcaatcaattttgatgttaaaaacaattgccgttttattatctttaagcgtgaacaatataaaattgatttaccagcgaagcccataagcggggcgtataacgtctattcattgtttgagcgtcaaccatacacctattaatcaaaacatcgttagcggtcgatttaggccgcttatattggggattataccatgaacgttaatcaagtactgaatgagatcgaaagcatcattaaaccgatgaagcgtactgatgctatgttaacaccggaagaatgccgcctttatgagcgttacagcgtcgaacaagtccaggcaatggctatggctaccccagccgttaaaccgcctgagaatgcgttacaggacgttacaggggattatatcatcaatccagtactagggaagatggctgcaatcaccgaagatcaacaagactacttaagccagtacttaaaaggttaattaatatgcttactgtacaggataagatcgacatcttaaaggttaatatgtatgtgattgatgcagtacctggtaaagtatttgcatacgatgacaccactgtaagcgatttctactatagccaggacgtgggggatctttctgtacagtcggttattgaaaacgtagttaatgcagcgtatgagcatttactttcaaatagtacttgcaattagtttttagtactgtataatgttttacatcgagagcgggaatagttcccgcctcacttttaaggaatatgaaatgaaagcatcaaaaaagagtactaacaagaaagcacgttcacctttcgctggggtattccctttacgtttcgttgatgaagtggtttcctacccgcctggccttactcctgagatggtagaaagtttgcgtaaatctaaaaaatagtacttgcaattagtttttaaacgcgtataatgttttacatgaaggggagaaatgattctccccaataacaggagaatcaaaatgaaacaatacaacgctcggtttgatgttactatcggtaacggcaaaggtcaattctctttcagtactcgccgcagttatacagaaaacttcctgcgtaattgtgcactgaccgccgcacaaattaaacattactttcaggctaaaaaatgaaatcattagcttactatagttcggccctggtcggtgcattgatcgcggcattgttagtaacctatctattctttatggtgatttaaatgaatccaacaggcttaaattataaaagttgttcggcgtttacgaaagcaaataaagcgaatgcacgtaaagcgaaagtacaggaatacatcaagcaaggcatgacgcgaaaggcggcgattctaaaagctaaaaataaatgaaaaaagtggttgactccggtcagccattttgctattatatattcattgagagatagctcactagcccacagggtgcataagtgtatctattatataatgtttgagtactgaaaactatttttaaaaagtacttgcaaactatctcaataagcgtataatgttttacatcgcaaggggaaatggtttcccctggtaataaggaaacgaatcatgactatctcaattgctcaatctaactttgaaaacgaaatcatcgcccaggcactgcgtttaaatgatggtcgggccgaaattaattacggtttcaattcaggcggttgcgaaaactatcagtactttgtaacggctgatggctgtgtcctgggtatcaatacagttattgtaaacatccaaaaaattaatttcaatgatccagacgatagccagttttacatcactggcgtagacgtgaactatgaggatgactcactaactgatgatcacactggcgagcggttagaaagtgcatacggtgaagatgattatcagtccggtccagaagatttcgaataatataaaaaaaatagtttgacaatagattatagtactgtataatagtttacatcaaggggagaaaaacttctccccactaacagagagagaaaacaaaatggctaatatccggtcgaaattaaaaaatgcaaaacaagttttattttcagatcatgaatactttaataaagatattacaggagttacaagtatcaaggaagtaaaagaaaaaaccggagttttgtgtgatgtgcgattagttgggacatttgggaataacgtgctatatcgctgcggtgattacaattttacactgactatcattaactaaaaatattatcacagtactattgacatagtttgatagtactgacataataacttttatcaactacactactaaggaattaaaaaatggctatcatcgcaaaaactgaaatcgttggtctggattctatcatcatgacgtttgaagatcaaaaaggtatgtatgtagtttcatatggtgattatgttcgggagtatgaaacggtagacgaagcctttgaaagttacattcgccaggtgaataaagcatacgacgactaccgctaaaatatattaccagtactattaaagttattgacatagtttgatagtactgtataataagttttataaacagtagttaacttaacctaagagagaaacaaaatgatcgcactggattcattcatcgacgcagtactggcaaaaactggcgaggatctgaccgcagaacaatacgcgatgatcgagcaatgtcagcaaaacggtaaatcggtgaaagatactgttaagattatccgcaagatgtaagattatagcccactggttaacgctggtgggctttaatcctttaccctatacaatgccagtactcaaccgtttatctcgttagaatgcgttacaggacgtttaacaatgattagcatgaaatcagtacaaaaacaaatagaaacattatcaaaaattaaacgtaaacagtactcgttagaatatacaatcaatggtaactatcatctaatgaaagagaataattttatcgtcattgatgaatcattgcaagttattagtatagtactgaaagcattaatcaatgacagaaaaaaattaaaataatctattgacaatatcctccagtactggcataatacttacatcaagacgagaacgtcactaacccatagggtgcacaaatgtaactatataatatcgatcaataaatgatcaaaaaagtactggatcaatttagcataaggagtataattctgatcaattcttgatcaaaggcaataaacgcagttgaatttatatagacaatacaaaggcgttactatccgtggtaatgctggtggatatgtagtatcatatggtttgaataagataaacactagtagtattattgtagcattacagtactatagtatttttataatgaggttaaaataatggctgttggattcgcgaaggacggggccgagcaagacgagattaacgcagtgattcaggccgctgtaaaccacgctagaacgcaaattaacgcacaaatagaatcactgatacattgcctcgactgtggcgataaaatccctgagaatcgccgccaggctgttaagggatgtaagtactgcataacttgccaggaggatcatgatagtacttttaaaagagatccgcgtaattgttggcatagatctatgagataaaaagtattgacagtactgaaagatagtgtataatattttatatcttaactgaggatagtaatcatgggaatacaacatatcacgcgtactactgacaatggtgagatcactggctatcaagtacagggcaaagtagaacaattgcagtactggtttgaaaaacgtggaatcattgcaccggatcttgattatgaccgtgtagcgtttattgattctctttatgttgatcctgatagtcggggcaatggtgaaggtaacgaattaatgaatgcctttatcgatgccgccaatgattcagattgtatcatcttagaatgcgatacgggagaagataacgcctttaatcttaaagaatggtacgaaggttttggattcgaggtactgatcgatagtgaatatcctatcatgattttatcatagtacttgcatttagttttcagtactgttatagtacttacatcaaggggaaacatcttcccctactaagaggaaataaaaatggaaaacttatcaagtattttagtacaagatgatttcggtaatcctggaagtgctatcattgttcggggtaataaagcaacgtttgttattgctggtggacccgtacagcgtagcattaaaaataatgctgttaccattaataatgtacgctatcgcttagataaagaattaattcataaactgtaaaaaagtactggacaatagattatagtactgtataataagttacatgaaggggagaaaatgattctccccactaagaggaaagaaaaatgcaaggtcaactaatcgttcgtaaatggtctgatactaacgaaaaaccgtgggatgtacaatacatcgcccccaatggtgaatccagatatcaaccaggtgtaacgcatagtactgagcaattcgccgccgctcatcgcgaacgtctgttacaatcaatgcagcaaggttccggtgaaaaattcattcaggatcattggctgaaagattaaaaagtacttgcacagtactgaataaagtgtataatgttttatatcgagaggggaatagttcccctcctaacaaaaaggaaagtataatgatccaagtagaattatcagtactgaaagatctattttatcggttaggtactaatggcgagtatcctaaaagtgataccgcaaaactttttgtatcactcgacttatggcaacgcgaacaattagtaatgtcgtggcgtaaaggtaaagcagatcgcgaggtgaaagcatgaaagaattcttatttgaagtagtgtttcaaggtgtcggtagtaaccaactgattcgttcaagtggttacaatgttaaccaggcatggaataacattaaacaaatgtacccgaacgctatcacatatcgcaacccaaaacaagtttaaaaataatagcaaagggattgactccggtcagtccctttgctattatatacgcatagaaacaaatcagcccacagggtgcataaatgtatctattgtttgctggtggctagtactgtaatatacttgcaaactatctataaccccgtataatgtttaataacgacataaccaggagttaatgaaaatgatatggtacaaaaacactgataatggtaacttttatcgtataaaaaacaataaggtattattccgtagggattccggtatgtgggcaaagcatgatagtttaaccccgcatgatcttacattgccaccgttcaagcctgttaatatgagtaagtaaaactatttttaaaaagtacttgcaatgtaattagaatcaagtataatgttttacatcaggacggggaacgaaacaagtaaccccgttaagtagtccaggagtaagacatacgaaaaactcccctgataaaatagtttgacaatagaaagtaaacgagtataatacttacatcaaccactgataaggaaacataaaaatgcggattctactgacagctaacgaaatcgaacaagtactgactactaacctggaagactggaaacgtgaagcagatatccaggcggttcaatggcttaacgataagttaacgccggatgacttaagcaagattgtagatcctcaattctacgaagatatccacgacaccgcgttaagcgtcgaggatgtactagataagcactttattgatactgatttgcaggtttacggtcgtaaaaactttataactattcacgacatttacaataattaagtattgacaaagtatcttagtactgtataatagtttacatcgagagggggaatggttcccctcctaacaaagagagagaaataaaaatggctaagtgcactatctgcaagaaagaaatagtattagttccaagtgcccgtgaacgtgccgctcggttcggtggcaaagcgtcagactatacaaaaatgtttactgcccatacagcttgccaggtagcaaaacgttcacaagaaagcgtagaattaatgcgtaaactttccaaaaaataagtattgacaaagtatcttagtactgtataatagtttacatcaagtgaggggaatggttcccctcctaactaaaagagagaaataaaaatggctatgatccttgcccagaaagtggaactgaaaattgtaacctcctttgacattaatgttaatcggtggactgattcacacggcaatacttaccactcttgctacgtgtctgcgttaattggcgaccgctgggaagacctgggacatgaaacctttacatacggttacggtacacaaggcgaatacacgggcttggagatcattaaagaaaccgttataggtttcaacccgaaagaaaaagttattcaccgcatcgaggaagagatcaacaaagaaataacagttcgctaccacgatgtaaaacgtaagaaagacatgtaatagaatccatttaaagtactatttgacattgcccagatagtactttataatagactctaacttgtagtactaactcaactaataggatgtataccatgattactaaattctacgctacccgtgaagctgcccgtattgttgcacgcgaggaaggagcagcatttaaagacatgggcaaagatgcaacgaaaggtcaacgctgggccgtacagttcaaagaaatctctgatattgtgaattcacctgagccagtactgacagcagcagaactaaaacgagcggatatgctggcggcaatacttgacgcacaagatgaatttatcgctgattctgatatcaaagtacaggcaaaccataccgcttggactcacgcggatcacctggcaaaccttaagcgtccaagtgaactgattcgcaaccagaaagagatccgacacgaccgtaagggtaatcgtgtaacagtatacagtaaacgccgccaggttatctaataacttgcagtactaacaacacggcgggttcagttcccgccttttttataggacaaacaaaatgattaaggttcaactatataaagataacatcttacgggtacactataaagcaccgaagagaatcatcacaaaggccgtacagcttgctaatgagtttattaatggtaacctattaccaaggaagttaagcaacgggaaactgcgtgtaatcgatgtggacactaacaacagaatagtaattgagaacacaggaaagataaacctatatgaacaccaacaatataataagaaaataaaactaatatcacgttgacagtactcaaatgttttagtactatgtacatataccaacacgggagaaacaaaatgaaattatctaaaatcgaaaagaaaactattgatgaagcagttaagcacggttatacctttcgtaatgattcacattttaccaattttcaacaagggtatcgtactattaaaaaacttattgacaaaggtttattagttgaagtcaataacggcaatggcattgagtatcaaccaacacaggacgcattttattttaagaaatataatattatctaattgacagtactcaaatgttttagtactatatgtacataccaacacgggggaaacaaaatgattactttagaaaaacgtatcaaagaaactacatcgctggtggaactgttaacagtactcaaatgtaaaacaacaccattcagcacgccggactttattaatatggttgatgttaatggtcgctatcgtatcacggtcgaacaaggagcggcgaaagtattcagtactaaaaacacgaaggaagtgatccacgccgttaatgttaaaaaagtagttgccattgatagtaaagtactgtaatatagtttcattaactcaaggagaacatgcaatgcgtaattatactaaattcatccgtacactgtcagaaatggaaaccaacaaagagatcctttcagcttgtcggttagctggcctggagatcatcggtgctggttcttcccgtatagttttcgctttaaatgatcggttagtgattaaggtcgcgaattgtgatgcgggtgtagaacaaaatgaaactgaatgtaaggtatggaattttttagactatgaccgccctcagttgaaacagtactttgcaaaggtgcatatgcatttatgcgatcctgataatatgtttatcgttatggatcggttgagtactgcaagcaaaggcagtgtgaagcacgtaaacgcgtgcaatgaattaaagtacaatattaaacgtaatgcaatcgaacgccagcaccgctttgctgatgcactacaacacgttgatgatacattatcaacactaacgataagagatatcagaaaacagaatatcggccaggatcgtaatggacttattaaagtacttgattacggtttaaccagcaatatctggaatcagtactataaaaagcgtgatgtggcagcaagtaaggtaacacgataaaaaagattaaaaaagggattgactccggtcagtccctttgctattatatatccattgagagataactcactgacccatagggtgcggaagtgtatctattatataagtattcagtactgaaaactatttttaaaaaagtacttgcattgtacttagaatcaagtataatgttttatatcgagagggggaatggttctccctggcaataaggaataaaatcatgactacaatgacttgcatttacgcttctaatcttctgaatgatgcggcctttaatgttgattcagaatatcaatgttatcgggatgaaaataaaaaagtttttgtagttgataataatggtttccatattgaattacaatcaggcttcactggtgttgatggtaaatcagtatggggcgtacaggatgataaaggcacatatcattttaaacgtaattaagtattgacaaagtatatcagtactgtataatagtttacatcaaggggagaatagttctccccacaccaataaaaggaaacaaaattatgtccagctactccgctactatgatcattaaagatatgaacggtaatcctacttctgctggtggatcatttggaaatattaacttagatgggcggttatccatgcaatcagccatcgatacagcgaaagaagtttttaagaatgaatgtactgttagtaagctggattatatgggattcgctatcgagaaaactactcgttttgtgaactacaaaaatccactgatgattgatactaacctgaaagctaacgaagtggggtacttattatgacagtagaagaagttaaaaaagtactggcagtactacgatatcataatcattgcaaggtgaagaatgatcctgattatattgattcatccctggaggaagacaccttgaacgctataagccatatgcagacattagcaaagcgtatgactgaaaagaacatgccggactatatcggaaataaaatttaaaaagtacttgcattgtagttagattaacgtataatgttttatatcgagagggggaaatggtttcccctcaagtccaggagatacaccatgaacactatcgaaatcactatcaatgctcacgtatacgacaacgtagtactgcaaactactatgaccgccaatgataccagtactttgcggaatactgttattagtgctgtatgtgccgctatcggtgatgtcgccctggaaaatgcaaaacacgtaaacgatggtttcactatgtgcaaacgtgataacgcaaaacatatcatcgtggaaggttacggcggtgtagaatttaatgtttatatgaaaaaagtacttgcataataactaaaacaaagtataatgttttgcatagggggagatatcctcccccactaaaaggagtaataaaatggctaactttgatgaactgatgcgggaagtagctaacctggcagaagagaagaaatcattcgattctatctataacaccgctcaccgtgattcagtactggcatgtaaccaggatcaaaaagatgaactaatcgccacctatcatgaagcatggaagtactaccgacaatgggagaaagaagaaagtgagtctaccattgtcggcctcaataatctaatctaaaagttttatttcagtactattgacatagcttgatagtactgatgtaataactttactaactacaaggggaaacataatggatcagttcacacaatatcgggtaaatcctcaagctatggcctacgtagaagaccataaaacgttaccagtactgcaaccagttaaaggccgtatctatcgtggccttgcctgggatacggcccaggatggatataaaaccgtcgccgtggggatgtattgcgggaatggtgaatggtttgatcctagcaatccgattgcacttgacagtactgaaaaaatgaaatgggccgactacatcgaagatatttcataaaaactatttgacagtactaaccagtaatgtataatgttttacatagagcgggggaatagttctcccgccaatagtttggagtaaaacattatgtctatcgctatcgccctggttgaagtactgaaagaagctaaagccaaccagatcgacgtaaagatccaggaactacaaaacggcttaatcggctgtacttgtaccgctggtggagcggcagactatcgagaacacgaatcactcgaatcactggttcggtatcttaccatgatcgttgatgattggagaatcatctaacaaaaaagaataaaaaagggattgactccggtcagtccctttgctattatatacgcatagacaaaaactagcccacagggtgcataggtgtatccaaaatatatagttaataacggtgagtaactatctgctggtggagtgaaaactattaataaaaaagtattgacaaagtatatcagtactgcaataatgtatctcgtagggcggcaatggtgcgacggcccacaaagttaggagattcaaaatgactacttcaatcgctatcgttaaagctttcatccgtactaatgtttcctctgtattcatcgacggcctcgaccgtaacgtagaatactcaatcattatcgcacaaacggcaaacggttctcggtacatcctgaatgatagtgaagcaaatcactactacttcactaaagccactggctttaaacgcatcgatgctgatgtagtatacgctaagatgaataagctggtagacaagattaacgcgaaaggtactatcgatttacagtactggaccgaaaccgatccagaatatggatcacaccgctacctgaatccaggtatcaaaatgtaaaaagtacttgcatagtacttagattcatgtataatgttttacatagagagggggaaatggttctccctcctaaattaaggagttttatcatgaccttctcaatcacttccttcgctgacgttttagtactggctcggacttttggtaaagatgcactggagtacgctgtaagtaatggcactatccaaccggaacagtgccgcatcattggaaactgcaaacgttgggcggtatccaatactattgcactggaaaacttcaacgatggcaacaatgaatattctgttgatgtagtattcgaagccgttgatctcggcggtatctataatactaacctgaatgatgtgcgtatcgttcgcactggcttcggtgcttatgatgtatctatccgtgaagctatggacaagggatacattagcaaggacttacttgctcacatcatgcagttgtggacggaacgcaacgaagcacgtactatcttagggttgtaagcgttacacatcatcaaacatcataggccgctctctagcggccttaactatatcaggagtacatacacatgatctatacagtatacagcgttctaggcactattgcaggcgtacatgataacgtcgatggtgctatgcgtacagtactgcaacaggttccactaaagcctaagaccattaagcagatgacagcacgactaaccagggcgacggctggcgtggaagtatggcaggactatggggatacacagataatcgtaagcgtaacgaaggattaatgcgtaaaaggatttagtactgaatcataaaaaagtcaaggcatttttaaacttcagcgttaaaaaaatgcataggtaatcccttgacttttatgaataaaaagggattggactatggcaaaatgcgtagggggctaaagggcgggtaaccttagcgacttcgataaaggggtattacgaataaaatgttattgactttttatatgaattgtatattatatgattgatattatttttaatggagtccctatgcgtattttaactcaagaagagcacaaccacacactcatatccaacatggcatatatcctacatatgtcacatatccgtggtattgcatataagcgtgaattggttatgaaacttttcataggaactaactatcaagaaaagtatatcgaactatacttacaagaattacgaagggacataaaaggtagactatgaaaatgcgtattttaaataaagaagattatcaagaactgttacgtaaaaacatggtaaagatttataacacagacacaaacttagaacgaattgagttataccttttgattacattgggaacaagctatcagggaagatgggtgattcaatatatggatgcattgaaaaatgaaatattgtccacgaggaaacaatgaaaactataacacgaacccaatcattcggtcttatcttgaaatacatggacttaatgtttgatatcagcaaagacctttctaaaactgaaatccaagttgcaagagcagagatccgcatgttggctgtactgaacacaaaccatcaggaagagtatgttgacgattggattcgatttttaatagaagatattaagagtaaactatgatttttttaacaccagaagaatataagatacgtttcaattcggcccaggctgaaatcttactgatatacctttcaaacgtagaccttaacttatcaagggcaatggagaaggatttactcatgggtgcatttttggatacagactttcaggagtattatgtaggggaatacttaattgcactcaagaattacattaagagtaaactatgaatatcattgcaaactcacaccaatataccgaacgcgtcgctgccagacaacttgaaattctcatagtatatgaagagactgatgatttaaacttagcattagtattggaaaatgatatactattgggtgcattcctcggcacagactatcaggagcatttcttgaatgagtatataattgcactccagaaatacattaagagtaaactatgaaacatttaagtaactccgagaagaataaaattatcgttgctgcaataaacaaatattttacacttcctcacacagaaggtttatgtgtaagagaacacaggataaacaccaccgatatacgcatgatggctgtactggggactaactttcagaaggagtatgttgatgcacacattaccgcactgatgaactttataatgggaaaggtaaatgaaacacttaacactagatgaatatgaaactatagtccgtaaactaacccctatagcaaggatagtctacgatgaccccagccttacatggaaccaaatgcgagctaaagttaatgagctatggttgctgtactttatgggaacgcaatatcaagataagttttgcacagaatatgtcgaacaattaatgaatgttatacaggataaactagatgattattggctcacaaaacatgaagactttatcaggagttgagtatcaaactgccctattctctttaatccatacccttagaaaaaacaatgccttacatggtgcacctgaagtggatgttatcaacggtgaactttatcttatgaaattcattggaacaaactatcaagatctgttcattcaacgatacctatcagcattaagaaaccaaatccaatataaaaccgtcaaggccaaaaaagaatggaataaacaatgcgacaaagaatgaaccacaaaatgtattgtaaactattgcagacactggcacagaaacactatgacacggtatctgaaatattaccctatgatatcatgcgtttacttcactgtgaggccgagatgcttgtactgatgacaggcactgataaaaaagcaattgccaaatcaatagatatgttcatcgaagcacaatgtcaacacattagaaccgagatatggagacgagagaatgataacactaaatgagtttcagtatcattggaggttacaagctataagaaggaaagttgttagtatttctttagacaagtctattgcacaagaggacaaatgtgttataatagctgaaatgaagttgggtgtattcgtaggaacaaactatcaaaacatctacactgacgtattgttaagtgccttacgtaacaaggtgatatctaaagaatgagaaaattacaaggctttgaatacatcagactcctgaaaacatgtgccaacagaagagtaaagattcaatctgataagagcatccctgccaacctaaaacatgcaatggtagctgaactctatgcaggggcactcatagggacaaactatcaacaaatgtatatagacatgtgggttgatgcattagtcaaggagatccaaagtaaatgcaaatgattaatttaagtaaagatgaatattatgttcgtcttgcaaaaacttatccagcacgtaacgccgtttataatagtaacattattgaacgctcaaagaagttgattgtagtaaatgagattaagatgctttcagtcttaggaacaaactatcaagagaatgctgtactgttgttaattgatgccctcaagagagagatacaaagtaaatgattaatttatctttccatgaatatcaaaaacgtttaaatgcatcaagggatataaggattcaaatcttcaataacaaaaaattgaaacctgacaccagaagaatcaaaataatagaagcagagttatgcaacttcctggggacgaaccatcaggaaggtaagataaaaaactatcttagagaactaatgatttgtatcgaaaataaatgtgatgctttggagaataaaaatgattaatttaagtaaagatgaatataccgagcgtatgacaaaaattacgcacaaacgtaatacaatctatcacaacccagaaattcaacacagtaagaaaatgattatgatgcgtgagttaaagatgggtgtattcttaggaacaaactatcaagatacagaagtaaatcgcttaatcgcggagttactactggaaatcagaggtaagctgtactttcatcaaatgacccaaccactgaggtgtactgatcgatgaatgcgatgaatattgtgaataacatcagattagcagaaagatttgatagaattggggaagcactgagaagatacgataaagaatatggtcatttgagcttttctatagaaaagagatatgaacttgaagcagagtttaaaatgcagagtctcttaggcacacagtatcaaaaccaatatattcaaacttggattgattgtttaatccagacaatttacgtaagaaacattaaatgcaaaatgaaatgatatacttaacctataatgaatacgtcgagagattagttcgtgccaagagatataccaataaacgtccaattgacctaaaccaaaccccagcagaaaggagtgcagaagtattattccaatcactaccatatcttctgggaactgatagacaagaggaatatgttgcacgtatgattagatatcttaaaatcactattaaggaaaaagtaaatgcaaatgcaaatgaaatacttaacagacgatgagttaaaagaacgattaattaaatccagaaaacttacaaatcaacttccaaacgacacaaacaagtcacatgccgaaaggagtgcagaagttttatacattcaactcctgtactttcttggaactgacagacaagagtattacattgaaagtatgcttcgatatcttaaattctctataaaggaaaaggtacatgctcaagaatttaaaaatcctaacagttaatgaatatcataagattgtaatgaaaactaatagtgcaatttctaaaaaatcaaacccaaagtacatactggaacacacatttgaagaacgtcaattagctttagttgaagcaaaacttcttgcactcctaggaacaaactatcaagaagaatacatcagaaaactaatataccttttaactaaacacatcaggaaaagaaaaaaagcatgaaacacttgacagatgatgaacatgggcttatagtaatggatgtaatcaacatcgaatacaaaaagttgatacgctaccgttgttatgaagataagcaactcgttctagcagaacagaagttgtttcgactcttaaacacaaacttccaagcacaatacgaagaatcgtatttgtacctactgtcgaggaaagcaaaaagagattatgaaaattttaaaccacagtgaacaaacagaattgttaatctttaatacaagtaaattcttaaacataacattgtctgatatagatgaggatgaaaaagagttacttagagcagatttaagagttcttttatatgtcggaactaacttccaagagcaattcgttgaggactacatcgatgaacttaaagaatctgtactgagaacatgcaaatgaaaatcctttcaccaagtgaataccacgaactattaagtagtttaattctaaaattgtatatagcaaagaccacagatttacctgatgaagaaaaaaatattctaatgagtgaaatctatgttaattctaccctagggactaactatcaagaatgtaatattaatgattacatcaaagaactaaaaaggtttatccaatgcaaatgcgaatcattaccgacgaagaatacctaacaatcttaaatggactgtttttgaagttatttgccattaacacatcaaaactaccagatactgataaaattattaagttaaatgaaatctatgttcaagctactttaggaactaactatcaagaagccaatgtgtataattacattaatacactcaaaagggtaatacaactcaaatgtcaacacacaaaccactaggaacagcagaatacattgaactaatggctgcaaacttctcatcctttaagaaactgatgcaagaatcaaataatgatttagaatatcacatcaaaagttcagatttaagattactactcactctaggaacagacagtcagtacaaattcgtacaggagcatattagagcacttttaaatggcatcagggataaactatgaagataatatccaatacagagtacattaatactatatacgattgctggacagatgtagcagtactcaagaagttgtcactaccgatagctattcataatgtaaaagaagaagagatttatctaatggcagtactgaatactaacttccaggataaacacgtacagcaatggattaaaacattacaccgtgaaatacactacagagttcacaggaataaactatgaaggaaatatcaaatcaagagtacttggcactattcagaaaaaatagtcaagaatttctgaatcttgatacaaggactgatataagtgaacttgaaaaaaatcttttgcgttcagagatgatagtactgacactcttaggaacacagcatcaagagagaactgttaattcacacataggtattcttatacagattgtactggaaaagatatgagaatcataacacaacaagatattcttaagttcacaagggttcatgcatctgaatttgatgctatattatcaaaaagttacaacaacccttatacacaagatgtacactacaatgaattatgggtgtatatacttttaggtacagatcatcaagagcaagcagtacagaagtatttgacagctttacgtgatgctacagctaatggagtacgtgtttaatatgaaagtactgacagaactagaaatgtatcatagatttaataagtactatcatttacttaagcctatacagaggattaaatgtccatttgaagagaaacaggctttaatttatgagcataagttctttgtatcattaggtacagatcaacaagagtactatttgacgttgtacttgattacattaatagatttaattcactataaaaccacacaatctaaacaagctaataaagagaaatatgaaaactaatatacaactcaaggtatataaatcatttgaacatacatatatcaaaagtagtctatgtagagatgtaatggattacaagggtaagccattcacaattacctatgattcttatgttagtgatttatatatatcatttgttaattacgaaaataaaatatacaagcacgttgatattaaagatttaagtactttatcaccagaggaatactttcaggaatcattagtatgggatttagagtttcctatgccattagtacataagatgatagtactaatgaaagaatctaaacaggagcctaatggtgattatgaagaacacacagttgagtactgaacaatgaaaagattatcatacaaagattacaccaatcttatcaggactttacaaccagaaattaaaagaattaattctcttcctatatctaatgcagaatgttcagtactgaaagatgagttaatcttaaaacacacagtaggaacaaactatcaagcagatagtgttcgatatttaatttgggggttgatgtgtcaaataaagtccagacaagcttgacagtactcttcattactgctatagtacactaacgttaatcattagggtaaaaattatgttaaattttttaaatttccttatcgtcttgtgtattgttcttgggattgcaccatttgtattgtatttcatggattcagatgaaatgcagaagatgaattgcacaaggacaggacagagtagagaagagacgattcttatgcctgttacggttattgttaacaacatgcccattacaaacatggtccctaccctaacgacaacgtaccagtactcttgtacagacggagagaggtggagataatgtgtaagttcaattgtattgtacgtaagaattcatgttacattgtagtagctgattttaatacaggttctgggttgaagatatttgagtacagaaaatgcaataattcttttcattggaaattgggtgcaagaaaaacaaaaacaatttcagtaccgaatttatgttctatctctgaagaagaagagtttcagtacttgttagtacatgatgattctttaggatttacattcgaagatatgaaggaagtacaaaagcagatgattgcacattgtcatcttccaaagaattttgttcaacacgtatgtgaattccacatataagagaagaatatgaaatttaatatagcaaaaacatcgagtatatgtatttttggttatgcagaagagttaggtgatattgacattcttttgtacaaaaaggatggtgttatgcatttcaagtaccaggatgaagaggcagacaattatcttttacctaatttagtacaaatgcaggaagaggaattattccagtacagcttaatatatgacattgatatttgcacgatgccagtattaattagtattcaaaaagtgatgctcgatatgtatgataagctaatacaaggtatgtcagggaggatcattgaaatcgatatataagaatttacctaatgaatatatgttgaagtacaaagagtttattaaagatgtatatgtagatcctttcaatatcaaatttgcagagttcgaagtatcattttatctagggacaatagtacaggaccaatacgttgataatctaataaggtgtttgaaaaaggagatacaatgcagacccaaaggtataaaaaggtagattctttattgtacgcttcaaagtacagggatttttgtttacgcggttctggagggggagaggaagatttcgctctgagattatcagaattcaatatgttattttatcttggtacaaaagaacaagaagatacagttcagaaatttatcaatcaccttgtacaaaaaattaatatgcaaattttgatgcttgagttacagaatgagatgaatgagataaatgaatatgaatccagaaatagttcaggatcttaaaaaagtaatatttcttttgaataccagaagttctttatataaggagttccaagataaggatggttcttttaaaccattatgtatagaattcaatgatttaattacagatgcattgtttgaattttcagagaaatatcaagatacagtgttcggtgttaagaatgctattagtccaagttcaaggaagataacgttatctcattttacatttgacaataaagatttattcagttataatcccagtacatctttatattttattccaaaaggagacaagaatagtcctattcattacggatggattatatcttatgtagtacaaggaaaggagtatcctatcaaatggcacgattagggagtgaagattataatatgaatatattattaagaaatattaatgcagattattgtgtatgggttaagaatcgagatatgatgtattatgatttttatttagattgtgccattaagcgttttttaagagaagaacattaatgaaagacgttaatacaaaagcaataaatgatttaaatgattctttattagtaagtatcaagatgtattacaatatacatttaaagggtggtatagataattacaattattatctttcattagttacaatagagcatttaaattatctagatcatttattacatccaaatcctccatattaaggaataccaatatgaataaaattattttagctctaacatttattttatcaatgttcgctaataccgtacaggccgctgcacatgatgtatatcaatttgattgcagattacaaaacaatgacaaaatcgacatttatttgcacaatacagaagttccgtatttgcagattgagtccacaaagtacattttttttggtgagaattcagtacaggaatttttattcaagcacacatcagaagatgtgattatttctttgcagttcgttgatagttcattaacgctgatgcatttcaaaaatgaaaaaggtttagttaccgttcttaaatgcacaagggtataatatgaatgatattgagttattggtacataagatttgcacaatatcgttagtgctgaacaatacgaatacagtacagagttcccttttaagaattaataaagttgggagtagtttatatttggaagtaaaagctggttttgcaggtcagtacaatgataaaatcaaagaagaagttaagggaagtgaagatgctttcattgaggtttgtgcaacagttggttcaaatccaatttcagtatcacctttaatgcgaaatgaaaattcagaatttgattccagttttgaaggttatttgtggtacaattatggtgatgattattttatatatcagaattccaaaacggattacagtgaagaaggtataaaattcattgatccttacaatgaagcagaagtatttcagacatccctaatatacaatacaaatcaaatgaagtatcttatgttgtttagtacaatgcatttgaatcaattgaaagataatttaaaatttttcattcgtttagaattagttgatattgcttatgatcttttaatgcaaggatatagttatgaagtataaaatgctgtatacaaaagatatgatttatgttgaattagaagacaatgacgatgtatccatcaataggtaataatatatgaatgagatagaattattagcacacaagattagtacagtaatgcttatgctcaagaataatcattctatgcataagtacatttttataggtgatttacgcatagaagatagatatgataaattatcgtttatgtttaaagatgaaagtaatgcaaaagtttgttttgcagcatttgcccaaggcaatccagaacaagcatctcctgttatatacgaaaatagtgaagggtatttgtgggtcaacacaaacgattatttcttttatgttttgaaacaagatgatgaagtagaagcacgaattgatttaattgatattagtacagattgtagtgctgaattatttcagaaatcgttattatacagtcctcgtcaaatacattatctaaagttattcagttcattgtacgcgaatcctttaattaagggttttaaattttatatcaaaattccgcacctttcaaacgtttatgatttattaatgcaaggatatagttatgaagtataaaatgctttatacattaacattaatatatgtagaattagaatccgattcagatgcatggaatttggttaaagaggtcgataccaatcaatggtacatggcaaatttagacgcacaggttgttacggattattttatagattttaatacattatctgaagaagaatttttccaaatgcaattggtggttgacatgtacggacatgacatggtaacattaagaaatatacagaaagtcgttaatgaattccaaagcaagaaagattatgaggtaggagcgtattatgacatcgacgtacagtgagtacaatgaaattcagtacacctacgctaatgccattcttatgggacaaaagttagcttgtattgttgcagccttatataatgcacagaaagcagcacataataaaaaaccatatacaagaatcattaacgcattcatggggtttaaaccatctgattttaattcacatattgcgtgcacgagtcattttgataaacgattcaatacacctgatacaccaaatgcccgtagtgttattggtcttttggatttcgccccaggtgctgttattggaaagaatgatttagaatacgcatggtataataaaaattccccattagtaatggtaacatatgatacagaaacgaacaaagcaatagagtacaatacatataaatcagaggaagaatttttccaaggttcaatgcttgtaccagtgcgtttgttgttttataatgtcataatgagtacagtacacaatagtccattacacaagaatcacaaaattaatttcaatttttgtgcttatgcgattgatggtgtttatgagtgcttaatggaggtattgagttatgaagctgaataatacatttgatattaataagttaagagaatggtttaataatattgaaattgacgccattccttatcatacatatgaacaaagtgatttacaaagtattgatatcagtgagttgtacaaatattatcagagtgcattagagatgcataagttatttttgagtacaaatttcatccaaaattacaattttgaggaatttaataattataatttagtacagaaatatgtagtagcaaagtacatgtacaatcaaggtatcaaaggttgcctcgaattcaataccgttcttattttagttgaggtaattttatgcaccgcatgtctgatttagaattcagtttagatgcagcctttaaatttgttcacaaaatagaaacaatatatcgtacattatgtgcaataacatcagtatcaaaagagtttgatgttggtgaaaggtatcaggtgtggaataattcattttataataaagaacattctgcgacggcattttatattttagcatttaatcccagcaattgttacccagagaagcatgaacgttatccaaatgacgacatgtggtttgagtacaaagaagatgctgatatgtcgtcaattgtagttcctgatgattttaatgcacaagatttaacagaagagtggtggttccagcagaatttagtacatgatgatattgatttatttttctatattgcatttaaaatgctttatcacaacaatatagttaaagaaagtttatcgttttcatgtctatatattgatgatttgtacaatgaaattcaaataaacatgcctgtatcgtaagatatgggctttttttgtttgacacgagtacaaatgcatggtacaatgtgtaatcatttttaaggagatacctatggaaaattttaaaataccagatgatttcaattcagtacaagagattgtacacaaggttcattatatttttaatgaattaattattgccaattcatccggtatgcaaattgagttaaaggatattgatagagaagaagtttttttgggttccccaaattcaatcattcctttttatggacaagatcgtttatggttcatgagagataccccaattgacaaatacaaaatacaaaacaaatcagagttttattatatttttgattgtcttaatattacattacaaacacaagatataaatgcaatgagtgccatgagtgcagaggattattttcagtacagtacagtgtatagtccagaagaaatctttgttgttatgctcgttgcaaaattgagtacagttaattttgggacgtacccaaataaatcattcaagattattattcctgcattcgttgatctttatgatttcattgtgcacaagaaagaaagtacagtgtacgatatgtatcgttcaaatatcagtttatttgcatcaagtgcagtaaatgcagtgattacaggggaattaaaatgaacatagaccaattaatgaagtacagtacaaatacaattccagtgctaagtaaagcattagatgcattcaatgctaagtaccctgaaggttccgagttaaatattccttttaccacagaagggattgttgatacgtacattgtaaacatcagtagtacaggtattgttttgaagcaaaagtacggcgaaagtgaatattatggattgaagctggataatatttcaggagagaagacaccttatgagttttgggttccgaataacattgagtcatggaaaacaaatattaataagagagacgaaagaaatttacctcttgtacaaaataatgaaaaaagaattgacgtattttattattacagtacagaccagtttccagaagagatttatttaaattcagaggtgcatgaagatattgaatcatttttctttcagttatcattggtacaggatatcatgcctgtgcaaatgttcagggatgaaataaatttagcgaaagagatttcggatatgttacctgaatttagtgttctttatggtagtagagctttacctgaaaatgtttacaaagaatttatttccattgttaaagggttgaatatataatatgaccgcctatgatatcaaacaaaggcatacgaagtttgatttgttcacataccaattccacaatgatatagtgaattttaacatcaatgcgtcattgcatcctacatcacaagatgattttgacaacagagtgcttaacatcgtggtgcttttgtgttataatcatttcagtgaatattttaacgccaaatgaggcagatgaggcacacatgtatcaggccaagtacaatacatcatatgagtatgggcacaacattttgaagatcatcaaagcgttagagggtggattgcttagtcataagtacaccagagtaggtgacaattggttcagaaatgatgatgagttcagaagtcataagattgtttacagcaataattacagtgccaattaccttcaggatgttgctatgtgcttcgaatacgtgttacagttcaggggttccatcagtcctgagctaagagaacacatgtacattcgatacctaccaatgcttaaggatgagaaaacaatattcaattcagtacatcaaagagtacgagagagatcattcagggatattttagaagatgaagctgcctattttcagcaatcattgattgatgctcctgatgtgttacagatgcagaatttgtataatgtattagatgcgaacatcgatacggatatctttttttccttaagtgattatgaaacatttttggaagatttaaaggaaataggattatgagtagattttcagtttatatagtaaacgtcagtaaagatggtagtttaattgaatttgatgtagttgataacaatgataattcatatggtattaaggtacaggacaatgatgtgcagttcagtacaaggacaaattttgaaaatccagtccaagttccgaatttcatagaagatgaagctgcacgattccaatacgaaacggcctttgataatttagcgatgcatattattatgcaacaaagtttagttcaattgcttcaggtattcagacaaaatatatatgtacatgaagtgtcgattaatggcattcaaagttccgttttgttcagtacaaatatgtaaggaaagtacaatgagttcaatgagtttattagatacattagaaaaagacagaagtgccattaagagattaaaaaatcttgtccagagcattgcgaacaacgctgagaagttcagtgacaatcttagtataggtgatataaccagtacaggaataaaatccctgaagtcagatttattaattcataaggaagataaattattatttgtattgagttcagatttaatggttgcaagtaatggtttcaattcgatatcaacacaagatggtagcacaggattatatctatcacagggtgtccagacgaacgaacaaaagtgttttagttcaggagtacagaatccctttaagttcagtacagaacaagctacagagcttttagatgcatcagaagagatgttatttcagtacaaaacggttcatacagattttgaattacgatgcatgtacgctgttaagcattatgttcaggagttcgaggatttaagttatcttttagttcgaacgaatacaaagaacattggtgcattagaagattacatttcaaaagttgttaaagggtgctaaagggtgctgatgaaagagttatttgaagaacagttcgatacatatgtggataatattctttattctagtcgtgctagtcaacgaggaaatcgtgcttacaacatagattacctattaacggtgctgagttcacagtacacctacgctgtgcagaggacatattatggataattttagagatgttgcaaaggagaagttcaagtgcagtttagattacggtttaaatgattttcttacatgcacaatgtacaggaatgatgattatgagcaatccgtaatttcgttgcacagatatttcgaaataatttacgcaagatatcttagaaggttagatggaataggggattggaattatgattacgtttgaagagccggaagtggtatattgctttagtgtgaaaggttttgaatacatgatggattcgattttgaaggatacatatttggttcagatttcagttgcagatgatgcagtacaacgagtattgaatatatacgagaagacgagtcgaaggctttgtgcgatgaaaaggattgaagaaatcaagctttctaggctgaataaatagagacgtttcgttttcacaggccgcagggggggtcaaaaaaattttcgctgaaaaacatgttaaggtatatgtttaatataaagttttaaaatgtgttcacagagtacagttcatgtttcctgaaacaaaaaataccccgccgcgaacgttctccttatattggagtttaccttattaattacagtagagattacaattgaaatgaagatgcaaataaaatataatgaattttgtgcaaggacattcatgtacactggtgaattagttacgcactgtaacttatacaagggtgatttaaactacacaagggacaagcttataaaatacgaaaatgctgacttttatttgatggattttagtactgggtttcatgggatatctatcgagatgccggactataccgtacttgatgatgctgcactgttccaggaggcattagtatttgataagaagtacatctgtacattagaagagatagttgaaatccagcgtagaattaaatgtattcacagggaatgtatagatatctggtgcaggactggtgaggctgatttctggaaattttttaatctaggggaagagtgatggaatttgattttgtaatatcagtacattcttttaagaacagttttcagtacttttgtaatttaaacaaaggtgatttgatgcacagtgcaaatgagtatattcatttcactcagggtaaatttacattcattgattacaattcattacagtatccgcatcaggatatgccggattatacagtaatggatgccgctgaactatttcaggagtcattagtatttgataagaagtacttgtgtacatttgaagaagttattgcaatacaaaatgaaatgaaagagtatgactctttgaataaaggcaatgtcagtattaatcaagaatacaaattcaatataggaattccagaatgacatttgatttttctatgtttatacctaagattagtacttcactggaagtgtattgcaatcttaacaaaggtgattatgaacacaaaatggatcagtacattaaatttaatggttcttactttagcttcattgattatcagaccaaaggaacagttgtagaaaatatgaaagactatacaacagtacagggtgaggctgaaatatttcaagagtcattaatatttgacaagaagtacttgtgtacactagaggaagtcattgaactccaacagaagatgaaagaatatagaagaatctgtatagagactgattccaaagataggtatagttttaagctatgaataaaaaagaacaaatggaatcattcatgaatacaatacttcgacgattcgtaattgatattagacataacaacagcattaggaatgacatgtacttcggtacatatgatattagtgaattgtatatagctaatattcacatggtttaccgagattatatcaagacacaacacaggagttgatatgagttttacaagagcattagaaattgctaagttaattgatttatgtaaaaaggaaatagtactcaatcgactcaatgggtatctattcaaggaaggtaaagcttattgtcgaatgatatacgatgacagtagtgagtacattcacatgtacgaagaaaacttagattcttctgaaacaacactcactgggtgtgatgttaatctggaagataattacatgtacttctgtcgtgatgctgatattttaatacaatatactgacattataactggtgcagcagaaaaacatcttccgtattcagtactggataatgactggggaagtgaagagttctacttccagcagaatactatctacgaggaatatgtgcttgacaagcttgtcattctgtggtactttaataataccgattgtcctagcttctatctggacttggatctactacgagttattaaagaggatatatgagtttagcaagtgcacttaaactggcacacaaaatacatcacttccacgataacataaaaagtggtttctatggtgataaagtaagtgcatttggtaatgagtattatctatcaggtataaagacatactctgatgatattttacttatgggccatgataaagacaatactatacagtactcttcatgtagtcaatatactagtttttttgtatatattccaggtactaagattactttcgacacatcaaatacacctattgacttcggggtacttgatgggccgtggggtactgaagagtattacttccaacagagtcttatttttaaccaagaaatgcttgattccttggttgttttgtggtactttaaggaattgaattttgaacccttcttccttgactggggagcatgtgaatatttaagtacaggggattagtaatgtcattagaaagtgcattgaaagaagcaaagaagattcatgagtacatgattatggtacaagaaggttcagttcctggggtgtataaaacatctgatactgaattttttgtaaaagaccgcgacgattatgatgagtcagagatatgtgcagaaacgttagtactacacactgatacgggtgatactgatgactgtgaatatcatatgtacaatcagtacattagttattgtagagatgaagatattataatttacagccctgataacgatgattatgacacaatcattccgtattcagtactggaaggtccgtgggatagtgaagaatattacttccagaacagtactgtgtacaatgaagaagaattagatgttattgtaattatgtggtactttaaaagtattggttctggtagtttctatttcgattatgaatacgtagagaatactgtaggggaagataatgtcattacgaagtgctcttgataaagcaaaagaactacaggtatatattgaagatatcaaggctgggaagttcgaagaagtatacaaagccgagaatggtaactactacaaggatagtgattttgctacaactacagttattcttgggttgaattccaaaagtcccgcagatttttcacaatacaatccagatgcagaatttatcagttatgcttatggtggtgaaatccgtttttataatcgcagtagaccgttaaaattgaactttgaagtactgaaaggtccgtgggatagtgaagagtattactttcagaatagtactttgtatgatgatgaagtactagatactttagttattatgtggtactttaaaagtattgatagtacaagattttatttggattatgaatatgtacgtgaagtatataagggtaaacgatgaaattcttatacagtattcagtacattccaggtacaattagtttaatgtatttcttcgatcatgataatttccagcaccttgccgttagaagatgtaatgaatctttaatgattgaatatcttcacgattgtgattatattcccgactttcttgaatgcgattacagagatgatcatgaaacatttctttttcaggaatcacttgtatgggataagagaattaatttttatgctttacttgagatacaaaaacaagtgaagtactactgggattacttaattacccaagaatatatagagattgaaatataatgtacgaaagtgatcttaagcacgctgaggaattagttaatatagtaaagttctttcaaaataatgtaaagtacttagactataaaggggcatatattagtactataagtgttggtacagatattctaggattaggtaatgaatataagtacgagtcacatgattatgatttggaattcaagtacttcgtatgggattctggaactttctattatatagaggaaggtggaaaatattttgaattcacagaagaagaagtactatttttaaattcagaagatgcttacttccagtacagtactatatacccaaatggggcgttaagagctttagtagtttttaatgcattcctgaaagagaactttaataattctatattcattgatttagattatgtatatgaactaaatcaggtaatatatatggagtccagagaaaaatgagttatgaaagtgcactaaaaaaggctaatgatattctacgcgttgttcagttcttaaaggactatcctgattatgtagatgatgaacgaagagaagtttctaatggcacgaagattacaattgattctttatttgacactagcaacgacaactgtagtactattgaattagcatacgattatatttcattgaacagaaaatatgatgaagttacgatagagcgtcatgagaatgaagaatcttttaaaatttctgatattttatctctgagtacagaagaagggtacttccagggaagtactgtttataatgaaggaacgcttgacaatctatgtacatttagtgtactatatcagaagtcagtactggatatattttatctagacactgaaaaacttgataggttagttgatttcgttactatagaagaggcatccttttgagaaaaattaacattaatgattatgatgcattacaagatttatcaaaaaagattcgcactatcgtaccagtactgaaaaaatgcagtactggattaattgatcctagtacagttattagtgagaagtacgatttccataaactgttacaagggaatggtgcattccagaagtgtgagatacgtgagaaacacgtcattgatacatcattgctttcaattggttcagccgttcataagaatgttgtataccttgaatccagatctgaaactattcgacagatgacttttaagaaaaagtgtactgaaattgacgtgtacactatgatatggggttatccagagttatatcgtactattaatattcctaagtacaattacaattcatttgaagaacagtgctttcaactttcttgtactgatcctgactatgctattattcagttctatatggaattacagatggcatttaacagtaatttaaatatcaatttattaaaggttgatttcgatgaagtattcaaaaacatttaatcgaattgaatacatgagaactgtgagtgcagtgtgggatatatggttcactactaaaccaaaaatggattaccatgactttaagctattgttcttcgttggctctaacaaacaggatgttgcaatgaagggttatattcagcacttacaggaactaatacagaagagggtttatgaaaataataaaccaagatgatattgctaaactattcaatatatattcttctaaaatgatgcaaaccgactcatatagtactgaattcaaagaattaaaagtactgatgtatttgggtacacagtatcaggaacaagttgttaaagaatatattgattctttacagaaggatatccgttatgtacaatgaacttgacttggcatttgagcgtgtaaaaatcttcattgaaacttatcttatgcatgaaactatactgaaaacaaaaggaatatggttcactgataaatttcttactatggctatgagaggtggaatgaaacatctgtactgcacagataatgcaagaatttcagtactgaattatgatgaaagtgtagcatccagtaccagtttaatttctacatacaatgataatgttattagtattatgtgcaatatgaatgtcccatctatttctgtatataaaaactgtgatagttcattggagtacaagattgagcagtacttatatcctaacacagaagaaaacatctttcaaaatagtcttatgtgggatgatacatctactaagtgcatatatctttataataaattaaaagagtacattgttgatagttcaattagtactgctgtattcagtgttactgtttttaatgataatcgtgaagatatgagttattacagagacattgtaagaatacatgcaatgtataaggatctactatgttattaaatgcaaataaatgttgtagtactgaggttcatttgtattttaagaaattagtaaatgatattatctatatgcaagaaatcatttatcacaaaagaatggacttagaaaaagcattagttcagttctcttttaatctcgatggtgatatatcgttagatggtgatggattgcgtatagcatttgacggtaatacaaatagggttttcttttggatagataataaattatgttcatcaatatgtcgtactttttataaccctatttcggacttatatcaattggtgtattctaaaggtgcagttgaagcatcatacggtgatagctttgcactagggaagagtatcccatatatgcaatcatttgatattgaattagtcagtactgatgaagatgcgatgttcacaaatgatataacaatgcagcgtgaatctgcaatgagatatattacaaattctatgcatacattcttcgaaagaacagaatttgataatgtgtatatagcaaatgtaaatatttttactgacctttgtcagttcttgagaagtatttttgatttcgatgaaagctattgtaagctttatactgaggtttaaatgccatgaataccattagtattacgtactacacaacgaaaaaatacgtttgttgtttactttcgttaaagacaaatgatgatatgtttgaaatggcggcatatacattagaattgtcagaagatggatttcaatgtcatgaagcgtactcaaatacacgtgaagatacaattgatactacgctaatgcaagaagatgagttatttcaagaaagtttagtatgggataaaaaatactattgtgattttgattttctttgtttaatccagaaagaaatgaaaaggatcttcgacaattatccggtgaagagattgagtactaagccggagcagtacaggagaattttattccgttatgaagactgaattagtaaaaataatgtacgcaactcacaccaagttattattggttaaaatggattataacagaaaacataatgaattctgtacattaatccgaaatgaggaatcatttacattgcgtaccaatgataagccaatgctaactataaatgatttttcatgtttagatacaggtgaattgtttcaggagtcattagtactggatagtagtatacatttggaaattgaagtactacaacagtaccagatacttttgaatcgtattatggaaaattatccatgtgaagttggtggaccaatgcaattcaaatcaaagatgtatgaactatgaggttagtatgttagataaaataaagaacgagggaactctatacaatcatcttaagttggatacgtttgaggcagctatcagtactgcacaagatataattgatattatcaagtacattaaagaaaataagttaaaatgtgtgaaaacgccagaacgtacaatgtacaaagatgacgaccttcacgtatcagttgttaagccaaaagataaggatggtaatcgagatttctataataacagtgggcagtatgaatgtgaatatgatcccgaatttagaggtggattcatgtgcttcagtaaaactgatacttcacatgttgagatacgtacattaaaaggtataggtagatttgagttcatggatatagaactaaatgaagaaaactacttccaacaatcattgcttactactgaatacaatttaggtgtactattcatgtacaagtacttatatgagcacttaaatgaagacttctatctggacttagaagattaccatttagtatggaaagaaatggtagaacttcgtgagaactcttgacaccccccaaatctttgtgatataatctctttatattaattgtaaagggttatatcacaatgtcatccgacctcaatttcgataatgcacaaaaaatcgcacaaaatatcattaaacttcataagttctttgtaacagttaaagagaatataattctcccaagatgcacactttatgcgtacaaaaattatttgtcaatgaatagcaatttgttgcatactacagatgagaatttctgtggtattcgtgtacttgacgatgcaccaacaggggattttatctcatattgtttccatacatctgatagttttaagtactatcatcctagatttaatgatgatgaatatgaatatgacacatttaatgttagatcagaagaagaattcttccagtacagtactttgtacaatgagagaatcgtgtttagttctacaatttttacagtacttaaagatgaactcaatgacgcagatgatagattctatatggatttaaacttcgtagatgaaatcattgagtacatggagaaaaatggtctatgattacaacagaatatgattacgatggtgttttagaatttgcatctaacattcatcgcattgcaaaggagttcagaagtccccaacctttcggtggaatgccttttggtggaatgttccaatatgaccaattcagttcaaccaaaggaagacttgcctttaaaaataataagggcaatcaagtatatgctgagttctttgacgataatgactttcactacagagctgaatatatttcatattgccaagggtctgatttgaagattaacattgatacatttagagattcagtgtttatcccttatagtgagttagttttcatgacagaagaaatgtacttccaagggtcttgtattcatgatgcaaaagtacttaatgctatattactttatggtgcactacttcatcattacaaatacaaacaacgattctttatagatttagttgtataccatcaatgcgtggattatttgaatgcataatacaacaacaattcagtacatgacggatggcaatgaatactttgcttcaagatatgaattcaacaagaaccatttcgtaacctatatccctgaatataatcagttttatctacagatttaccaaaatgattcatatatgaatgagatatattctgaaataaaaatccctgattatagtactttatcagaagaggaattgtttcaggagagtactgtcagtactgaagatgtgtacgaactaatggaataccagaaggtacttaaatatttccatgaagttcaggatatacaaatggatagtgttaaagcgtggaattataacacatacgaggtaaattatgttcgaaatgattaaaattatgcaacgatgcattgttgaccaacatggaatatatggatatagtttaagtgcagctattgacaaaaacaaaacaacctatgtaagctataatgcagtacttggatttgatatattcattgatgctaacaataaaatcaaacaagctaaggatgtgtctataatgacccctgacgagctatttcagtacagcttagttctgccaacctgtattgatttacaacgcctaggagctatacagaaggttttacgcgaacataaagtacaaccaaataaaattacccacatcccagaaacattctacaaacccatagaagtagaaacacctgattatatgttaagtgatgatgagttctacaagaaacacttccctggtaaagtttggagagaataatgaacagaaagtacagagaaactatgaagttcgctaaggagtgtttagagacatttgatttcattttcgataacaaagactcactgggtcatcacttcgtaattacaaagaaagaagataagagatacaagtgtcaaagattaggatacagtattgagttctccttaatgattgacggaatgataaactccttatatgaatgtggtaagactgattacatttcatttagatcatggagtgaaggtatcatgttcttgagaacaaatggagttatatatccttttattgatgatttatcagaagaaagttactttcaaaatactttaatttacacagaaaaagaactcaagatgctattcattatgtcgtactttaaaaagtactgcaaatttaaatcattagcttttgagatttctgcaatgaaagttttcattaaaaatgtaaaagaattaaagaggatttacgatgtacatagaaaatgataatgtaaaatgcattactgacatttgtataaaattaatgaaaattttcattaacccaaaatacaagactcgttctttacgtcataacattgatgatcattgtgtcattactattctaggtagtatgcttgatgtaaagtacgatggtaaattgttattcggtgtccgagaagagaagatagatgatgtcttcttttcgcctaaagataagtttgaaccttctgattataaagtaattattcgtgatgatagcatctacattagtagtgatcattcaaattacttaaatcaaatatacactgaaaatgttgactaccaccatgaactactagatttaccaaaatcagacatagatatggagagaatcaaattttcattatcaaataatgagtacttaggtatacaaacatattatgcacttcaaggaaagattccacctgctatgtatataaggattgagattggtaatgtattcagtgagaaggttatatcaattgctgataaaatattgaaggtacaattatgaattttactaattataatttccatagacttgaattacgtcattgtattgcatttgcaaaaacattaatgtgcatcattgatacattatcatctaaaacttttcgaaaggataatgatttgtgccttaaaaaaggtaaagtacaaaaatacgattattcaggagaaacgtattttgatatctttttgggtacaaacgatagtactagagttggatgcataggaacagtaggaacacattgcttcacatggaatccaaattcaagtacagtacgagttgactttaatgatacaagtcatattgtacttagtactgaatctgatttagaatcagttatgttccaacacatgttaattcataaaccaaatgaaattctttatcttgttgcttttagttatctcttacaaaattataaatcaggttttactattgaaactgatatcgatgagattatggatgagattcctagtttaaaagatattcttgaagaaaaagatttctatcaggactttagagatttatacaacatgcacagggagttatctgataatgaataaagatgatattctaatcagactaatcaacagtctgttaaaattcgtgaatagtgatagtgatacacacaatgtaggtgacattgaattcaaatcatttggaatgtacggtgaggacaaaacatattatgcatcaatgaaattccaagattattatgaaatgttaattgcgttaacatacgaagatgtggacccaagatggagttccagtatttctctgtcgagaatggtaattcgtagtaaacatcgttacatttcgtcaaagaatactcctaatttgtttgatattgttttgaatgaaaataccaaccccccatctaaacatgatatcgtacctttaactgatgaagtacagtttcaattgagtaccatttgtgatgaagatgtgatatcatgtatgaaaatttacgagaagattggtagtgatatccctaagaactattacataacaatagatggcacgtacctccgagatgaggctctagcgtacattgacagcgttttaccaaaataaagacccttatgggtctttttgtgtttagtgctttacatgagcattcaggtgtgttataatcgcttttaacagagtacaggagaagatatgagtactgaattaattaaagaaatcacattgttggtaaagcattgttttaagttcattgatgataatggttcacgccagtacattaaagttaatgagaaatataacattaacgtcctaaagaatgaaaccgttaacagttatgcaaacattgagttagatgttgaggacaaatacacagcattacacatcatttcgtccggcgatagaaaacaagattatcgttctacattttatgatgatagtgttactgttggttataaatttcataaaaataaaattgcttataagaatacatacacacatgaagtaattgaagagtacaattataaaattaaaaaagacgagtacgatgtacttttattcaatgcgaacctcatacacaacactggcactgttcgcaatcttatgttagcatatgaaattccaaagattatagaaagaaatgaattgataatctttaaaactatattaaaattcagtacagaagaattagaagatctagtactggctcttaagacgttcatcaatgaacatgtacctgttaaattagaggacttataatgcaagctgaacacattcaaattatgaaattgatgcatgacattgcagaactatctgaaaagcacaacattactgaacatgagcctattggaaattatcgtcttaaagttgaatgcaaatcaccatatcgttttggttcagtagtactggagtcttataaagtttacgattatggaacgacgaaaaaaggttcatgggatactatggcaatgtatatccgcacatcaaggcatagtgagcaaatcggttccattactccaaacatgatatttgtcaatgctttacacgaagatattaatcgaattgttgaatctaattttgatgacgtagagaatgatacatatttggaaattccaccagaactagatcaaagtgaagacattcgtgaagcatacattttccagagatcagtacttgacaacttcaaggagtttgagtacatgatgctttgctatgaaactgcaaaagctattgacactggtgaattggtaatgtatagtaagttcattaactgtgaatccgatacattaaaagagctacacacggcaatcaaaaacatcaaggatacatatgaacgcttatagttatatgacagcccgacaccaacagctatatgatatcagtacaaagatgctacacattgttggtagtgccaaagaaattaacaaacattacctcattcgtgatgtgtcattttcatctaaatgtttgtccaaagaatattacgatcacggtattcttactatttctggtgccaggaatatttgtattgtaaaaaataatagtaaaagtaatgaagagtgcgaaattagatccgatatccaaattaatgatgatggaaatttttcacaccatccattccatattagtactgttggtgttttatataatattaaagtactattcggtgatgaagagtataagttaaaagctatcaatccagaatcaagtacagttgatgaagaactgtttcagatgagcactgttatacctgaagaggttcttagtactgttgttttttgtagtttaatttatcacgaatacaaaaagaaccagttcgatttccacattttaggaacgtacattttcaacactttgagtgttgaccgtttaaaatcattaaatgcagcgatggataagatactataatgacaagagaagattgcttgtatatatgggatataattgacactacactttcaaatccagaaaaatataaaaaacaaaaaagacaacgacacaaaatatggatagatttgttcgttgagggcatacacgcagtgactatttgggattcaccgagggcatcagcatctactctattggacaatgaatgcattgattgcattaattccacttttcatctctacggtactacatatttcggtacatttctagatattgaaagtaaagatgatattgattcacttgctttacaatacggagtactgtatgatactaaattaatttacgatttagtactagcttcttatgtgtataaattaatgatgaaatacaatcacatttctgtatcagtttataccaaggatattctttcattaagagacaaaacatgagtttattaaatgcacgagaattagttgagatgtatgagatcttatcttcatataaaaattctccaaaagatgtaattctcaacaaaaagttccatgtcaatgttgatcatatgaaaaatatagatatgatttctttagtggaaagtagtaaatcgggtcttgagcgtgatatcatgcgtttgatttatattaccaaaccatcatatactaatgatagttcaattagtaatgagacgtttttgtacactccttatactgattgtactttagtttcaatgtctaatcagaaacaagatactatccaattcatcaataccagtactgataacattgaagaaaatgaattccaaaacaatacattaagttcatgtagtagtgttataacctttatgtcatatctgtggtcaatcaaatcaaatgcaattgtatatagttcgaactatacacacgatagtattgttgaatcatataaagttctaaaggaatactatgaaaataactaatgattttattagaagtttagttcaccctatgcttggtgttatgaaaaaattacagaatctacctgaagacaacgattacaagtttaatcgttttgattcagatgtgttttgtattgaaatggaaattaataacaatcgttattttcatttaaaattcaaagaatcgtcgagttcgtactacaactttgacatgaattttaaaataagcaatgatattgaagaaaacgcaatatcaaatcatattagcagaaatggtttcatgcatagaactaatatgttcaataataaaaacagtattatatctaaatggaaccatcaattcactaaaatttgtgatattgattgcagtacatttggtgaagaactatactttcagttaagtacaatacatgaacttccaccatatgattgtgtaaaaacatggtttgatattcataatataattgatgatgcaatcgtacttccatttgggttgtcaatatcatatactgcacctaaaacgtttgtttttactgaagatatgattatgaaaaagatatgggcgatgatgccacttatgcttgattaacggagaactacatgaatcaaagtcatgatctttttaaattatgtgcatccaaagatgtggaaggatgggcagataaaatcaatacaattattaaccgttatcttggcttctgtgcacgttcacgaagtgaaggttcaatgcgtttccaaataaccatgtcaatcgatggtgttgtaatttatgtagatgaagaaaaactatctattaatctatatgattcatgtgtatttgctattcaccagaaaatggggacaggttggggttgtaataatatgaacaccaatgcttttttctgggtaggtcatagcaacacagtacttgatccttcaaagaaatcaaaccttttagatgataatttggtatatgatttagcttactctgaagaacaacatttccagttaagtacaatacatagcttagttcaatatgaagattgtatcaaagcattagaattatgccattcacttgaacttaaagaaaaattgatacaaatttacccattgttcttccatgaagaagtacaatgcacactagatcatattttatatgggtacgacaaatgagaaaaagttatcaagaagctattgacctaattcgagaagttattaaggtggctcctggtgcgatagcattcaagaagtccctatataaaaagtatggctctatgtcaagtatgtgctgtcaaaagaaacgtagtaaattcactacgcagtactggcacgattctattatcctgagtaatgaacatcagcgtattttaacaatcgaatcagtagataatcaatatggtgaaggaatgatttgtgttcctgactatgatgaaattaatttcaattgtggagattatgagacaacattattattacacgagggttaccctgaaggtgatgtaatggcagagtataatccaaaaaccaaaatactgaaacatggtatgcagttcaaaatcaataataaagatgatgtggaagcagcactaatgcaacttagtactagtgaacctatcactattgatgtagaagagttatggggcatcatttcagtacttaatgagtgttataaaattaaatcattacataagtactctatcattttacatactaattgtgcaatgataaaatgcaagaacatacaagagatggtggttccagatgaactttaaagaaatagaaagtaaaattaagtacttcaaagatattaaaaaactttgggaaaagtataaaattgattatcagttccaagatgatgatacggttcaaagcattgatattaatattcgtgtgaagttcaagaatggcaattatggcgaagttaaattgaatgctattggtgtattccttaaggattatgatggttcttcactcgctcaattcgatttcacacctgatcctgatgatatgttattgagtgaagtcaatgcatatgaccttgagatgtttaatggtaaacctttactattccgcttatcagatgaatgggatgagatttactacacatacaaagatggtgtgattcgagacgtaaatgatgaagtagtaaatgatatggaagaacgtctatttcaagaatcatgtgtgtcatcggagtcatatacatatcaatatctacttgacatgttcgatttgtatagtaaaatagattcagaaatgagtacattgggtattcattatcttacaatcaacgactttgcacaacttgaaacagcggttaaagccctggtcaaagtactgaaataggaatgaataatgaaactgtatcatgcgagtactgtaaaaattgataacttttatatcccgtatggtggccttcatatgggaggtaaacacagtgctttagaagctgcattacgcaaactgagaagcccactaaacgtcgttgacgctgatacagtatacttgcataccttagaagttgatgttgataacgtgcttctatggacggatatgggcagtgatgatgaatggcgtggagtgattgagtactgcgaaattaacggctatgatgcagttcagtaccaaaacgattacgaaccagatacagttcctagctatatgatttgggatacgtctaaggttcgcattattgaagttgatgcgatgcatatggatgaagctgaaatgatcatcgaagatttccttgatgaatatgaaggtgtataatgattgaacctatgacagtactagcacgtactaaattattattgaagattggtgagatattcactgatattttgtacagtgggattgatatacatgaattaggcattaagcaaccgtgggaaataaccaagttctctgcgttctatcgtttatcatataaaggggaaacggttctggactggaaccccaaagccaaattcatggaatatgcggcgttatatggaagcaatggtggtataacaaataattttaaagaaattaaagtcctaattgggtcaaaggaatttaatgatctactatatccagaatttaagttaacagaagaattaatatttcagtactctttgattttaaaagatcttaatgatttagagtactacaaagagttagtagatatttttattaatactcgactttcaaaagatattgtgatattctggtatgttgagtatgttacagaggaattgcttgaagaatttcttctaaatatgacagcaatcaaggagaagttatgttagacattttaggaaacatcgatacagcaaattattttattcaagatgcactgttcaatacagtacagaaagggttggatgtacgatgtaatatccatcagggagatgggtattttgttgatatcactgaaacacgcaagaacgtgttcaatttaaacattacaacattagcacgtcagaacattgcacgtattttggttaataaagatgaagtagttcttcgttataattccaaattcttgttcacatacaagaagaagactgacatgttcagtactaatttgtttgatgaacccttcaatctagaagacttagaagcaactttctttacacagaacactatgctgaaattcaatgatgttgaattttcatcagaagtaatgtctgaaacactacaaatggttaaggtagtattctatgcttttcaacagtttaacgaagaacgaaacaaggttaacaacaacagatgaactaatcgcggcgatgggagccaatgagaaatacttcaatgggattcatttttttaaaacggatcttagtgaaagtaaagtactatatgtgtatggttcccagtactgcattgttacaaagcaccccgacgcgatttcactaaaatttaatacttattcaaaaaacttcttgacgattaataaaagcaatgttactatgtctggtatagggaatcaggttgttgagattcctttggactcaattgattctattgagttctttcaatacgagtgcttaggtgttgattttggtactgtcagtactggatctatgcgaacattaattaatctacttaaaggtaaagttcatgcttttaactaattcgatgaagaattcatttaaaattatcaaagaaatactaaatggttctaaaaatcatagtgggtcttcctttactagtgaccagatccaacacagtacaaaggattgtactgtaatctttgggttacatagtctgcgtttgacaatagtaaataatattgataacacagcaattgtaatcaccccatgtcatattcagaatgaaactggtgtatacttacaccacatggggactgtattctacatcttcaatactgaagaaaacattgttaaagaatacaacacactcaatgttgatgcgggtgagttatttcaattgagtactgtcaatgattgtaacttcagtgacaatgcagaagtacttccattgtttctaagtcttctcaataacatggaaaaactaaccacggcatacaacaaaagtgacgtaccgcaagcagtattgaatatcaccgaagcaatggagaaatacaaagctgtgacctaatatatgtgcacatggagtgcctttgaagatcaaggatagatcatggagattaaaactgttgagaatggaaagatagatgacattttagagttggacgcattcaaagttcatgatataatgttcaatgtaaaggacataattcagtgcttgtttttatgcagtaaaactatgcacgacttctttcacaatccaaatactaatgtttttatactaacaatcagtactagtaattcgtttatcatgggtatgcctatgagtacaaatgacgagtacattgattgtgttattcgtaacaatgataatattaccccacaatctgaagtacgtaagaaaaagaatacatacactatcaaagatgataaaatcatgatgtgttgtagtaaagggtttattttggataattttaaagtgaaagatagttatcatgattttaaagtatcagagacacaaactaatgtagttctttacgcaagtgatattgaaagcctaacagttaaagatcccgatttggagtaagtatggctaaaaatgtaaacaactttgtacaaaagcatatgaatgagtttaataaacctcaaacacatgtggaccgtaaaaaagcaatgaagaatggtaaagtaaaacacaagtcgagatttattctcgactaattttttgtccaaatttatggagattgtatatgttagatagcactgactttcgcaattttaaaaagtattcagtacttgaacatatcaacgaatttctaaattccccaacaccatttggcatcagtacatcagatacatacgatggatatagaatcttcccatgcaatgactttcaaatttctgtcaaaaaaggtacttcaaaagaagttgcaattcgtgatgtagtactgtatagcgattcttctatttcttactgtcatgatgtgaacaattttgaatctctttcaacacctaattgttcatactacaaatccaatgacactatgatgtacaaagaagaacacatcaatggggtttcgttttataaaaccgccagtgataaatcatatacatctagagatgattttggaaaatatacatgcactatgtatacggatgatgaaaaatcaaatcgtattcattcattcgaatccaaattcaaagagagtgaagtttcaaatatcactatacaagaaaaggttaccgaagatggtgttgtgtatcgtagtactgcattcttccgaatgaaagatattgcaactggtcgcccaatgatgtataatattgacatattcatgaaaggtgaaacatcggaagtggtgattagtactggttatcgtgccaactacacatttacaatgcattcacctgatgcatcgttggtacatctattcaacaatttatatactttccaattcgaacttggtttcgaaacaaatgaatatcaaatatttgagatattaaaaagtaatattattaagaaattggaatattacttccagttaggcgggaagatgaacatagttaatactatgttgtgcaacataaaagaaacaatgtaattatggaggatttggtatggatactaaattcaaacttattttcaaaacagaaccgtatatcccttatactggtgaacgttttattccacctggtgctgtggagattgagcatcctgatggaacaaaattgtatctcagcccatgttcgtatgaacgtgcagttgaaatgctaattatgaatagcaaacactgtagtaataagtacattagctacttatacaatgaacatattctagaatttaatgatgagaatatgtttatgctggctattaacgatttcaataactggcacgaaagtttgactatttgataaaatattgtggacataacaattccttgcgatataatgttcacatctttttttgataaatggagatatagatgaatacaagttctgttctaaaagcgattggtggtgtacttctgattgaagtccagggtgaacctaagctatgttgcttagaagacatgaagaatactaaacacttcagtactggacagattttcaatgctattcgtgttcttaacgacaaatcagtacaagactatggaaaggtatggccttcgtatgtaaatcctgaaggtgaaattagtgctgattggaaaacaattgaagcagtacgtgtgagttgtgagagcgattgggatttcatcgttgaagtatgtgaccaactgcaagaagatgtgccagagattgtagaacgtaaagaagttcttgcacaacttgataaattccgtcacggtactctaccgtatgacgtaatctaatctgatttattaaaaactatctaactaacattatataaaaaggaatttaaaatggaagacaacggaatgaaatttgatatgtttgaaggtgtaccagagttcgatttcaataaacttgaaaatggtgaagaatcagaactagtaagtgttacactaaaatcagataccaaaaagaaatattccccatcagttcgttcacgttctcaagaagaatatgaaaccttcattgagagtattcattacgaaacgttccatcatgcagatggtactccgtatgaagttcgtgttacagtactgaagcctgaagtaaatccaatggaaaatctacgtcctgtttactgctgggcaagccactaataaaccaaaggacgggatataatatctcgtccttttttttgtctggagatatatgaaactttatctaattgttgactacagtaagggttattatgactacacagaagattctgaagggtattgctcgtctactaatgtaaatgtacgcagcagtagtacacatgagcatgaatctattacaaatctaaaagattttattgcataccgagcatttgaaaagaatttctgtcgtagtagatattcgaagtttgagtacccgttgattgatgttcctgatgaattgatgttccagttaatgctcactggagtacaagattatgattacatcgcgtacaatcacattactaagaaaatttatatcggtacgtcaacacatgacatttctatgtatgcatcatgccctgatgatcgaatgaaggatagaaattcacgaaattcatacagtagtggttcagttggtttaaatgatgcattaaataaaaatttattctttgagtacgagtttgataatcatcgagggaaaaaagaccgagaagattattgtactgaaattgatagtaccaatggatatgaagaagtgaaagaagcgttaatgccatatatccttgacaagtactacaaagattttcagtactgtagtaattttctaatcagaaattctatcataataggtcgtcaaagtactgcattctctaagtactacaatgattcccctgttgctgaaaatgaaaactgtaatgttctctcaatcccacgtgaagatatggtattcatgttcacatctttcattgaagatgatgagttgtatgtaaaaaacaagcacaggttcatgccaagtaagattgaggttatgagaagcttaagtgcagatatcttaacgaatttcactgaaaaaacagaatacaactgagacataccataagtttatgatataatgtaaggtgacagcagaatatgttgtcacctttttttaatcctgaaaggttccatatggaaatgattgaagcctaatccactcgaaaagtagagggtagatgagtagtcctttcagtacgaacagcaaatgaaacccgttagatgatggcatagtttgaaccactcacggcaatgcggctgtataaagaactccaataggataaagagagttcctcgatagacatataaggatcgcaccctaccaattatctaagggagatttcatgagaaatttgcggtcgtaatttatacaaaatagttgcgtccaaaattcgtgaaatcaaatacaagtactggtcatatggtatttgtattatgtgtcgggatgtttaagaccgacgaccgttgctacaagaaccgcgatagagagaaacagagcaacccgctttcgcctcgtaagagaattcgtgatatgaactatgtgaaggccaccagcgtcaaacttttttgttctttcccctgcggggggatgaaatatgctcaagcaaaccccgtcaatattaattaaaacaaatcatagtactttcgttgaattagacatgcgaagcgtgtataattcgactggtgttgatgaagtcaacgccatgtacagtcattgatgtttccataggaataatgatgtcatttattaaaaaatctaaaagcgtcacttataaaacactagaatttgttgattcagacaatcagaaccaagaccaagagaattttactggttttgttgtgattaaagaaaagggatgtatttcgtacatcaaagagttgcagtgcggttttgaattaacttccattaagttattcccaaccaagaagcctacaattcttaaagctcgttatgggaactactacgaagagcgttatagtaataatctaatcagtgcgaaagcacatatcgtcaatggagaactagaaggagaatatagaaaattcaacccacaaggaaaatgtgtttgggttaaatacttcaattcaggaaatgatgtaacatcagaaattattgagtttttaggtttaacatgtacccttgaaactcttcatgattacaaatttaatactgaagaagagtttaatctgatgatgcgttatggatcacattttaaatttttatatgaatacaacattgacagtagtacttttgatgacatagtacttaactgtctataatcaaaggaaattatgtatgtcgaagaaggatgcttcgaagaaaaaacaatcagtacatttcagtactggaaaagataactggactactccaaaggatttctttgaagatttggatgaactctgggaatttacactagatgcagcatgtgttaaagaaacagcattgtgtgataatttctttacaccagaagataattcacttgaacaggactggggaaacaatatcgtgtggctcaacccaccgtacagtgatttgaaaacgtggttatctaaggcagttgatgcatataacaaaggtgctacagtactgattctcgtaccatcaagaactgatactattgcgttccaggactatgcgtctaagttatgcgactgtatttgttttataaaaggtcgcttaaagttcggtatccctgaagaaccagataaaaagacggatagtgctccattccctagttgtttaatagtactggataagtatttgactccagctaaaatcaactatcttaaatctattggtcaggtgatgaagaacatatgaaagaaacatgcgtagtgacattcggaagaattaacccagtacatcgtggtcatggtttagtatttgaaaaagctcaagcactacaagaacagtacaatgcggatttgaaaatattccttagcaccagtactgatgccgtcaaaaacccattacctcctgaactgaaaatgtactatacagaaggattttacccatctgtacaagaaaatatctatacagaagataatctgtttgatataatgagagaactggatggaaagtacttagatgttcttttcatatgtggttcagacagacttgaaccattccaaaaaacgcttgacacgtacaatgggaagttatataatttttgttcaatcaaggcagttcaagctggaattgaccgaaatgtaagtcgctacagttccacacagatgcgtgagtttgccaagaatgaagattttaatagcttcagtacttttctacctggtaatgatgatgcactgaaaactaaactatttgaagatgtaataaaatacatgaggaaataactatgtcagtactgtttaaaactaacccagtactttgggatcagaatgaggattcgggtttccgttcaatccatgttgaattcaaaggtaatacagtggttgcaatcattgcaaacaaaactttaggaaactggactgcacaagttgttcctatgggatattcttatacatctgatgaagttgcgtttctggctgaattatatagtcaaacaccattcatcatcaatgttctagagcgtagtgataagttaacacatgacgaagtaattgacttcctggcgaacttacatgtctgatgattcgaatctaacaggttattttttgcaagaatcaatgatcaaattcagtgaacattttccagtactagatggtgtggagatgtggcatgtaaaaccactcttccacactttcagcaaagagcacaaaatgttattgactgaggcttgtaaatcgaataaaatatgccaaatcaagattggtgtaaatgtctacaaaggattagtcatcttttttgacaacaacagcaactacttttatattgttaaggagcattacgttgacaaatacaaatactaatacatactttcgttatcttcgcctagggctttccctacgcccaatccgtggtaagtgtgattcacttgctgatttggattatgcatatgcattacattgtgatggtgttcaatatgtattaggtgactatggtacattcgaagaatccaatgacagttcagaaattattgctggtgttgctaaccttaacaacattgccaatagttctcgtcatgaaatcgttcttgaaattcagaacttcattgagaaaaatactggcaagcgtacatggtcatatgtcggtactgatgcacaaatgtcaatcgcatttggtaacgaagatggttatgtagcacaacttattatggatttcgaatcagaagagaagttccaagaatacaaggaaaaaatcatccaatccttgttgcaaatgggtattcctgaagatcgtatgcctgaaattcaaagcattgatgagtttgttcttatcccatctgatgaaaaatatgatgcgatgtttacagcactgaacattcctggtgtagtggttgagtacttcgatgatggtgatgatggcatttacctagatctcgacgacgatgatgatgacgatgaataacacatatagcccgacataagttcgggctatttttgtaaggggaaatatgaattacaaacatatacaattcacttatatggaattatttaaattacaccataatcacagaagtactaacacaattaataaaaatgcgtttactcataaattatggtcaaattacctagaagaattacgtgagtattttgttgatactgaaattttcattaatgggaagaaacgaaagatacttagagtcgatagttttggtggtagattagtactttcatataaatttgataacgacttattctctgttgatttggtgaatatatgaattataaagatttccaattaacattcaagtgcattcgtgacctagcagataaaaataatagtatatttttagaagatacatgtattgaaatgattaacactgtgcgtgagaggattaaagaaaaattcagtactgtaattattaacaacgatcatgcagaattttcagatataatcattaagcttgatggtaaagtcgaggtacagttcttcactgattttggatttacgagtgttcctctggagatattcccttgaaattaaatttgaatgatgttcaattcacatataaaaatatatacggtttgtatgatatgtatctttttagtgggaagattggtgaacatgtcgaatcaaaagaatcaccatttattaataattactatgattacttagattctattgctgaatatataaaaaagaattacagtacttacactgatggcgatgatatattcgaatactcaggtgtaaaatcttatcaaggtattatccatgtagaatttcttgaaaaaactgatagggaatttatggagatcaaagttttgaagttaacggacctataagagttgacatatgaatattaatgatatacaattcacatacaaatttttgtatatccaatacgctacggttgatgctggagaatatctctacggtgaaatctatcgttcggtatggataaagtttttggatgaattacatgaatattaccatgatttgtgtatagttcgtgataataaaatatacaaattccgcgatattgttagtcatagcggtaagctacgattggaattaagtactgatagtgatgttgattggattggtgtaaatttactggagttggagaatgaaaaacaacttaaaggaaatacaagtattttataaattcttatacttgtcatatgtaaaagatgagtactatgaaagtgtgtattattttttatggcaacattaccgtactatagtaagagatttatatataggaaaatctatcatatccaatggtgaaaaatgtatatgtactgatgttgttagttttaatggttctttaacactgtgtttcagatgcgataataatagtgggtcattttcattaaacgtatatcagttagaaggaataaattttgaataaatgtccatattgcaacagtactcaattagctcgtttccgtttagattcagactgggcctctggtgctggggatttctttccaatcaatgatgatgcggaatacactgaagaacagcacaaagatttcgataaatcatggcgacctgacattgagtgcatttattgtctggcatgtgagcgtattcatgactaaagctgaactgatcgtgcaaacactgcgtttattgagggatttagatataccacgcatggatgtgaaacttgaagatatctacattgaatctcttagtgaagattacaccgataccgtaatgatgctgaatgacgtgctttatcgtatagatagcattagtcgttatggaagtactttaaaagttaatatggaacgagttgataaacttcacgtacatatatatagtcttcccatttcaatattaaactacagatgaatatcatattaatacaaaaaacatatgctctactgatgaaagaatatactaatacttatgatgaaaagtgtagtgcaaatcataatatgtataaattcattactcaagagtacagggattatatatatgctgcgttagttggtagatatttcagtactaaaaaacgcaaagaactaaaagtagtagatgttacttttttctacaacgggcatataacaattcatggtgtggaacataattcacaaatatatcgtaactactcatctaacgaggtaacatttttatgagagcattattttttatctggagtcttttctcactggcagtaataactgtaagtgggatttgtttcttatcgacaatgaatgtctggtacattaatttactattcccattcgtaggtgtaggtttaggatttactttacatagtgtttgtaaggattttaatggcaaataaatcgaatgaagtacttgttgctgaaacaatgaagatggtttataccataacaactagtaatgatatgtcttacccaattaagtccaagttgagagatataactcttcaggttatacagcagtactacaaatctaaacacaaaagtattattaatgtttatcgtgactatgaaaggattcgcattttgttctggaacaagaatcgagttcgttcggaatgtgatatagaaaactttaaatttgagaatctttattgttacaaagcgggacgatagctcaagtagtgatataataatggataaggaacaataactaacacaaggagtgtggaaagtgcttgaccgtatccgttttgccacagagatggcgaatgaattaaacatggcaaattttcaaatgttaacatcagtgatggctgaacatgcatgtgcttattctgtaagtggtgtgcagtgcggtcaggagaatatgttagcagatgtatatagcgaagttcaaagtaaacaatacagtgtaaagacgtacaaggataagttcgttagtctttatatgaatgaagacattgcagaagaccgcaaatatactgattttattattgaacgaagagtatcaggtgtatccaacccaaatgctgacagtactacagtatttgaagaagtacttcaagatatatatgaaaatgaattgaaaagtaagaatcattacaatgtacgtgaaactaacacagtgctcttgggatatgatgaagacgatcaatattattatttccgtatgactgaagttccttttgaatataaatcaccaagtactactgctgtaaaagaatttaccgagaaaagcaagaactacaagaaacatgaaggcaaccgttgtagtataaatggttataatgaagatggtgttcatatatatgaatgggttcatcctaattgccagacatatacccgttgcttgaagaaacgttataatttagaagacaatgaatccttctactttaaagttaagaaacaaggctatactcgccctgaagattcagaattgatgggtatggtatatttctaaggaactgttatggatttttacctacacacatggtcatacgaacaatacattacattatatcttgagattattaatactgatcccagatatggttgtgattttgctgatattataaaagagtatgcagatgagtttgagtttgtatatcttggctctgacctattcgtgaagagtgtaggtaaaaccggacgcatcactgagattgattatgatactgttagtgtgaatttctatgttgattttccttgtgatggcgttgatggtgtatattgtctgtatgaaataatttaaatgttaaggccagcgtttgctggtcttttttcgcaggtacaaagatgattagtatagatttaattaatagtactataaagttgttggctgatatagtaagagaatccaatggaactttatacccatcaatgtataaaatctttgaacgatacatcaaggattgtaacatatccttatatggactggcggttgatatagacgaccactatgaaattaatacttcatataaaactggaatgttaattggtattaatataaagatgggatattttccttattactgtataggattaccagatagtactatggtagattatccagccagtattattaaactaagaggataaaactaaaatgaatgtattagaattatgtactaagctgattactatgcgtaatgagtggtacgattggttttataatggtactgatatggatttttcaaaatatccatttatggaatcaggatgtgatgcaagataccgctggttgagcaaagattgttctggtttacatattctagttgacgatagtggtcagggaattataaaagatttacttcaagttcaacaactcgtccatgataatttgtgtgataacgatccataccttggaaatatgatttatgtaagtgaagatgattgcatattcgttatccagcgtcatggtaattctatgttttatatagcagacagcagtactccagaaggtgcagcagcagatggacttatgcctaagattgatatattggaatttggattacctgagcacttccagattggtactttatacgatattcccccacttgagttctttgaagaatttaaattgtactacaatgatcttcaaaaattgagtactgatcgtcgcattgaaataactgttaagtacatggacggaacgaaattaaccgatacgaggatagaattttgattaaagatttagatagaattttatatgtactgaggggtgtaattacattacaaccacaggttaatcgtatggagagagcctttgaattaaaatcaagagaaactccatattcacatatatcaaatgtagttggttcattcagtactgaagactcgccttacgatatttgtgtatgtgaagtacagccaagttcggatcttggatttgctatttttgataaaaatcaaaatctcattagtatgtttcagtgcaataatcctttttggaaaacatgcctgtatccagagtgggctatgcttgatccaacaaagagttccattaaagtatatgactctaaaaatgatgaagtagttattgatttggatgagtcaatgtcagaggaagaacactttcagctaatgatgatgcgtgctatgcctgagtacaatgcaatgattaacactgtgcaatacattaaggataccatgccatcattgcgtacacatgagttttgtcatcctgtattgtatgaacatttagatttagacttcagtactattaaatttaaagataatgttattaattacattcaagagaatgttaaatttgattttattagtacaatgacaaataatccaaatactaatttcaggcatcagtacaacgaatctttgtctggtggtcgagatacaacttggtggaaataatatgaatatccaagatagattgcaattgttgcacacacttgaagaagctgcttttgaacttgttaataaaattgcacaagaactcccaaaaggaaccaatgttcgtgttcgtgaaatggattatttaacgggagaaattgaagaaaaagtactaacagtgatcaaagtaacatactatgaatctgagttatcaattcaatgtaagtcggataatggttacgtttcctactatggcacagatgtagatatagaggtaataaaatgacccttttacaaatatatgaagatttaatgcacttatgtaatacccgtgaggctttcttttatgtggatcataaaagtcctgctggtggaacgtatcgtgtattcagttatcgtctagcatcatatactgatttcatgcaacccaatgcattagaaacccgtggttctatgtgggaaattgatgaagaaggtaatatgattcgttgtgctgctcgtactatgaaaaagttcttcaatgcttacgagaatcctgctacaatgttccctgctgataccacattcgatgacattgcagtagtgatgcctaagttggatggttcagtaatcagtacttaccgtgataatgacggtgtaattcgttgtaaatcacatactgcattgtattcagatcatgcgattaacagtactcgtcttctcaatgagaaccaaaatttgtatcaatacattgacgaagcagaccgtttgggctatactgttaatctggagtatacaagtccagagtaccgtattgtattaccatatcaggttgaacaattatttgtactaaacgttcgccatcgcaagagtggtgaactattatgtggttctgcgttacgtaacaagttcccatgccttgcacagtacagtactaatatgacaggtaaagatattcattacactttccctgttcgtactacattcaaagaaagtgttgaagaagttaagaaaatgcttgacattgaaggttttgtgtgcatcctaaataatggtacaatgtgcaaaatcaaaaccgactggtattgttctttgcatttaacgaaagacagtattataatcgattcccatttatatgaagctgtattaaatggttcgagtgatgatttaaaacagttgttcagtactgacgaatatgctacccaaaagatattaagaatggaacaactagtcttttcgtgctataatgctttacaagatgaagttgaaagcttcgtcaaggaacacaagcacttggagcgaaaggaattcgctaagaaggttcaggagtgtttaactaatgaactgaatcgtcagggcttggcctttgcaatgtacaacaataagaaagtcgattacaaagagactcttattaagtacatgaaaattgtactaaaggatttttagtactatctagcctagcacaaggagaagtgatggctaaacctaagtataaaaatgacggttccctttctccgacagaattcaggaaaatacaagaagaaatcgatgaattacagcacaaacgctctaagaaaggtgtgaagattagtaagaaacgaatcgagaatactttcgggtgtagtagtactgaatacaagaagaaaaggaaaccaaaaggtgttaagccgagaatacatgatgtaactcgctatacatcgaaacgtgaaaataaattcgacccactataaggagttcatatgaaagttgaagttcagcatagtattgttcaggatatgtcagtagttaaatttctttccttgaaagattatttcagatgtatcaagttcctagaagaatctcaattacagtggaccccattaaagtacagttcatccaatgatactgctagtattcgttgtgatgaatctgtacttgtgaaaatctccaagcgatttgggattgggaaatacaatgataaacaatgcacaaagtaatttactgtatataaagtcagtagaagctgaaattaaaaattcagtacaaacaatcgttgatgaaatgattgacaaatacaagaacaatcttattggaaagaaagtcagatgttgggattacacattcaaacactggtatgattctgagattgtgaaagttgatgtgaatactgatagtaatggtctaattaatggtattgcgtatattggtgttttaatacgcaagggaacgccacaggaatggctcacctatcataatatagagcatgttaaatttttagaggattaaagtatgccaactatcacactaacagttggattgcctgggtgtggtaaaactacatgggcagtgcaagagattaaaaaagccaaatccaagactatcaacatcaaccgtgatgatattcgtgaatctatggctggttcacatgatgcttacaaattcaatgatgctaatgagaagtacgtaactaatttacagttcagtgcagcaaattcagcagcagagaatggttggaacatcatcgtatccgatacgaaccttaaaccacatttccgtgatcaatggaaaatgtgggctaaagataatggttatgattacaaagaaaagaacttctatgatgattttgtacctaatgaagaccgtggtgcagatgttcatgaattctttaagattaaagagttcgtaaaactttgtaagaaatataatctccagcgtgagcgttcagtacaagatgatatcattgacacaatggcagatacgtactattatagtaaggcattacacattggttactatggtaattcacgcgaagctgctatcatcgttgatatcgatggaactcttgctcataaatggggccgtaacccgttcgatgaaagtactgtactccaggatacaccagacgaagaagttattttatctgttatcgctgaagcagtttttcataaacgcaaggtaattatcatgagtggtcgcactgaagggtgtcgtgctgataccgaacagtggcttaagaattggggtattccttacgatgcattgtttatgcgagacattgatgataaacgtcctgatgatgttgtcaaattcgacctgtacatgaaaaatgtggttgatcattacgatgttaaaaaggtttatgatgaccgcaatcaagttgtttttatgtggcgtaagctacttgggttgaaagttttccaagtggcagaaggaaatttctaatacaaaagggatcatatattggtccctttttcttttaaggtacattatagtgaatgtaacaacacagatgttattacgaaaagactacttagaaaatatagaacgatactatagattgtctttgtatgaaaataagcataaaaattatagttttgataaactactaaattctagtactgaagattatctattttcatcaatgttttatgtgagaggattattgtaatggataaatttcacacagatatatcacagataggtaatcttatcaatagtctaattactgatttagaagaaaagtacttaggacgaaatgtatacttagaaatgtatgaaacatatggtgttattgatatgatttattacagtgcattgaagtgtgaaatacgtttaactgtatgtttatatgaaaaaggtacatttaaaagaagtactgcaattcgccaagttggagttgatgacatagaattatacgaggaacactgatgtttgagcaggacttagagctattcaaaagttatgtcgagtacttagttacattagaaaaagagctaacgacaaagtacaaaggtattcgtgttatgtgctggtatgatgattcggattataaacgtgaactcaccattgaccgaatctatttcatcgacggtgtattgaatgtgcatggtgtaaatgattttggacattcatatacgtattcgaataatgctaaattcaagaggattgacaatgaatgagtactatcaaaatttattcaattatataaaactaatagatgatcttgcttttgattttcttagtactgataaagttggtgagcctttatattatgattgtattggaacactttgtttagatgaaaaagagatattagcaaacaacttaccatccacggtctgtacaatcaatggttccaaggcattagtgtgcgaggttaattttcataaatcacttaatacaattgtttacaagttcgataacacttgggtaaatcatgtaaccagtaatattaaatctgtgagatttttatgaatataaaaaaattatttgaacaagtaaatttattgtactggtgttcagacgggtcagataaagaaaatagtgaagcttttttagaattattcagaaatgaaatacacataattagaagatacttaattgataataaaactgaagtaaaagttagataccataatggtactttaaagaatggtataattattggattgatagttacacgaatgtctagtaatattaaagttgcagtaagattaatgactgatgatggtgtctacacaatagaagctagtgagattatatattaaatggatatacaaacattcaataaacttaagtactatgatgatggttttgcattaataattaacgaacttgatggaataccttacgaatatcataatcaattaatgaagataataaaatgtatatgtgaagaattaaaaagtatatttaaaaatgaatatgtttatgatttaggtaatagtagcaaaaaactatacataaagaaattctgtggaacgcattgtggtctgatggttgatttaggtttaagtgctgacaacaatttcgaagcatgtagtttatatctggatgaaatgcgaatctcatgagacatatcttgattcggtgatataatttcattacaacactgacatggagtagttgttgtgaataacgatttttttaaaatgtgggaaaaaacaatagtaattctatctagttcattaatgcacattttcagtactgataattcttatagttcacatacatttgatttaatatgtaataactatgtaaatgggatatcagatgatttatgtccattcattgcgtattcacctgatggcattgaagaatttaatatacaaaacattcgttgcggttttggtgattggcttgtgttaaatgatcgaggtggaatctgtttatacatcgaagatattggtaaatttatatacaaaggagtagaatatgttaacaatcgcagcagttattagtgtactaggtgtagtcattgcaggtatgcttgcctacaattacaaccgtagtgttatcggctatgtactacttagtctagtactaaccccagtactcaccatcgttactttattagttctaggtgaacgtaatatcaacttcatgattaatgataaacgtgatcaggttacaccagaacctgaaaaagttattcctgaagaacaagaagaacttaaagttgaagttcaaatgcaagtgaatgttcacaatgcacttgatgaaactgatccaaaagttaatgttactgttgttcctgtcgtcaatgaagtaaagcctaaagcagcaccgaaaagtactaaagcaccaaagaacaacaaaactacaaagaaagctcgctacacaaaagggaagaataaaaacaaagtccaagatgaaccacaacaaggtacacacgaccatacttcccatattattaccgcagccacagcagcagcagtcgtaacaccatatatctcttctgctgatactggctcatatgatagctctagttgtgattcaagctcaagttctagttccggtagctgtgattaacaatgaaacatctcgcacaatataatcagtacttgattgcgttgcatcaaatgaaagatgatttctataaaagtgcagaaacagaactcgtcggtaagatagtaaaatttactgacgagtacatcaaccgatatgcggaaatagacgatgatccagagtatgaatcatactaccagtacataaattccaatacaagaatgagaattattgaaattatgaaatacggtatacgtttaattgcacaagtagaatacatcaatcacgatgcaattgatgccgctgcctttggtgatgaaataagtttagaatatcttattcaaattgatgaggaataataatgactacattttttgcaatatatggatttgttgcgttttgctcatttatatgtaactttctagtactgaattggaaatgtttcaaagatgaaatcataactgcaatgagtctacaatcagcagcactaatggctataatttggcctgtaactatggtgtatctttttatctcaataacaaaagatatcatatcccacttcaagagaaagaaataatgttcaacaccgactattcacatttgcgatatcttatgtcattggctgatgattttattaatgatttgaagccgaagtatattggacaagaagtacgtttgataaactcaaggggttatgggaagtacattatcgctgatatgtatattagcggtggtgaatggcgtttcaaagttaatacgtatcttaaagatggttcttttgcaggtacacaagttacaaaacacactaacattatatggttggaacaataatgaaacattttttggaagttacagtaccggatgataaagatttatatatcgttggtgatttacacggcaatggaaaactgtgggatgctaccaagaaagaatttggtatcaccaataatgactatgttttttgtgtaggtgatgttattgaccgtggtgaccagaattccaaactactatttgaattccttttcggtgaaaaccgttttatgattgctgggaaccacgagatcatgtgtgttgattctgaaactcaccgtgactggcatcactgttgggtacaaaatggtggagataagttcattgatgaagttggtgagacaggtatacagttctttcgtcagtacttaaaggatctccctatgattatccaaatcaatcaccgaggattgaagattggactggttcatgctggtgttcctttggaatataccacatgggaacgtttcgttagtgggacaaaatcacttagtgctgatataattgagaagtgcttgtgggaccgtgatacattcgactactgcaagaaaaataacacatattacgtccctagacttgatggcatccattgcgtctttagtggtcataccgcagtattcgacccactcatctacggtaatcgtatctggattgatagtcagttcttaactggtgatttgactcttgcaactccccaaagtggcgggatgagatacttacgtaaagaaaaagatgagttttcatttaaccgcttcaaaaggtaataatatgcatgatgatattaaaaaatcattgtatgatttatatattatgaaaaaaaccatcaattctatacttgccgaccagatcaaacaggtacgtaatttcctatcaaaaaaacttattggtgcagaggttaaattccattacaaaaaaaatgtcgtggttgatggtgttattagaagagtagttacaatttcagaccaaacaatatatgttgaagttgaatatgatggtaaattatcacaattaagtactgaagatttaacatttttataaggaaatagaaatgaaagtaattcaagttatggtagaaaaataccaaactgaagatggtcgtatttttgattcagcgaaacaagctgaacatcatgagcgtattatttctggtgcacgtaaagtgtgccctacatgtaatggaacacaacaagtaccatctgaagactatcgcagttattatgcatgtccacgttgtgatggtcgtgggttcgtggaaaaacaagaggtatggaaatgaaattatattgcttaacaaacatgtactgccaaggtgtacaagctggaattcaagcatttcatgctggcgtaaaactaattaaagaatatgaaggtactgctttcagtactattattgatgaatggtattatgaccacgaaactattgtagtactaaatgctggtggtcatgataagttaaattcttattatgatgacctttgtaagcagggaaaagtgccattcgctaaattcaatgaagccggattaaatgatgcaactacatgtgtagcagtactgtgtacatctgaaatggttgaagacatgtcggttatgcgtatgaatcttcctgctggggatcaactaatgcaagtaaaatatggttcattgtttaacacattaaaagcaattagtacaatgaggactgtttgatggattttccagagaagttatttgtggctcgttcatatgtaaatcataaccaagttactggttacattatagatgctacaaaatcacacacaaaagcgtttgagactaaaaaagaaaaggccgagtactgggctaagaaaaacaatctaccttcactatggattgataatgtgcctacaattgggttttctgtggtacataagctcactgttcatgctcgtgaaacatacttcaccatacgtcaccctgaaggttttgagttcttagtgagtgctaaaaacatgaacgaccttatcatcaacaatgatattgttaagggtgtatttgttgaacctatgttcttcaataatagtttagaactaattaacggtaaaactaaaacctttgctaaattggttgagaaggaaaataagaaagaacatcaaaaagaagttgtttctaaattgaaagtgggtgatggttttagacacaataaagaagattactattattgtggtaaagtaaatgctatttgtatcaagaaaactaaagagttttcattttctgataagagttccaagtatcacttagtatataatactactcgtgggacatatgctcttaatgctcgtcttgaaacttatgcattagaaccaagtgctgcactgaatgtgaaaactacagttcaagatgaaattgttaaagctaatgcattttggcaaaatatccaacgaaatcgccataacccattatgtgaaagcaatgtaccagtactgataagtgataagtcgtttaaagcacaagatttgaaagtaaagtacgaagaaatcaatcctgatgatataatgagtaatggacgattcaacgagaacgtaccgttcatgtgtaaagttgatgaacaggcatatcgtgttttctttggtgtaaagaacaatacaaccagaagttattatggtcgtaatggtgattatattcttcaatacactgatgtatttgaacgatacagtgcatatccagttgaaattgatgctaatggaattatgacaatggatgtggatttaaacgaacatgtatcatttggtacatggaatggataccgttctcctttctttccaccgactgaaaataaaacagcatcaactcgttactaccaagaaaaaccttgtcacgtccagctatcactaagtaataaactttacattggaaagtattatctataagggaatatacaatgagcattttagcaattcttgaaagcattaaaaatactagcagtactctgggtaaaaaagctatccttgaacaaaacaaagataatcaaacattacaaaaagtactgaaatatacactagacccttcaattgtaagtggatataaaaagctaccacaagctgatgatgtataccaacatatgacattagacgaagcaattgataagctagaatgcatttacaaacgtggtgtgaccggaaatgctggacgtgacttcattgcttcagtactgggttctgtatcagaagatgaccaagaagttcttcgtaaaatgctcacgaagaaccttgattgtggtatccaagaaaagaactgtaatgatgtgttcgggaaaggtttcatcaaagacgaaccatacatgcgttgttctttgattgacaaaaagactgcaaagaacattaacttcaaagattatggttatgctatatcagaagttaaaatggatggtcagtacttgaaccacgttgtcattaatggttcattaacttctacatcccgtaatggtaaactatacgacttcctgggttgtcgtgatggtgaaatggcaggtcttgctcacatcatccaaagtaaagatgaacgttttagtagtggtgtagtctttatgggtgaaggtgtagtactggacaatgatggagaaaccattctcccacgcactactggtaacggtatcattcagaaagctggtaaagatagcatcagtcagaatgaagcaatgcgtactgtattcgttctctgggatgttgttccatatgatgcattttgtgaaggtgtatggaatgtaaaacgcaaagaacgccgcgagatcttagtagatgcaattaacgaactcagtagtgattttgttcgtatggttggattccgtaaagttctaaacatcaaagaagcatttgagtacaatagtgaactaatgaacgaaggtgaagagggttcagtactgaaatgtgaagatggtatctggaaatctcacacttctcctaagcaattgaaaatgaaacttaagatgcaattggacttgcgtattgttggtttcaatgaaggtgaaggtaagcgtaaaggtagccttggttctttacaactggaaagtgcttgtggtacattaaaagttaatgtaggtactggaattaaagagaaagacgcagaatggacgtttaaaaccatttgggaaagaatgcaagaactcatcggtcaagtagtaacagtagagtgcaatgatattgtattcgataagcgtactggcgagccatcactatttttaccagtgtttattgaatttagatttgacaaaaacacttgtgacgactatactcgtatcttagaaattcgtgatagtgcggttgaggtgttctctaatagtattcttgaatcactcggttaatcatttataggaggtaattatgaaatttgttgtaacgtcagacgtacacggtggcactgattacctccatagtggtgattacagtgatacagtgctgattattgcaggggactttgatgaagctaaacgcagtcgttatcgtactggtatcgaatccctgtgcaagcagttcaagaatgtagtactggttcctggtaatcatgagtactacggttcaaacattcacaagactaataaagtactatccgatatgcaagatgagattccaaatttcatctttttgcaaaacaaatttgtatggctggatggtgtactgctggttggcagtacactgtggactgactttgataaaggcaatgcactggttaagtttgatgctcaacaaaagatgaatgattataaacacattcgtcatggaacaacatcagaaccgtggaaacgtaagctcaaacctgatgatgttgagttcatgcattatcaggataaacaatttatcaaaaattcagttgacacagttcgtctaatgaatgataatgatatcaaggttgtggtggtaacacatcatgcaccaagttatcagagtgtatctccgagatacaagaatgactcactgaatggatgttattgttctgatatggaccagtacatcgaagatttgggtgctgatgtttggattcatggtcatgttcatagtagttttgactacaacattggaaaaactcgtatcatttgtaacccaagaggttatgaatcttacagtggtgcatgtgagaacttcgattacgatcctaaatttgtatttgaaatctaaggtgaggttatgatacatacatttcacattgatgacaaaatgcttgttatattgggtagctgtcatatgtatcaacgattgggtatgcgtatgctatcctcttgtgacaaaacccaatactacaatccagatggtactggtactgtgatgaaagatagatatcacttcacccgtgatgtaaaacaagcagacgatttagattcatttgtgggaaaggtgtatgttcttgttcatgatgatagtcgtggtgatgtgttgccattcagtactttatcaattaatatgttctttagatacgaacaattttcaaattcactaagaatgattgagattgattttgatgacattccagttggtacacgctatgaatttctatacgctcttacatcaataggggtgtactgatggaaaatatcgttgtgtatgtaattgagtacaatgatgaaataaagtacgtaattaatgcgtatacacattactccagtgcagccagaaagctggaaatatattcaaaagaagcaagaaactactgcttagatgatgattcagttgaggtttggattgatggatttgcagagtactttgatgctgacttctatgaagatcttgacaaatcaaatgacttatacatttatgtagaaaatgaacgttattacacaaattctttgtttgacattaccgactctacggtgtatgataatgctatggttaagttgttaaagattgaccacgatatgtttaataaacatacaatttgcggtttactagattttttaagaaacttgtagacaaatacgaacactgtgatataatactcacatcaatgaaacaatagaggaaaataacaatggttgaacaattcaattttggtggttatgctggtggtgaagttcgcaacatttctattccttatgtagttgaaaaagttaatggtgcagaacgtacttatgacctagcatctcgtatgatgcaagaccgtatcattttccttgatactgacttcaatgaccaaatggcacatatcatcaagcaacaattggtgtggttggattctcagggttcggaaccaattaccttctacattagttctcctggtggttcagtacacgcaggtttgggtatcgctgacattgctaagtcttgtgtatctcctatccgtacagtagtaatgggttatgcagcatcaatgggttgttatactcaatcagtagttggtactaaaggtttccgtctaggcgggaagcgttcttacttcatgtgtcaccaagtaagttctggtactcagggtttgattactgaccagaagatttctttgaaacactctgacgcattgaacacactattgacgaaagaaattgctgaagcagttggtgtatcacacgaacaactactgaaagatgcagaccgtgacctgtggttgaacgctgaagaagcactcgaatacggtgaacatggtttcattgatggtatcatccttggtccacgcaacgaagaaggtaagtatctcgtcaaacgtcgcggcggcgtggaagagtgggtctaatttgaatttcatttgatgcctcatttggggcatcttatttctggagattatatgaaagttcttgtacgtaataatactgaagtcaatgatgtgttagatgattcagagtttattaataccgcattagatcagattagtgcagtggctattgaattgaaaggtgttgacgaggcagaacgagtactcaatggtttttctattgttctcgaactaatgcaagaagttcttattaaaaagaacattaatccaattaacgcagttcaacacgcagaagctatgcgtcaagaacatggcacattctcagataaaaaattcatcagtactgacgaggggaaagaataatatgtctaatgcacaatacaaagaaggttctgccgcgtttaaaaacaaagtagtttttaacaatgaacagctaaaatcacagcacccactattccgtcaaggttatcgtgctgcacaagctgaagctatgaagaaaaacaacgtaacattcccaacaactctgtatgatattcctaaacgtccatcagtgtttaaagcagaatggactgacattatggcagcaactaaacgtcctcgttttgctaaacttcacactgatgaaggtcgctggatgttgatgggtattatgaaagcagttgagaaacaggcacataccatcgttcgttacaaagacgttgtagctatggttgataaagcatttgatcttattctccagtacggttatgatgaaggtgtactaactgtttccgattgtgagcagtaccagtacactccattccagaaataattacttagggaatctttcatgattcccattttatttgctgcatatcaaaaaatattgatcaaaaattgatccatacaaggtaaatacccaaggtgtaattgttaatagggtaggtggatatgcagcaatataaattatctgaagatcaaagtgatgtatttttcaatcacatgtttttaattgatgaatttgccgaaagtttaaattcagaggcaatagctatagttaaaaagtggtattcttgctataacaagaacaaaaaatggtattggttgaatagaaatttaaaatcatttctaggaacaataaccagtactgatagtattgaactaatacatagttccattggctacagttacttaaccaagcataataatacgtcaatagagtctggctttaaaatcaagcgtctaatgaaattgacgggattgagtgcagaaactatacaaaacgatacagaaaagttatggaagattatagaattcatgaataaaaatatgtcatttatatatagaaattatgatatattcactgatgtaagacaattttatacgagtccatattcacttaatgagaaatatttccgtcacatggaattatgctcaactgtggttgatgaatggaatttagaggattaacatgaaatacactgctcttagcccaactgatactaaagtatggttgagtaatttgaacaaaactattattttaaccaaaaaagtgatatcaacagctaattcattagatgtaaatatcaagaagaatgttcttaaatatcatcaccgaagtaaacttagtacttggtactccaatattttttacggcttatatgggatagatgatattttaattggtacatcatctgggtcatgtttcagtgctggcggtatgtgctttatggatttgggtttttcattatccgatgaagaaatcgagtttaaacaattccgtgacaagttactgggttcgggtgatatcaagttctgtacagaattaatgggagcatgggacgtttatgcagcgaaaccatttgacattgaagaatcagatgtgctaaactaccttcgtattcttaaaatacattcgaactgtaaagccaaattacaatccctaggagtatatgatgaaacacttgacgtggttgaagatagccgaagtcgtggctgaagagagtaaatgcatttcacagaaagttggttgtgttattgttaaaaataaccgagtattgagtactggttataatggtactccatctaagcaaccgaactgctgtgacgctaatgagcacttagttaatggtggacgtttccaagactgggttagcgatgacgcaaagcatgaacaccatgaatggagtaatatccatgaaatccatgctgaaatgaatgcattgttatacagttcacctaccgaacgtcagggagcaacactttacacaacactacaaccatgctatacttgttctaagttgattgcaggaagtggtattgcacgcgtgatttatcacaaaagttatcctcgcactccaccagaagctattaaagtactggaagatgctgggattattgtaaattgcatttatgataaggggttgtgactttgactttcttgattttaggtattccatttgcagttgtgattcttgtacttttagtgatgattgtattaaatgataatactactccacctgtgatgcgtaatcatgaagtacgattttcagcacaaaacaacaagtactacatagtaaattgtttaacttgtaaagagtataaagtaactggtaaatttggttttaccatttattataaagaccgtgttgaagctgacatgatttgtcagaaacttaatacggtagaataaaaaaaggagccataaggctcctttttcttttgttagtacacgataatttgaatttcaggaaaactcttagaaccaacaacgagttcagtactaccacgttatttgttgacaaaagcatagacattatacattcgtgtgatataatcattcaaaagaaggtacaaaggcggggcgattctgcgagggaatgtgtgaagtgatttaaaaaaacaatttgacttaagttaaatcttcctataatattatttatgtaatcaacaatcaactaagagggttaaccagtggtacgattatataaagaaatcatccaatctattattattattttcttaattaactttcctgcaagtgcaggtgttgaaagaaaaagtatcattagatatgatgaatctaaacagacagttcagttcatttcaactttaactgaaaatactgtaaaccgtttgatggtttttagagaaacacacccatttgacactatcatcattacgtcaccaggtggtgattttgatgcgggagtggcactaggaaattttgtcaatgataacaatttaacaattattgttgaaagatattgtaattcttcttgcactatcgcattctttagtgctaatatagaaaacagatacatgatgaaggactcaattctaggtctacataatgtgtcaatcgaaagtaaagcacgaaatagtgatgacacatacataacagttcgccaattgactatttttgctgaacagctatcaactaaggttggtgttctatttgcgttatatgcagcgaatggtattcctccagaattgttagtggaggttagtaaggttcgtggtaatgaagttgtgagacttacaccagagcagttgctcgaattaggtagtatcattcattagtattagatacaaaataataatattataataagaggatgataaagtggtacatcctttgttataagttcacatacactaggagtgtataaactatgacaaatttacaaaacttaacatctcttgttttttatgcaacaactattgtatattgcattacattagttttaacatgtttcatctataaagactacaaacgtggttttatggattccagtacacacaaatttgtatccaagttcgaagcaggaatttactatgttctatcaatttcttatggagcatgtttacttacactagggttgctgatatactggttgtatacggcactttttgcacaaggagttatttcatgacttgtattatcgctcacacaaatggcacatcttccttcatcgctggtgataaattaggaagcaatggtttcactaaagcagttcaaactgagcctaaagtgtttgagaaagagttcattaaactcaatgaggatggtcttactcgcactaaagaagtaatggcgttagggtatactacatcgttccgcatgggtcagttgttgaattacaacctaactctaccagaacaagttgcaggggaaaccttttcacagtatctagtactgaaagttattcctatcattcgtcaaatgtttaaagatgaatggggtgctcgtgatgcatcacaagatgttggtggtggtcagttcattattcttcataatcatacgatttatgaagttcaagaagacttttcagtactgcaacctaaaacacaaattactgctgtcggaagtgggacttatcatgcaattgcatccatgtcagcgtatattgaagttcaagaagaaaccaatgttcagttacatgaacgtgttgagtctattttcaaaattgtcagtgataatgtaacaagtgttagtccagagtttgatattttgaaatactgagaataataattataaagagagagtatatctgatggcatacatagtttacgagtggattttttgtttcatagttgtgtttatttgtgtggtgttatacaatcacactaaatgtttataccgagaattcaggaatggtaataaacatggacacaataagtggatgtatgtctatcatattgctatcattgtatttttagtattaaacttgatactttttatataaggagtaaatgtgatatcagataaatttatacaaaatgctgggaacaaaagattacttataatttcaggggcaggtctttcagttgagagcgggatggaaccattccgctttgatgatgggttgtgggacaatttcaaaattaatgatgtttgtaacattgcacgacttagttctaagtatcatgtagttcattcattttataatacattgcgtgtaaaattaggtgaatgtcatcctaatgaaatgcattactttattaaatcattagaagatttgtatggtgattgttttttacacatgacttctaatatggatgatctatatactagaattggtggaaccgaactcaaactacacggcaatttatgtgaagtaattgagaacttttctattaatactgatgattacaatgtcattaattgtggttatgaaccatatatccctaaagctgatgtttttgcaaaaccaaatgtagtgatgattggtgagtatcatcgctacgttgatggggtacgtctccccatttatgaagaacgaaatgaagtgttgaaaagtctcacagaaaatgatacagttgtagttattggaagtagtgatacagtactggtatggtccagactggctggtgcacttccatgctatagtgtaaatgttaacatccgaaaaaatgataatgattttctttttaatgagaaggtcatcaaacctgcgacgaaagcaattccacaggttgaaactataattaaggaacgaatgcgatgagtaaagcggaagtaccactggggcaaatggggaaacgtgcaaattttgtattctgtttcttttatgcaaaagaatgtaccccatacgctggttatgaactaaatgatatcccagtggttaacttagtactcctacaagtgcgttgggatggattgttgggtgcatgtggtggaacagttgaaagtactgataagtcattagaagatgcgttacagcgtgaagttcaagaagaaatgaactatatcattgacaaaagtcgcctgtctccattaaaatcacttgaattgtttccagagggacactcacatagctatagttatgaaatgacttatgctgaacttaaaaaacttcgtgataattatgcatatggcaaacatgctagtgcagaggtggctggtgtaaatttatgtcacatctcacgttattctaagggacaaaatcgagaagcaggatataataatcttatgacacagaacttcatcggaactgcgaaacaagaattggagtatcttgtacaaaaagaaaacttactaatcaactatctataggagtttaaaatgtcgtactcaatgttcttggatgatattcgtgattatcaaaaatattatcctgaccaagagatggtattgtgtcgtgactacgaaagtgcatgtgaatacgtaatcaaaaatggaattccagcatttgtctcatttgaccatgacttgggcgacttgagtacagatgagaaaacgggatacacttttgccaaatttctaattgattatatgtttgagcataatattaaagaaccatttaaatactatgtacatagtagtaatccagtagggaaagttaatattgaaacttacttaactaatggatttaatgcactatgatttcaacacatatcaagagtcttatttgtacaacgctattaggtataggtgttctgtggttcagttcatatcatgagaacactaaacgttataatattcattacaatacagcgactgtaacaggattaggtcaatgtaatgaaaataaatgctcatttacttataaaaccagtactggtgaagttcgtaatgggttatcaagagatccagtatccattggtcaactagtttaccaggaatgctgggaggaaaaggctcgtggttcaagatgttatgttgaatacgaaccgagcatgtaatattccgagtcactaaccattagtcgagtacaaggatgtactcataactcaaggatgttttatgaaaaaatatacaattgacacaaacgtactactatctgatccaaatgctaccattgcttttgatggagcagctatcattctaccgttcacagtacttgaagaattggattcaatcaaaagtcgtaatgtggatgtttcccgtgatgctcgtgttgcaatccgtaacattgaagcaatcctttctgatgcatcacatgaagaaattagtagtactggtgttaatattgctgatgttcatactaatatgagtcctgaaagtaaattgtttgttattacaagcgaagaagctgaagcactaattcgtactgctggtaacgaagagaaagttcaaactcttctaaaaagcacagtaccagatgataaaatcattttagtagcattagcaactgattcagtactggttacccgtgatatcaatatgcgtatcaaggctctaagctacggggtggaagttcaagattatcgtcatgatatcgtgattggtgatagtgatttgattcacattggtcaacatcaccttgacctacatttctgggatgtgtatagtaatctgactgatgtatctattcagtctgaacaagttggtcgtcgtttgtaccactacattccaaaaagcttgattgaacatatcatgccacaaaatatttgcatcggtgattacctatatgataatgctgatgttctatttgtgtacgaaggccaatctgcaattgaagaagatgatggtactttaacaccagaagatattcttgtattccaagatattggacaatctgttgctctacgtgctaaagtgtgggatattaaggctaagaatattcaacaagcactagcaatcaacagtatcctagatcctgatgttcatctaacagtactgttaggttcagcaggtactggtaaaacactaatcaccattgcaactgcactagagttagttctagagaagaaaaaatacgaccgtatcatcttctccaaaacacaagattcccaattcgaagacattggtttcttaccaggatctgaagcagagaaagtgattcctttctgtggtgcagcaatcgatgcgttggaattcctacacaaagatgatgctaacccacaaggcagtatcgaagaaatcatgaaacgcaatgttatccagttcaaagcactaaacttcgttcgtggtcgttctttcacaaatactatcctagtagttgatgaattccagaacatcacacctgctcaggcaaaaacaatcttgactcgtgcaggaatgaactgtaaagtggttattatgggtaacttgagtcagattgactctaagttcattagtccagtaaacagcggtctaacttatgttaccgagaagttcaagaactgggacggttgtcgtgtaatcgaactagaaggtgttgttcgttcaccactggcagaatttgctgaagaaaatatgtaataatgtgtgggacattcgtcccatacatgatataataatgttattaacaacaaaggagaaatactcatggcaaagcaacctaagaaacaagaaccagtagctaaagttaagaaagttaaagttattcaatctaaagaacaacgtactttcgaactacgtaaagcagaaaccctaacaggtcttcaagctctacgtaaacaaggtgttctaactcgtgctcaataccgtgagctagtagcacaaaaaggttattgattcatttgaagcaataaactggagttcatgataaatactttcataagaataataatactttttattaatttaaaaagaactccatgtgttatttcagtttttcatccctgtcttttggcagggattttttctttctagatattgacaaaaggattaaactatgagaacatgtattaaaggacgaatgacattccattaggttagtttaacttaaaggagaggatatatgttttttgaccaaacatttacgttgtaccatgattcaggtaaagttgagattattgataatctgttagagtacattgctgaacatgacggtatagaccgtttccacagtaagatgaaatttgatttagctgaattcaacaaaaagaatcgtgaaacattttggaagaaccgtttctattacgaaatgtatccagaaaagttcgtaggttattatctttgtactgaaaaaggattacttgtatctcctgatttacttatgggtgaatacatgatactctataatgagtactgggagcataaacgaaatgctcgtgacactgaatggcgacataagcgttcgtatatgtacaaacataaccactcccgatacaaacgtcctaagacccaacaagagcgtcgtatggcttgtgcagtactgaaggatgagggggaacctgatatacgtggaagacgtaagatgcgttcactaccatcgtattgggatgatatcagaacaagacacagtactggctggaaatacagtactaaacgtaaacatcaatacaaagggagctaatgctccctatttttataggtgaactttatgaacaaaattgaagttgctgtcgtgattggttatattgaaattgaacagtgtggcattgatacctttattgacactcttaataagtaccgttcagagtacaagggatacattagtctttcaccagacggtggttacggtggtttcgatggatacaatgtaatttggaccagagaagaaactgacgaagaataccatacacgaattgaagctgaatctaaaagatgtgaagaaattgaacgtcaagaaatgaaacacttgatgaacaagaaatcattaagtaccgaagagaaatctaaactgctaaaatacatcaaggattacatgtaatgaaaaatgtatcacaagaaaagattctgtaccttgcaaagtacaatggtggatttaatattaccagttgtgaatatcatggtaacatggctaaaatgattgacgagctactagaaggtaaaatgctccgttgggagacaaatgacctttggtacgaatatgcgggtcaacaatgggaaagtgactacgataatgcaattcatacgtatacaattactaaaagtggtgaagtacgtttggctatcatgcgttgtgcttacacttacaaaaatttcaaagatgaagaaaagcatattcgccgaaatgaagagttagtacacctaatgggtgaagctggcattacaatgcatgacttgttcaatgaaccaagatggactgggaatctgaccaaagcagaatacaaagcattgcgatacattcaagtaccagaaatcaacaaaccaaaagaatgtattgatgatggagaactaagcctcaaaaatgtatttgaaagcaccagtactgaaagtattgctgatctttcagttcagatggctatcaaagctatggaactattcaaaacacaatatgatggtgttaattcagatgaagtagagcgtgagttcattacgcgagtacaaattgcattacataaatcaaaaaagtaggttcatatgaaaattttacttgtactaatcgccgttcttatggtattatcttgttcagttagtaatggttcatacatttacgtatcagtatttgaagaagcaccaacgaactgtgtattaactcacactggtattgtgttagttaatggtaaaccatcaatcgagtacttatgtataggtgattaaattatgaaatttatttctattgcaattgtttcagcactcatgatgttagtaacaggatgtgcacctaaagttcaggaggctgatgcagagttcattcgccagaatttgactaaacttaactacgatggcacattgtatgcttgccatgagatgcgtcatgggcaagatcttaatctcatgtgcaggaagattgtgaatcgcaaacgtcttaatactgttccgaaggatgcacaatgaaagaagtaattggttacaaatgtaaaaattgtggcaaagataagggtaagcattcagtacaagggatggcttgtccaaatccaggacgtggtaatttcagagggttcagtactgaaaagtcttacgaaccggatcataccaaacctgtaatgggttataaattatgagtgattatgtggcatttcttcatcgctttggtgaagctcaagaaaaacacattatccgtatgccagcttatggtgaagaagactggtacaaaagtactatcagtgtaggtgcatttcgtgaccgtgaagctgaattctttctgggtaagcaacatgaacgagaggtactttgctcactttggcgtttagatgaatgggatagtgataacacacgaacgtctgaaacgatgctgacagttgttggtattgcgaactatcagcacccatatgatctattacctacatttgaacatgcttctttgtttgacttttacaaagcagtagggtatgattataaaaagaaacgttacatttaatatcagtactgccacagtgggcagtactttttaattggagattactatgactacatcagaaaagtactggtggattttgggccatcctaaattcatcaacagagatatggttcccccaaggattgatatcgaaccacatgatgtgtgtccaatcacaaaccgcattgaatcatttaaagctctgaatacaaagacacaattttgggtagaattcatctcacctatgtacgttgagcaagatgatgaatgggtacaagcacatgattatgagttagattgcggtggtgatacttatgatgaggcaattgatgaactatacaaaaatgtgctaaacacttatggtgattacacccaacaagaagcagacgatacgtttaataagatccatgcagtcatttctacatcatcaatttacaatacagcaaaaacagtttgggaagaacgtcacgggtggagttcatctgtaattgatgcagaagccaaagaaacaattctcgaagacataaaaaatataaaaagtacaatagaagccttgcgtgaatttataaagtcttgtacaatagaacaacagaaagaggcaaagatgcatttggagagtgaagaatgtaaactttgggttctagagaaatcatttgaaaagggtatagacttagacttatgaatcgtaaacttgagaaactaattgaagaattacgacggatgccacccatcgagcaagtggggagctacaaacgttatcgtgtgattgctcgtgcactagataagaaaggtcgtgtattggcaacacgtactaattcttacacacatactcacccagtacagaaaggttttgcaatccgtgctgggcgtccacaaggtgaatttcttcatgctgaaatctcatgtttgctggcttctcgtgctgaagttcatactttgttgattgcacgggtaagtaaagatggtattccagtccctgccaagccttgtgagatttgtacgttggcaattctggaatatggggtcaaagaaattattcatacatgaagaaaatcgaacgctaccaaaaccatacagttgtgactgaagatgatatattttattattatattttcagacccacacactgtttacaaataacgacatatgagaatggtaaattcaaagatgtcaacttccatataacagatttagcaaaatattccagtactgaacacttttccaatttagtatttgtgtactgtataccaaatcataacatgtaaggagtcaacaatggctaaaactatttctttaaaaaatgaaaatgtaggacaacgcaaagatgggttctttggattctcatggacaacattgttctttggtccgttccctgcattgtttcgtggtgactttattacgttcatcggtgcatttgtaatttacttcatcctcaacgcagtgtctttttggattgtgggtacaattgcaatggtcgtgtgggcatttctttataataagtactacactgtgaatctcatcaagaatgggtataaattcaatggtacacatgaagaaaatgctgaagctgcaatggcgttacaaattgatctaaacaaaaacaatacagtagataaaaacaaagaaccagaataaatggatcagtatgagataacttacgattattatggtaaggcttatatgaagtgtggtcgttttgttgaactatcaaatagagaagcaatcgacccacaaaccattatatccatccataactcgtactataaaaaaattaccatagctaattttgcaacatacgtagataatcctatatttccgtatattattcatttctattgtagagctataaaataaggtaaaaaaaatgttagccgatgattttatgtctctaagtatcaagatatttgatatattaggtgatgaaatagatttccatctaaatgataaaactataccacacgaagatggtgggtattttttcgcatttggtaataagttcaatgttgatttttcaattccggttcctgatggaagtgattatgcagcatcaacatattttgaatttcagttcagtggtcataccgagcgtttactaacatatagacgtaaaggaaatttcagtagaccagagattatattaatggattttgaaaaacgcatagaacttgcaaagaataatccattcatcagtacttatgcgttaaaccaattcattgatctatttgatggatatccagacagaatacgagggtcgttacgtataaatgcagaatgaaatatttaaaaaagaatacgatggtgaaagtctctatgatattcagcgagacgtacatgaagcattcgattcaagatttaacccattagctggacaaatcccacaagatgagtttggtttccaagaaggtacatttactgtgactattacatggagtccagatgagactagctaaacttgtaatcggatgcagtgcacttgctgcatatatgattttctctgctccaaccaatgtagtactgctaatttgggcagttgttatattagcagtactttaaagcaccctagaggtgctttttctatttgtgcaaataaaaagcaatgtgacctttccttgatatagatcaatagaaataccctgttctgacgctataatggtgtctggtgatgttaaataacttcacccccagatgatttcaaaatacaaggaaagtaaaatgcaattagataaattatatactgacgtaacaaatttcctaaatcagagcaatactgatcttacaaatgaaaatgcaaacaaagatgcgaaatgcgtcaatacacacagggatttacttgctggtatcctatctaagcattattcacaagatgttattccaaaggagctaatgcagtggcataatgatggttatggtcacattcatgatttagactactatatcagcccattaactaactgttgcttggttaactacccagatatgctaaaaaatggatttaccattggttgtgccaaaattgaagaaccaaagagttttagtgtagcatgtacagtactgacacaaattgtacaagctgttgctagttcccagtacggtggtcaatcgttggctcatatcgacgtgggtcttgaaccttacgtacaaaagtcgtgggataagctattagcgaagcaaaaggcatataatctcagtactgaattcattgaggaagaattacgaaaagaagtctatgatgggtgtcaaaccttactttaccagacaaattcaatgattagtacaaacggacaagcagcattcatttctcttagtttaggactgaatacttcaaaatttggaaaattaatcactgaacagtacttaaaagtacatgagaatggtttaggcaaagataagattactcctgtgtttcctaaagtaattttctttttacaggacggaatcaacatgaatagcgatgattgcaactatgacatgaaacagttggcaatgcgttgtgcatctaagagaatctacccagacttcgtttctgtgccgttaaatcataaagtaacaggaagtggcagtacagcagtaactccgatgggttgtcgttcatttttaggaaaatgggaagattccaatggaaatgagcaatataacggtcgtttcaacttaggcgtagtttctatcaatttacctctaattgctcttgaaagtgcctcagatggagagttttttgataaaatagacgagcatatgaatattgcatatcgtgctcagatgaaccgtgtagagcgtttaaaaggcacaaaagcgaagcagaatccgattttgttcatggaaggtgcactttcacgtttaggggcagaagaaacgattgacaagctattttataacggatatgctagtattagtattggttacgttggcttagttgaatgttcagaaattctgactggttctatcagtaaggagttctgtatgtcagttctgaattatatgaaagtaaaatgcgatgagttcaaaaaagagagtaatatagcttttagtctatatggaaccccagcagagtcactttgctacaaatttgcacgttgcatcgaatctaaatacccttcagtactaaaacgtgattacatcacaaattccttccatcaaccagtatgggtagaaagttcaccatttgataagtggagttacgaagagggatttgcttacctcagtaatggtggaaacatcagttatgttgaatcacccaacctaagtaacaatattcaagcacttgagactttagtcaattacgcttacacaaagattccatattttggcatcaaccagccaattgaccagtgttacgagtgtgggtataaaggtgagttcagtgtagataaacacggttttcattgtccagtatgtgataatcgcaatgagaagacaatctcagtgattcgtcgtgtttctggatatttggggaacccatcgtctcgtggattcaacaaaggaaaacaacaagaatgttgtgagcgtatacaacacaaataaggtacattatggatttaaagccaattgtggttaacaaatataaagaaccgtatgatgtgtatatcgggcgtgggtctaaatggggaaacccatttacccatatcagtgataaacagaccaaagccgagttcattgttgctacaagggaagaatcaatcgaaaagttcagagaatacattattgagcgtatttctaatggagaagttaagattgatgatttacttgagttagcagggaaacgtcttggctgtttctgtaaaccgaaatcatgtcatggtgatgttctcgttgagatagtgagtgcaatattagatgaattaccagacgataattaaagacgaccttattaatggggagggagtaagatgctccctttttgttagtgggtgcagtcatgggtgtgccggatgcttcaacgaagaagcatgggattatagaagtggacaagagttcagtactgatacaattgatataattttagctgaactcagtaagccttacgttagtggattatccctccttggtggagatcctctaatgaaaaagaacatagaaacaattttagaactatgtaagattgtaaaagagacttatcccaataaaactatttggtgctggagtggatatactttagaagagattatgaataatcatgctaaagacattcttcagtacttagatgtattagttgatggtaaatttgtttcagatgaaaagaatttgacattaccttttcgtggttcaaataaccaacgtattttatataaaaataaagacttttaaacacaagcacccaatgggtgcttttttagtacattcataaatacagtaactaatatctaaattacaagggatatgtatgtcaaagaaaatatatggtggcttagacgtcactcataatgtgacagttaaagggaaaagaacagtacagggcatcaatgatcaagtatttgatgctaatggtaatatggaaattgatacatattccaaagaagaattacttgatgtaattagtttacttccaatctcgcattatggtacacataactatctacctgctggggtatctggtgattttaatggtgcatcagaaaaccaatcccaacgtagaaacaaaatacttttagaaaacgatggcacattagtactattacgtagtggtacaaacggtagtgttgaaggtttgttttattcttacctagcgaacgcattatcagttaccgatatgagtcgtactgttaatacaagccgtcagtataagcctggctatttcggggcaaaccgtgttgctattggtttatacaataccgattcaaaaatactgttaggtcgttacaatgacacatctaccagtactaatgggttgtttatatcagtaacgaatggtacattggatgatacacaacatagtggtctttttgtgaaccaagctgatatttcacctgaaggtgggattgagtatgctatgatggcagaagacggttcagtttatgtattcaacgtccttaatgaaaataacaaactacagattgttgttgttcgtgttgtgttgaatattgcaaacggtacttatactgctacccgaatcacggggtggacaacaaaaactttttacaatactacatatactgctcagaataatatgatcattactgaccatgttacatcaacaaacattgcagataagccatatgtttatgtaccacagaatttagctggtattggaatttacatgacctcaatcgatttgtatgttgctcaagagccaggaacgcagaacttccgattcagaatgaatggtgacgcatggttcactatggcaaactacaatacccgaccacagcatagttatagtttcaattttaacatgagtactaaacaatgtaacttggataatgggaacgatattggtacatttgctgcaccatttgttgttacaaacacaggttcggcattggttgctactggtaatgttctcaacaacgatccgttatatgaccacaacggtgcaagaaacatttacagttcatattattatttgaatacaggtgatgtattctgtactgcatgtccaaacttagcagaaccattgcttatgcagaaagctaaatttactgcacaatcaatatatagcatgattaatgtacgtgcgaacatttcaactgatttcagaaatggcatagttcgtccttcatttggttcagcagttggttcttttgttaacggcgtagaattgcttccagggaacagcactaaacagtattctcgttcatctggttctggtgcattccgtccatcttatgcagttcataaaagtactcctaactttacgtttaattctttatcacgtggaaccatacaaggttatgagccaacaacagaacgtgctaatgtgacagataacacgaacaacagagtttttattagttccattagtggtaataatgttactacaaatggtgggatattcatggtaggtcagagatattcccaatcactatcatatgataaaaatatgaacggaactggtattattagtgttactcaatcagtacttgataatttcagaaatgctgaatacgctaaagtactaagcgactggaacttatctcctgctgcttataaagatatgacattgtttgttccacaacaaactgatatacctgcattcgtaatgctaagtacagttacaaatacatatcagaactatattagaattgctgaagtgaatgtgaatacacgttcaggtaatatcactacaattaccttcaagcgtttagtactagaaaacgtttacggaagtaactttacaccaaatggcaatggtagttttgcttcttcatctgttggtttgacaatatatgatggtggttctttctacttcataggtgggtctgacccattaactcacccaactataggtaatacaagtacacatcaatttagagcatatgtaacaaaagctactgcacaatttgatagttttattatcagtggttcacatgcaagttatgagcaaggtattcaaccagcagctttacctggtattggttttggatatttccaagcaatagactatgtaaacaaaatgactttccaaaaatgtggtactacaattgctgattataataactggactgctcaaggtgcaccgattaacgtagtttcacaagacgttgctcaaggttttattgtgtacttcactgaagaaactccagtaattctttctggtaaagcatttacattaccgattactagtataaacttaactacagttaaggctaatccagcaaacacattatttcatgtatatgttaaaatggaacaaggtaatgcaaaatatgtaataacaactgatgttatttcagaaactggtactacagcatataatattttctggataggtactatacaaacaaactcactacaaatatcaaatgttaacatacaaaaacgttcaagattggatattttcggtgcgtctcttgaagctgctggttcttcattcccagttagttatggtctaccgtcacaatcaggaacaatcaattggtaaaggattaatcttatggcatatattataagatccgatatcgaagctatgtcacaaatcgtagtccagaataaaaacactggactatctattagtgatattaatgacgtatcgtatcgaacagacgcaaatggggaatgtacattccccctcttaacaaaagatgaagttgattctattgttaacggtttaccattatcacaatatggtgaactttatgatgtatctagtttgtcaattacatcaagcggttattcattacgttttaaccgagagatacctgcattcatcggtggctatctttataattaccctgttgttgcagtgacagcaccaacagtggcatcaggaacacaaacacaatatgtatacgctactttagtactgggtgagccaatttatagaatctcaacttcacaactacaagaatcacagattataatgttcatcgggactattaccgttggaactgctggtattactgctatcaacattgaacgcgtatcacgattcaatacatacagaccaagtacaacacaaaaaggttcatctttcccagtcagtactggaaatccaacacaaactggtacattaggctggtaattaaaggaaaaagaatatgtcatccaaacgcatcattggtagtgctgctatacttggaaatttagcaattggtggaaagtacgctatgcgtacttttaatggtacagcaccagacgcaaatacaggtattgttgactatccaatttataaaagatcagaagttcaaaaaatacttgatatgttaccaatctcccgtataggggaaatggattatctaccattaaacgttaatggttcatacgaaggggcaacgtctctttcagatgtataccgtatgcaaccaacaatagtcgaagatgatggtactggtgtggtattacgtgctggtacaaatggtagtactgaaggatattactatgcattcattcgtgatttgcgtaatattgatgcactaacacaaagtagtgttatcagtactacatcaaaatatcatcctagaattcttccaagtactgaaaatgttaaacagttcatcggaacgaatggttatgaattactagttagcctatctagtgcaagtaattatattttcactttaacaaatggtacatttaacgaagttgcacatattcacgcttctatcgctgctacatcatttggtacagataaaccattgtatgcacatatcgttaatgataaagtatttgtgtggtgcaaagacactactatagcaaactatggtttggctttaacattatatactgttaatacaagtagtattaaagatggtactatgagtacttttgctaaggttactggtttttctggtcaaaccttaagaagtgttaactacacaagtgctaataatttgaaaatttatgaaagattatattcagttggaactagtagtgattcattatttgaatgcacttcaccagttacacgagttgaatattcagattatacagattataatatacaagcaaacgtaagtccagatttatcaaagattagaattacattattcccaactaaccgtttagtatcaaatctatatattagtactgtttatgctagtggttttagttttgtttatactatcaactctaaatcattatcaattgatggaagtagtagagcaccaatagcagcggaatataatgatgttgatggattcacattaacaaacccatttgccattgagatgaataacttcatgggtacacagttaggtgttccacaattaggtaacgttggttctatatgccaaacctatgacggtttagtattcagcacacgtgctcgttggagttcatctgaaacctatggtattcaggtttataacgtaacaggaacaccatatgatagttgggttgccagtactcgtaaagcgaacaattccaaatttgtaaacgttgcaccaacatatggtagtgcagtaggcgaaaaccttttaggaacacgttttattgataaacgtaaagtactgttagcatgttctggaacatatgaagatgagtcatatggttataacaatacagtattttctgaaattggtactgatccaaccttccagttcaattcggtacaaaacaatacaacacttaatggttttgcaccacaagctaaccgaactcgtcttggtgatgatttcaaatatacaggtatgatttcactaattgatactgacggttcagttaaatgttatgggacatcattcattgaaggtgtatacaaaacaagtggtggtttgtttaacccagatactttagaatttgatggttcttatacaattggtgataatgttctggaaacattaaaacaagaaatacttgctaatattggaatagtaggagcattttctggtaaaattgctttatattatgtaccagatagttctttctcaaaatctattgcggtggtttctgcatataacttaggaaataaccaaggttatgcaatatattctgaagttgatgtcactgtttcaggaaccaatattagttctgcgtctatggtgagttctagatacgaaacacttaattctgtaacaggtattgtaaccgaagcctatatgaaacgctgtactggtctaactgttgctaagtattctggttttggttatattggtgttgatgcagttcatcagttttcacaacctggtaatgctcaattcaaattgatgattgctaaaacagtgaatggtttgattacatctaaccgatttatgtcatccagctacatagataatggcaatgcattccagcacggagttataccaggtgttggatttggatactatcatcttcaagattcagattatcaaactaaagcagtgtttagtctctttgggacaacatcagcacagatggatgggttgattgatggttcaggaactgtacaagataaaatcgtagtagtttcacaagatgttgctgaaggtttcactgtgtacttcacccgtgaagttccggtattccttggtggtatgtttgatagattagcgattcaaaacatagaattaagtactattaaaactaacccagctaacagtactttttatctttacattcaaatgaaccgtaacacaagaaaagcggcatacgttatcagtacaactcttcttgatgagacattgacaaacgtatatgttggtgatattgttactggaagtacgagtattacgtcaattgatactgaaaaggtaacccgattcttgacatacagacctagtacgaccaagcgtggttctgctatcccagcaagtactggtgttccttcaagctctggtacacgttggcattaaaaattttaagctcgtctattgacgggcttttcttttatgtgtataatgctagaaaatacaggaggaaattatggtcaaatctttactaccaccaccaaagcgtcacaaaatccaagaaatgaaagaccaacgtacattaaagatgtacaacaatttagttaagttactgtgtaaaagtccatcgctcaaagcagagtttaaaactgatgatgaccgcaaagcactaattgagatgaagtatatgctcagtaaaatgtccttttacaaatttgtaaaagaatacgcatctgacccatttagtcctcgttggagaaccaaaccaagagagttttttttcggtggttcatatactgatatcattcaagatactgtgataggcgtagagttcgagattgattatgagccgaatggtgtggaaaacttgctgattgagaaacgtttaccaagtgaagaagaaatttatgtttatgcaagaaaactttcaacttacagttcaagaattactctaggcaagttagattcatttattattttctatatacgtgttggtgtagataaaatggtaactaaactcaatgaactttcattacaacaaaaacagattaatgcatacaaagacattactgatttatactaatgaggaatgaatatgttttttggcccagttggaaaacaaaacagtactttaatttggcatgaaattatctttaaaattatatcaaaaagtttcacacttaaagatatcatcaatacagatcaagatcgtcgtgttctgttagaagcaaaatataaattgagcaaacaccctttgctaccattaatcattgattacgttaatgattatgaatccagtcgttggaagtttgaagaaggcggtttatttcgtggaaaaacattctacggtgcggaacgatatgtattcagtgatgcaacaaatggcgttaagtttgctattagaaactttaactccaaagaaaatgattatcttgaaagtggagtgaaagtatatatcgataataatagcaatgttctaacatatgacgaatcactaattatgttacaaataatgcgtggcgttgaaggtgtaagacacaatcttactaatttgaaaattcagcaaaatgatatacataatagacagaaaattaagggtttatataaatgatttcatttttcaaaaagaaagaaaaagttgatgaaactggattagaatcgtttctatggactcttatcatcaaaaaaagtccattgataaaagaatatgccatcaatgatactaatagaaaaactatcattgaatacaaatacgaattatcaaaatgtgatccgattgtttaccactttgtaaagtactgttctaataatttatcggatatcaccattgattatgagtcagtaccaatgagttttccttatggagattgggtaaatacttatgatatttttgatgggtctaacggattcaatttttatttcacatcaaataaagcatatgttcgaatcaaaacagatataggttgggcattacatagctcaaataaagaagattataatttattagctgatgtatacagaagtgttaagaattcaaaggatattgatgaaagaattaaaaagcaaaatcgcatttctttatctttagaaacatataagtcaaagtacggtggttaattatgactacaatcgatgatatctacagtactatacgcaatatgagtacagatagaaaagtctttggtgacaaagaaaagtccaaatgttatggcatcgattcttttgatattatttcatacgaatataataacaatgggacaagttcactaaacattgtgtgtccacgagatccagaaaataatttcatgtacgttgaaattaacaatgatggtatgttctttactaaagtatataaaggtgggaaagaatacgaacccatcgaagtaatgaatgaagagaaattcttccaagaagataccatcatcaatcttggatttagttacaatgactatcaagtactggatcatgattttaaacgatactataatggttttctaaaggagttaacgatttacttatgaaaaacaattttctagaacaaactattgtgaaacacttagctggttcacaggcgtatggcacaagcacaccagaaagtgatacagattatcgtggtatcttccttgcaaacaaagaatatatcctaactcctttttttaatgttaaggaagtttcagatacttctgaagaagatactaaattttatgaaatcaatcagtacttaagtctgtatactgaagctaacccaaacattcttgaatcactatgggttaaaccggaacacatcgtagaaagtactgaaatctatgactatctacgctcattcaatcagcaattattgagttcaaagattgcacactcatacagtggatatgcatacaatcaggttaagcgtatgtctaatcaccacggctggctcgataaggaacgaattgctgaacgtaaactaaatgaaattttagaagaacatccagttgacgaagtactttcatggatgtatgatacattcccgcagtatttggttgaccgtttgaataaatccaatcttcacccattcaatgctacaaaaattgattttgaaaaatacatgcgtgatacttcattacaattagtttcaacacaagcattgaaacaatatcattttgtacgtttagtacataattatagtactgataaagtattagatcgtgatttcaatttattgaattacaattctggatatgaactaatccattacggtgaaaacatctttggggtaattatcaacccgaatgaaagtacagtgaatgctgatggttcactacgttacttcaataaagaacgtacttcggaagaattaaaagttcgtcctgaactcattgtaaaattcaatgaaaaggaatacaaagaaaatagtgagaaccgtaagagttatcacaaatggaagcagaaccgtaatgccaaacgtgctattcttgaatcacaccacggttatgactgttatagttttgatactgaattcttaactaaagatggttggaagttatttgatgatattactgaaaacgatctattagctacttttgacaaaaatcacaaagttgaatatcagaaatacactgaacgttttgataatttatataatggcaatctataccatttcactggtcatcaccaagatactttagtgactgctaaccaccgaatgtatgttaaggattatgcacgaaatcaacaaaaagatatgtctgattggaaatttgtagaagcagcacaattaaaagaaacatataaaattttgaatacaatatccccaataactaaagaacacaaagataaaaaaagtccaattgactacatggatatcaaagtttatcttcaactcatggggtggtttatttcagatgggtgcataaatttcagggatggtaaagtaaaatctttatatatttcccagtcaaaaactagtcaaggtatgcgttgtgctttatcaaaatacaaaaaatctggtcaattaatgtttaatgaatacattatagaaaagaaagattatcaagctaatgacgaatcaagatatacattcccaagtgaagtagctgaagcattatataatgattgtggacatggttcatataataaacgaattccaaattgggtatttgatttaacaaaacgtaaaatggatttccttctgaaaggtttgttacaaggtgatggaacaaaacgaaatttagttaatgacaatgatacatttgtatattatactgccaattcattattagctgatgatgttcaaaaactagcattactatgtggttatgaaacatcaaaatggggaccatacacaaacgaaaccaattttggtagtgttgatatatatcaaattcatatcaatatgaaacccaaaaccgaaaaaatgaacatgaaacaaaatcttgaaaaaattccagttactaattacagaactgtgtgtttttctgttcccaacggaacactcattactcgtagaaatggaaaaaccgcattacatggaaattgcaaacatgctatgcatacaatcaggctgctgaatacagccgaggaagcacttgaaactggcatcatccaagttcaccgaccagatgctgctatgttgatggacattcgtaacgggaagtggttgtatcaagaagttatggattatttcaacgaaaaggttgactacatccgaaatgtggcgtatcataaaactcatctaccgaagcgaccgaacataaagttggcgacaaaggtactattagatatccgtgaaatgcaatggtacagtaaaaaataagaggattgttatgctaaacgaacaaatcaaagacgcactacgtgtactgaatcgcgaagttaaccgcatccagaaaagtactgatcgttataaactaatgcatgaacttagactttcgttggaagctatcaataatggtgaatggtatcttgagccagaatatcgcactcgtgaactaactgacgttgaaaaagcaattgtcaaattcattacaagtcgcgacaaaaatgcatcagagaaagatgtatcaatgaacttccatcttaagaaatgggaaattgaagataaatttaaattcgattggcttgactggcttgaaatgatcatggaacttgaagaagaattcaaagttgaagttgatcaaaagtacgaagataatgatacaatgctatgtaaactcgtagatcatattcaaaaaatgttgtaaacatataatatagtacactctaaataatattaccaactataggagatgttattatgagtgtactagaaattattgtttcaaaagttttaataccatattggaaaccaattttggtagtaggagtaatggcaggttgtgtttacggtggatggtcagcaaatacttattatactggttataaagaaagtattgaccaaaaaatagaaaagaaagttgattctgcactcgctaagatgcagcaagaaaatgcaaaaaactatattgaaaccaaaaagataatgcaagataatgctaaagttatcgagacacaagtgcctattatagtagaaagagaagtttacaaaaacgtatgtctagatgaagatggtgttaaacttctgaatgaacttaaacagaattcccttgcagcgaggaataaattcaaatgaaatacgctttagtatttgcaatttcttttcttttaattagtggttgtgctcaggaatttaagtatcaacctaagccaattgtagaacaagaaatcttacttgaacgttgtgacgaaaatacaccactaccaagtaaaatcatggtcgataaaaacgggttcagaggatatgatggtgctgaaattcttgcagtactcgtaaaatgggatgcaatgtacaatgactgtgcactaaaacatgatgcattaattaaaactattcgtgatttacaaaatcaagatgttaaggttaaaattaaatccgaggattaaaaatgtcaaaatatcaggtctactatgttgccaaactatcacttcttgatgagttaaatcaaagaagtacacagatgaaacgctatacatataacggtgttactttccgatacttcccacaaaaagtacttacattcgttaagaattgtaaatgcgttgcgtgtggtattgaagccactgaagttcgcgttgagcgttcacatagcactgatccggtatatggtaaacctcacttaaatgtctatgcagtttgtggtctatatgaagtactgatgacagtagatcataaccaattagcatctaagggtggacctgatttagagtcaaattacaacaccatgtgttcacgttgtaacagtcttcgttctaataaaactgaatcagtaggtgaattcctggaaaaagttaagggtagaaatctactggaagagcatatgaatgattttttcaataaagataagaagaaatctaaaactcctactccagaagaattggaagaacgccgtttacgtacagaactatgggaaaccgaccatatatggcatgttcgtgattttggacgacatatgaaagctctaaaaaaagaacaaaagaaattgaataatcacaattaatgtgttatgatagggacttgagaaatcgagtccctatttttttggagaaaataaatgaaatctaaaatctttttaccgcagttaatgtggcatctggcagagttagatgaagatgatgaatatactgactatggtacatgggatgacagtactgaatcattcaatccagatgttaagtacaaaatcattagtaatgaaagtaaagggcatagacgatggacagaagaatttgatctagtttttcttgacatgaacacgaacaaatattatcattgtacgtatgaacgaggtttaacagaagatagaccagcagaaccattcagaaatgaaactgatggtgttaagtgctatgaagtttctgttaccagagaagaaattatcacttatcgaactttgtggaaatacttgtaatgctaaaagaattagatttttcaaacttagaaatcatcagtgctgttaaaaatatctctgactttggtgatgagaagtcagtactggtaactgttacattcgtcaaagaacaggatagctatagccatttagatggtattgaagaactaattcacaagactaatctacaaaacgatggtaaactcattaagcttcaggcttcctatacgcaaaaatcgtcattttttgtagacctaaataatgtagtcaaggtggtatacaatcaccctgaacacaaatacaggaacacgacaagaaacgagaatgatgctatagactccaatatcaaagaggatgtcgaattcatcaacacaatttttgatcgttgttccaaggatttgaaaaaggtatacatgtaacgggacataacacatcctagtgatataatgtatattgtaaaatgacaacggacattgaaaaatggataatgagaacctacttctcttgaaaatgtaaaggatagatgagctttaccgttgtagcgaacagcaaaagaaacctgttagagtactggcaatcaaacaaacacgagataagaccacgaatcacggcgacacggctgtataaagaactccaataagcacacagagagttcctagatagatgtataaggttcgcaccttacgaatttgctaagggagttcaaggattgtggacgcgattttacaagaaagttgcgtccaaaatttgagaacaggtactactttgatcgaatagagtttagtactgagtgctgttgatgaaaagaccagcgaccgttgcatatgactgcgatagagagaaaccgagcaacccgctttcgctctctaaattttggtacaggaaagatccgtccaaaatttgagaaattcgcaattcgataatatccgatgccatcatcgtcaagagagacttaattgtctcttttttattaccttcattcccctgcggggggatgaaatagtcctcaacaaatcccgtcaagcttttaaagtacattatcattttcagaaggaactagtttacgaagtaaacgtagtgacttcttgagttacgagagaacgaagtgaatgagtaacacaacgaaaatatccaatacatctgaattaacacaaatgttattcaaagaatattttgagtatcaaatcaaaagcgatcataatttggttcagacctatttgaagagaatcaaagatccattaagtttaaacaaaggaactgaattttataacagtattttagactttattaatttagttcatacaaacagacctattgtagttttcttctttgataaatcaattcctgtagaagttcctgataatgtattttttgttactgaaactgatttaagtaatcaaagtactgtaagtagattaaggaattgcttacttataatttgtgattcttcattatataacaatagagtactatggaatagaagtaagagaaatgcagtttcagaaatgaatcctgaagttacctttattattaactaaataccatagaataactctaaggagagatttatggaaaatattaatgatttgcgacatgtaatggactttattggagatactgaagaagatagttcttatgatgaagtactacttacatttattgagaatagtttatttttaagtgctgctgctcacaactggcatttacagagccatttctacactaagcacctacaattggatgaactatacaaagagttacctgagtacgttgatgcatttgtagagggtattatgaacactcgcggtgcattgcaggtaggtactggtaacagttatcgttttacccctatcgaggattgtgtaccaattcttgaagaatatgttagtcaatgtaaagccattcatgctatgcttgaagaggctgaagactatggcagtactaacacactagaagacattatgagtttttgtgaaggaatgctttacaaactcaaagttttacaataaaatatatggagagtcattgtgactctccttttcttttggagaatatatatgagtgattaccgcgtaacatctggactaatggcccgtcttattgaagcagttcctgaagatgattatgaagctatttcagatcgtctttttgacgcagattctaaactccatattacatatgatggtgcattgatttacagtactgatattgatatgtctagttatgaatttgagatttcttttggtaacaaactaactactgaagaattcgctcaaaaatgtgagcgtgaagggttgtgtattgatattagttcagttcagccatatacatcactgtggtatgatggtgctgatagtccaatgtctactacatctttacaggattttctaaatgcaaatcaaaaagattaaattccaccagcattgttctatacatgaatgtgatgattgtggtatgaacatgagtgacatttatacagtttcctgtaaaggattcaaattcactcacggtgaacctgcatattgttatggcacagaagaaggtgatatcgaagtagtactgaaagaattgttccagtacttgcaaagtgcaggtcatgatgttacaatgcccacatattacgaagatgattatgactcacatgtagaagaaaatacatattataatcaattcgttcatggtaatggttttatcacatacctacatgagaatggtattgaggtaaaaactaagtacactagtgatgattacgaaagcgatgactctatggagattgaagattgaaagcaaaagacctagcagcactgttgatgcagaaccctgaaatggaagtgtatcatgagcacatgcatattgatgatatgtgtgaatcgtactattcaccagaaaatgtgtctgggattgaaatcacaccaagtggtgtattcatcagtactgaacgtattgattacaattcccagcaagaaatcaaaactccacataataaacctcgcattggtgctattgacctagtatttcatcaggaccgtttggttgaatatgatgaagacgatggtactacccgaactgatgttgagaatgttgtttttcctttttataatgcatacgaagacccaacaactggggaagacttatttcgtgagctattagaggatggacaagtttatggtcagaatggaacagttttcacactagaccctaattatgaaccagatcataacacatggcaattctatacacctcaagatgtaatggaagttaaagtacttacagatcttgacgataattggaacccagtatatacttcaatgacatttgacgaagcaaaaaaccatttcgtttctaaactaaacattacaaaagaataaggatttgaaatttatgaaaattgtcgcaagtgcatggatgaaactaccagatggtactactgcttttgaagagtatggctttgttgaaagtgtagaagaattaaagcgtttcaaaagtgaaaatgatgatgatgtatttgacattgtattcacctatcaccatattccaaatgatacagattatgaacattattattacaatccagacctattggaaaatctagtgtgcgacaatcaacatgaaattgatgaaaacactgctctactaatgctgagtaccgtatctccggtataaggagttatatgtataaccttacaattatccgcgaaccaaatgaatatgacggtaatacaatctatggtgaagttttggtatttcaaagtactgaacaaagtggtattgaacataaattaaaagattatttacgtgatcatttatatctgcaccgtactgatgcaaattgtaattatggtgatataatgtttattgtaacgcacaatggtgcggtaattgaacatatgaacatgacaaatgtaatggatttttataattacactgatacttcttttccattggataactatttcagtactgtttttgatgcgttacgtaagaacgttgctaaaaatgatagattctgtactaattttagattattagaaacaaatacaagaaagaatctttctaagaagtatgatgaagaacataagaaaaatcaggaaattcaacgtttacatgagttaatgaagaaatatcccaacgaggtcaaatatggctcttagaggacaaactcaatataagtgtattgaagaaatcagaaagaaagatggaacactttttgacaggaaattaaaacaagaatataaagacctaagagatgttatccgaaatgaaagtttcggtgggaagcgtagacagaagatttatgaatttctgaagaatggtgtagaaattcaagtcaatggtcttcattgtgtacaaaccaaaaacgatccagatattttacgtcttttaaaagagggtaaaatagaaatgttcaatatcccaatttcatcctatggtaatagattaaaatgtaagcacacgtacttaaggattaaaaatgggtaaattagtatattactatggtagtatgtctagtggtaaaagtactcatcttttacaaaaagcatataaccataagaaaaatggaatgaaggtaatttacttaaccagtgcacttgatgatcgttatggaacaggaaagattacttcgagaattggcatcgaagctgaggctgaagtaattccaaaaaatgacattagtgttcttcttaaagttaaagaaacactcaaaaatgacgttgacattaacagtatctatgttgatgaatgtcaatttttaaacagagaacaaattgaccatttagctgatatagcagataattatggtgttgatgtttcctgttatggaatccgaacagattttgaatccaatctttttgaaggttcacaaagactgttcgaaatagctgatgacatacatgaacttaagaacgtgtgtgagaatcagaagtgtggcaaagaagccactatgaatgcccgtatagttgaaagtactgataaagtctttattggtggtgatgaatcatacaagagtctatgcagaacttgctatatggattatatgaggaataaaaatggttgattcatttatgaaacgcgttttgaatgatgtactatctggatttaaaaaagcgactagtcttatttttagttcagtagtgatggttattaccgtaatggcatttgcacttgtactgcattttgtaccattctggttagtcttcattgtactcattgttcttctaggtacacatgtttattatgtttaccgtgaaatattggatgatgataacgtttaaaagtgtttgacctcactatgtggggtctttttaaggtatctatatgcataacgaaactgaagtcttcaaacgtttcattgatatttgtttacacacgaatttggtatatttgggtccaggagcaaacttcagaactttatcttcaattttaggatacactgaaccatcatgcttatattgcgatgggaacatgatccatctcactgatggtgattttaatgttcagtacatttcacaatgtgatatgtatgtattcaatacaccagaatataatattattattgaagaacgtactaaagataattacccaacccaatatgtaagttgggatagaacagattgcgtatatgccactggtccagtacagaaacctatgaactatcctactattcatttgaatgttatccatgatgaattgaaagattactgtaacagtatttcagattcggaaacaaaatactttcctattatattttttaaggtttgattatgagatggcgtaaacgacatgtaacaagatttgataaaataatcaaaaaatatttctcacataagttagatccaatcatacttcaactaagaagtagtatgtttgatagacgtttcccacagtgtttagaatcgtacagtcgtaaacgttacaagaatgaatacctggtatatcgttatgatttatcagaattctttttgaatactcgtgtatctgtacccatcagactgtactcaagggtaaaacgcagtagggttcaagatatcacttatggttatcttatgcttgagattaatgaactcaatgaaaaaacaggtagaaatttcagtactttatgtctggaaaacaatgataccataaaaagaattatagaagatttgggcaagtaggattttttatgctataattggagatgagtatgaaatacatcgacaaaggtacagttgaaacacagtactggaatattcatattgctggtgatatccaaacagcaagagagtacacaagaaagtttgcattcaaacttggattttgtgtacaattgattccgtgtgaatacatctacacgggtggtcttgaaagtggaatgtgtgctcgtattattcagtacccacgctttccaaaagaagaagtatatctcaaccgagatgtattaaactatgctaagggtttagctgaagagttgtgtcaaaagagttttactattgagcgaaacaatgatacaatctattatgaaagtgccgaccctttacacaagaaatgaaaggaaaatatatgaatggactaaaaaagtttggtaaagattttctaaagtgcatccgttatacatacgatgctaaccctgaaatgaccgccattgtgggtgtgtttattacactcgttgtattaagctttattgtggtgtaaaatatgattgaaattaatgctgatgtttattgtagtgcatcaccaaactacttcatttatgcactaagtacatttggtgaaactgaaggtgaaacttttgttttagtagataatactacatggtacaaaacaagtaataaaattccgaaagatgttttagaaacttatgttcgtattgaaaataaaaacatatatgtaaatttataggtaaaatatgattgaaatggaaggaactctggtgtatgatccagatcgtggcactatgaaaaagaagaaggacttctggttagtactgcaacttccattacagttggttcgatactaccagtacttcatcagaactgacttacatattgatattaaagacccacaatggggagcacatgtcagtatcgttcgtggtgaagtgccaccaaatccagagtactggaaaaagtacgatggtatgaaagttaagattaagttcgaacctttcatcgaagaagtaaaagacaataagaaacctgggtcattctttatcatagagtttgaagatgatttcattgcacaaattcgtgatgaacttggtttagcatctaaatatttcaaatatcacatcaccattggtagaacatactacgattaatgtggttatttggtaaataggtcttgatataactaaaaagtatgctatactacttaaatgttccaaagaacaactgagtactgtagaaagtccaatgaggcttttgcaaatggcctctttgccctctttgtgattgcccattgttaacaaccaacaaaggaggcgttttgaaaaaagcgaaaaaagcactgaaaactaaaattgccgtaggcgtattagtttcatcagccctattcgctgctattggattttatggtttttctcaaagtgatcatgtaccatcattagacgaaagtcaggtgcataatttaaaaccacagtttactcaaattcaaaagcaggaactaccaaaggtatcagtaccaaaagcagttccaagcagcgagaaacattatacggttcaacctggtgatagttattattctattgcacagaaatttaaacctaaaaatgtacagattgaagattatgtcattttgttgaagaacatcaacttaaatgcaactcttcatacttctcagggtatctttatcccaacaaaagaggatttgaagcacgtattgttaccagatgtgactgtactgtttgattataaagatccagaaattgtcaatcacatcaaagaagctgaaggttctattgaatttcagtccaagaacaaacgacgtttacttggtgggaaagttggagttccatatcgaaattctaaattttatccgtatcgtgatataaaaggtaacttcactattgggtacggacattatcttggaaagaaagaatcagatgcaagtaagtatcgtaatggtattacgaagtcacaagcacataaacttttattgtctgacatggaacgaactaataatgatttagttttattattgaagaaaagaaatgcaacaaaccttacggctgaacaacaacgaattttatttgagatggcatttacattaggagttgataagttaaatactttcaataaattatggaaaagcgttgataatcaaaatgataacaagttcaaaaaagaaattaagaattctctatggtatcgtcaagtaggaaaccgtgcagaattgttagttagtaatctttaaaactaaaaaaaaggtaggtaaattatgctagatttagttatccaaggtaatgttgatattactccagcaatcaatgacgcgattcatgcagaagcaaatgcactaacgaagtttagtgattcttcagtactttatatcggtgttcatgtgaagaaagagcataagaatcaatattccgtaactttaacatcaggtggtaagattgtcaccgccgatgatgcagatttatacaaagcaattggtgattcatttgaaaaaatggaaactgtcttaggtaaagacaaaagcatcaaattgcatcgccgtaaccaccccgaacatccagttcaagaagacttgactgaagacgaagagtaagatataataaagggacagagattattctgtcccttttctttttggagtacattatgaatgcagtactgatatttttaatgtgtgtggtatttggtgcttttggtctattcgtaattttagatactgaaccaagtactgaagtaggtacaaccatcacacttaaacctggtgttaaaattaatgatacctattgctacaatccaaacacaaaccgttatgagatttgtttatgaaaacattcaacattgttcatataattgaaccgattgcagaacatattaaaaacataagtaagaacgagtcaggttttttcttcaatttagacaaacttcatcgctataccaatgtatctagttttaatcgtgctaagagactttatatccgtatacacaacctatggtacagtgacgatacgttgatgatagatattactgttgatgaagacataacattaagatacattgacgattttaaatcagatgatattcgtgctggatcattaccaattgatgcttcatatgaagaatatctacaataccagttcattgatgacacatttggatttgactttgaactatataatagtataatgaacgtataccatatatacgaaaggaatttgaatggacattcgtaaaataccaaatttccacaatacattaaggttcttttctgaacaagaaatcagtactgaaatacgaggcatgatttcgtataatcaatatagagtactaaccactaataaatttcagggtacagtacgtgtaaaaatacgaaacgcgttagtagagaatgatgaattattaattacacttagaaaaagtaagatagaattaacatacgcaattttcgatactacatgtgatttgatgtggaacacactgttaaaaaaagaaggttcattgccagtttatgataatggtcctgaaacacttgatcagtacatgttcattgatgatacatttggcattgactattctgcatatcagtgtatactagctatacataaaaaatattacgaccgtctacgtgacagattaatttaattggaggcattatgattgctatgttagaagaagattggggtgtttccgagcaaggtactgatgaatatgaatacccagaataccaaccaaaaggcttctgggaacgtctacgtgattggttgatgggggaatgatatgaaaaagtatttggttggtggctacgttcgtgaccgtttaatgggcatccgtgcaaaagacaaagattatgttattgtcggtgctaccgaatccgatattaaatacttgcaaagtattggatacaagcaagtaggtaaggatttccctgtatatctaagcccagaaggtaatgaacacgcattagcccgtactgagcgtaaaactggtactggatatggtggcttcgaagtgaatacaaaaggtgtgacactagaacaagatctatatcgtcgtgatctcacaatcaatagtattgcatatgacccagtactccagattcacatcgacccttatggcgggaaagctgatatcaaaaacaaagtacttcgtcatgtatcagaacactttaaagaagatccattgcgtgttctacgtttggcccgtttcgctacacgttactctgactttacaatccatgatgatactatgacaatgtgtaaagatatggttagtactggtgaactagaccatctagttccagaacgtgtttttgttgaattcgaaaaagcactttctgaagaaaacccttccaagtttatcaaaactctggtacaatttggttattacgaaaaggcatttactacagttccagttaccaagaaacgtctggaattaattgatgctatcgctgcaaattgtacagaagaatataaaccatatttcttatggacagtacttcttgaaaatgaagaagtaaataatgattcagtacttaacggttccattaaggttccagttaagtacgtgaagtttagtaattacatcaagcgtttccgtgaagatattaaaaccttccgtaagaagaccccagttgaaatgggacaaatcttactggatatgaatatcaaaaacaatggtggtgaagatttcctttacaaagtactggaaaacttcattttgaacaaagaaattgattctgatcttgaagatttgattattaaagtttatgatcgttatactgatgttgaattacctgatattcagcagttagtgaaagatggtgaactccaaacatcagagattcgtgattttgttgctgaattgcgtattgaagcaatcaagcaaatgttctaaaagctgggacaagttaacatcttctgatataattactagtatctgaacatcacttgatgataaagagataagattatgcgttatagctgtggtataatattttatcgtgatggtcagatacttatcgggcatacaacacggacagaatcactgggacttacctaaaggtaaaactgaaggtacagaaacatttaaagaggctgctgtacgtgaatgctacgaagagacaggatatgaaatcgatgaagatgatcttctgtttcttggtgatgtatcgtatagaaaggggaaacgtttagttttatttttctatacagccaaagataagcctataccagaagagttggagtgtaaaagtacttacacaaacagatatggtagaagtcacccagaattggataagttcatgtacattgatgtactagattgtcaaaagtatttgactgaacgaatgtgtaacagtataataaaggctgttacgatgtttcaacgaaataaagggaaaagaaatgaaagttaaaatttatggtcgcactactggttgtaaattctgcgacactgctaaagcagtatgtgaaaataacaaatttgatatggagtttatcgatattgttaccgctggtattgatggtgctaaactatctgaactatgtggtgagccagtacgacaggttccacaaattttcgtaaacgatgtttacgttccaggtggctgtactggtttcgttgaaggtcttaaagaaggtcgctggaattaatgaatattgataaagtatcatctcgtgcaaaacatttagctgacacattgggtgttgaatttaaaatgcctgatatggaagctgcaaaagttaaagcacaacgtaaaattcacaaaatgaaagaatacactactaagaaagaacagtacgataaagcggttgcttatattattgaagctttcagtaaagatgatattttggcattcatcgcttcagtagaggtttcgagcaaccctaaataataatgaagaacacaagttcttcgtaacaatttgggagatactattatgctcagttttcgtgaacaattagcaaaaggccaattcgctgctaaagctcaaacatccattcctaaaaagtctgctttcttagggacgattacagaagatggttattgtgattatgatgcaccagaagattcatggtacattacgaaagacacaaaacgtggtaatagacttcacaaaagtaccattgctcgcaaacaacgaaaagaattgaaaaaaattcgattcggtgaagaagaataaaatataaattaaggactctgattacagagtcctttcttttcggagaatataatgatacatgaacattgtggtaatctgtttgatttattcagtactgttactactgatcaaactgcattacatattatcgctcatggttgtaacgctcagggtaagatgggttctggttttgcaaaagaattaagaaagcgtcaccaattggcatatgatgtgtatcatacacgttataccaatcagaatggtttgaaattgggtgaagttgtctatgcagcaccaaataataacttaattattgcaaactgcattacacaagagtattatggtaatgatggtaagaagtatgtaagttatgatgcgattgaccttgcatttaactcgatgaatgaattcattaaaaatgaaccacaagagatccatgtacacttcccgaaaattggagccgatttaggcggtggtaactggaacgttatcaaagaaatcattgaccacagactggttaatgcagaaaaacacttatacattctaaaataaacaaaaggacttgacaaaaatgactatgaccgttaaactactaaacatcaacagcgttggcccagtactagcaattctacaaaatgatgcaccagaagcagtagtagttaactacccagcacagctaggtactgacgaacaaggtgaaatcattctacgtgattacctagaattcattagttctgaaaaaggcgttattttttataaatccaacatcattagcatcagcgatgcaaaccctgcactagttgaagcttatgttgaagcaatcaaggctatcgaagaaaaaccagcactgattgttcctgataacaaaatcattctataatagaggtatctaatggctgctcaaaacgttaaagttaaaactatccaagctatcgtagtactgaaagattctactccatcaccaaaagaactggttatggctggtatgacaatgctacatcagtacaatccagaatcacctaactatgtactggaatacgaagcgaagcagtttaaagaacattggcagtcatggattaaagataatgaaatggaacaggttgtttatgctgctgatgacattttcgaattagaacaaatcgaatatctagcaggacaacaatctgtaccattgagtatcttcggtaatggagaagaagttttagtactgggaccatttaccgctgatgccatcatgcatttactaagtaattgtaaaaaagttggctaaaaaacaaatattatcaggttaccgtaataacacgttgcactacaatgacttaaagtactgggttgacccacacaacaataagtcattgttgctgtacagagataaatttcgagatttgtacggtatatatgacacacagttaatatacttagttgataccgaacattttgctcctatggtatacttgtattgcttgtataattccaaataactattagcacctctaaataatgtatataaacattaatgaggtgcttttttatgtcttacgattatatgggtggaaacccagatgctccaaactttgatcatcgtgaaaaactgaaagatgttatcactcaaatgttaggtgctggtgcagttgaagttgaaattactgatggtcaattggaaattgcaattgataatgcggtatcaaactaccgagcatggagttctgcttcaaaagaagaagcattcttgaacatgaaattctatgattcacaatctgtatacatgcttcctactgaagttgaaattgtcaaacagatttatcgttatggtaacggttatctaagttctggtagtggtaactcagtagaccctttttcactcgcatttaccaacacttaccttttaacgtctgcacgtaacgctggtggttatgacttaactacttatgattttagttttcaattccaagaattagttgggcgtatgtttggtagagaaatcatcttccagttcaacccaatgaccaaaaaactaataattgatcgtgatattcgcggtactgaagaagtgctattacatgtatatcataatatacctgaaccattgctattccaacgtcaacaaagctatccttggctacgtgactgggcattgtctgaagctatgattatgttgggtcgcaaccgtgctaaatttgctacattgcctggaccacagggtacattctctatggatggtgatacattacgtaatgaaggtgcacaacttcaagaacagcttaaagaacagttgaagagatacaaagatggtggtgacccacttggaatgattatcggataaaacaaaaaaaaagactcctatatggggtctttttttatatgttgtgatataatgataatattaatctaaaggaacctgacatgaataacaacatagatgcagtgtatgcaatgtataacaaatatacttgtggagcacctacattggattatgaatcaaccgaaaagaactggaaatttataaaagaatcaatcgtagatgttttcggtagagatcgaataaacgcgtgggcgagtatatgtcgtgatgataatggagaaacattctacatcacttatgttactatatattatgggagtgagtttatagttggattacttgaatgtttagtaggaaaggatttagtagtacttatataatatacatggagaagtattatggaaagacaaataattgcaattaacggtactatcggtagtggcaaagatacttttggtgaaacttttatcaataatggttacacaagaatgtcatttgcaactaatcttaaagattcagttgctgctatctttggatgggatcgtgaaatgcttgagggttcgactaaggaaagtcgtaaactccgtgaagagccagaccagtactggtgtgagaagttggggcgtgatgatgtttcccctcgttgggtattacagaattacggtactaatattttgcgtaagtactttcataatgatatttgggtccatagtttagagaagtcaatgcaatctgttgaagggaatattatcattactgactgtcgattcccaaatgaactaaaaatgattcgttcattaaatggtattgtgattgaagttcagcgtaccctcccacactggtatggtttagcagcatcttttaataaaggtgatattagcatgaaaccaattgagttagaatcagttcatgaatctgaatgggcgtggattggtatcaataatcctgatatcattgtacaaaataatagcacaattgaagcgttgcaccaacaagcattgagcgttatttatgccaataagtgaaattaaaacaattaggacttgacattcaaatccttcaataaataagactatacgaatataattcgaataaccaattatttttggaggatttaatatggcaggagatctactctcacctggcgtttccatttcagtaactgatgaaagtatgagtactgctgctgctcctggcacagtaccactatttgtaatcgctactgctgaagacaaacttgttcctggtagcagtgcaattgctgcgggaaccactaaagcaaacgctggtaaactacagctactaacatcacagaaaagctcactagatacatttggctcaccaattttccaaatgaacaatggttcagttgttcaaggtgacgaactaaacgaatatggtctacatgctgtgtattcttatctaggtatcaccaaccgtgcatatgttattcgtgctgatatcgatttggctcaactatcaccaagtgcaactgcaccaactggtccagtaccgaatggtactctatggtttgatgctgctcaatcacaaattgaagcttatgtcgctaagaaagacagcccaagcagcttctatgactggcaattgaagcctgttaccatcgtaagttcagaagaagttgacgatgtgagcctagttggtctaaacgttgatgacctcgttctacgttacaaaccaagtaatggtcaaatgcttatgtacaaacgtgcagcttctggtctagtacaggttgaaacttacctatcaccaatcaacaaagttccagttggttcaactattgaacaaggtaacgtatggattcgtgatggttatactcaaaatggttcaaactattttggtactcgttttgttctaaaacgttatgcatccctaactcaagtttggaatatcgttccagcatatactggtaattctttccaagaagttgaagctaagagtggtgtactaaacaacagttatattgcttgccgttttgatgacgatagtaagagtttctctttctatattcaaagtgcaaaactatcagcaattagtgctccagcagtaccactaggtgaaactgttattgagcaagctggtgaagatagttatttgactttcgcttacctaaacaaatctgttaaagtacttgcagtaccacaaggtggcgtaattaatactcaaactatcatcgataatctaaatgttagtgctgatcttatcaatgatggattcaaattcaaacgtgaatctaatggtggtttggtagttacaaacaccaaaggttatagctttaaagttacccaaagcggtgatgatatttttgcagcgaatgaactagctaaactaactgtagatagtaataactattctctagttaacgttaataacttacgtgttagctcttctgttccacgtagcattgctaaagatggtactatttggtatgatttcagtaattccgataacctaactgttaccatgtacattgcagatgttgcaaatgacgaatgggatctagtacaagaagataacaaatacgttcaagttgatgagccagcggctgaccgtctaatttgggtacgccctctatctcaaggcattgatggttatgatttctatcgtaacgttgatggtgagtgggttaaactagacaatactgaccaaagtactctaaacggtatgatttttgctgactttaacttccctgaacaagttgcggcggctgctctttatcagaatggtatgcttgcaattgacctcggtaataccgaaggtgttgttaagaaaatggttaatggtcaatggcaagttgttagtggtgttagtcttgatggtgcaggtctatttggtcgtgcagcacaacgccaactaatcgttgaagcactagctgctgtaatcatcggtaatgatgatatccgttctgaattcatcgactttaacctaatctgtgttcctggttatgtagaaactctagatgaatgtattaccctaaacactgatcgtaaagaaacagcgtttatcgtaactgatgtacctgctcgtttgaacccaaccggaaacggtagtgcagttcaagaatgggctaccaacgcgaacaacgcaccaagtaatggttcagtaggccgtacttctgcatatgattatgctgctcagtacatgggctggtgtttaagtactaacgttgatggtgaagaagttgcagtcccaggcagtactgttgcaatgcgtacctatgcgtacagtgatagtgttagttttgtatggtatccacctgctggtactactcgtggtgttgtaaccaacgctgcaagtactggtttcattaatagtgaaggtgaatatcaaccagtagtatacaaccaaggtcaacgtgacgtgatgtatacaaacaacattaacccaattgcaatgcgtcctaaccgtggcttgctagtatatggtgataaaacactatctgctaaccaaacctctgcactaagccgtgttaacgttgctcgtttggttgtttacattcgtcgtcaactagaaatcatctctgaaccattcctattccgtttgaatactccaagtactcgtcaggaattcagtggtgtagtgaatagcttcctagctgaaatcgttcaacaacaaggtctatataacttcgcagtagtttgtgacgaaagtaacaacacttctgaacgtattgatcgtaacgaactttggatggatattgcaatccaacctactaagtctatcaacttcatttacgtaccgattcgtattgaaaagactcaataaaatactaagggaaccttttggttcccttttttattgtttaaaattaaatacgttatattattaattaaacgattaggaataatatggaagaaatacttaaaaaaacattacaagatgtaagtaaaactgtagcaacacaggacgatgccgtaaaaatccttaaagcttttatacaaaatttggaacattgtcggtataattcgagaatacaatgtttacacaaatggtaaatggtcggttggtgtaaactatacagatcataaacaagaaaaaaagtacttgtattgtgtgaatatagattggttccctgttgatgagatacttcaataaaagtgtaagtaatagataaataatataaagatgtcattccataacaggagaatataaatggctacaatgcttgatcgatatggcgttccgctcgctggcggtggtcgtatctctatgaaacaacctaaagcaaaatataaattccgtgttgttttctttggcttcggtgctaacgacgatggcaatatgattaccctagataccaacaccgttggtgctgtatctgtatcacatgaaaacgtcactgtgcatagttataacagttctgctcactataaaggtaagtatacttgggatactattgatgtggctttccgtgattcagttggtaatgcttctgctaaagctctttataaccaaatgcgtaaagaatttaactattacagtcaagaatctcgtatgactgattcccagttcaaatttgaaatgtggattcaagagctagatggctccaatagtgaaaacacttctaacctttttgaaggtactttgagtacttgggtatgtcaaggctgctttatcgaatctagtaactttggtgactgggattattcctcaagtgaagcacaagttatttctatgacaattcaaccagacggctgtgcaaaactcggtcctaatggtgaagcgttcggtgatgaaattactggtttcggtaacccatccactgctacctctattagtggtgcacaaaccaacattagtagtactactctaccagatagtaacttctacgaaaattaatttttcttttaaacgtaagcctcgaactagttcggggctttttttatgctaaataaagtataataccttataaaataaaagaggttgctatggcaaataacatgattaataaatatggcgttcctctaccatcaggacgtaaccgttcaatgttacaaccgaaagcaaaatacaaatttcgtgttattgtatataatttcggtactgatatagatgagcgtgatcacattgcattagatgttgataaagttgatagacctactgttactttcagtactcataaactatatcaatttacaacaaatacatcttacattggtagtcacgattgggacccaattactttaactatccgtgattcagttggtaatgcatcagcaaaagccttgtcaagacaattacagaaacaattagattttcaacgaagaattacttccagaactgaccatgattatggttcatataagttcggaattgtcattcagatgttgaatggtcgcaactctgatgatacactagaagacttgggaagaaacacattagttaatgcaacaactgccgctaccaacaatactggattagtcaacgctgttgatcagttcattggtggttcatcatacaatagtgctggcgttatggagtactttgtactaacaggatgtgttatacaaaatatatcatatgattcacttgactatagttcaagttctcctgttgaaatggttattacaataaaacctgataattgtatccaattcgataatatcgaagaaatgtacagtactagaataaattcacttttacctgaaaacgtaaaccaaggattagatatcattgaccgtgttttcggtagcattggattataaggagataacccatgagtgatttttttgattcatttgtcagtactgggactagtatagttaatggtgttattgacaatatcaacatcattagagaaccagcttttgagaattataacgctgcacaacgtgtgtttggtacagcaggtgaaatgggtttttcattctataatttaccaaaatttaagaacagttttattatcgaatttgtactaaccccgttcgcaaagaactttattaaaacccaactcccagatacacatactgattttgatgttaataatgtatcgtgctttgtaaaagatgtaacacttcctagtttttcttttagtgttgaaaccgtaaaccaatacaacaaaaaacgtttagttactggtgatattgtttataaacccagtaatgttgttttctatgatactgttgatggtgctggatatctcctaatggacgcatatcgtaagttctactatggtgacttctttgacaagaacccacaatcttaccgaaatgacgtactcagtacaccagaaaatttcaatggtttaggtggaaactggggtcgttctgtaatgaacaatggtaactacgacaaccagtactttttcaaatcaattaatatctatgaaattgataatgaaacctatacagttcataacatgataaatgtattcatcgaagatatacaattagaaactaaatctatggaaagtgaaggtgacccagcactattatctttgactatgcgttatgaagcgtgtaacaactttggtcctgaagggtacttgagtattggtgttcctacaatggaaattgcacaactcatcaccgatactgaaggtcttggtgtgagtggattctttaagtactttggtgaacttgatgacaaaactaaaggaatttcgacagttggtaaaattatccgagcaggaacatcagttagtgatataatcagtagtgctggtgatatccttcgtggtgacattactcctgataccatccgaaacataggttccgcagtgacaagaggtgcaaatgctattggtttaggaagcatcgtttcttctgcaagctcaaaattcggattaggtaacatattaggagatttttaaatggcatttaaccagcagtttaacccagcgaagattactaactccaaacaggctcaaggtatcttccctataaaaaatatacaaaagtataaaagtaataaccaacctatataccgtagttcttgggaaaaggatatcatgatatctttagacaacaaccctgcggttatagagtggagtgtagagccatttagtattccttacgtgaatccagttgataatgcagttcatcagtactggcctgatttttatgtactttatattggtgcagatggtaagcaacatgctcaagtactggaagttaaaccgtacaaacaatgtcacatggaaatggctaaatccaagaaagacaaaatcaccgttgcgattaaccaatcaaaatgggcatatgcaatggaattttgtaaaaataaccggattggaatttaaaatcattacagaaaggaatctatataaaaaatgaaacctaaacaacaagtagatgaagcactgggattacctagtgctaaacaatggatggaaatgacaggccaggagccagaagaagatacagagatggatttgtatcaggatgacgaagatgaacagagtgaaactgaaatttcattagaagaagcaaaagctgcaatggaaaaattgaaagctatgcgtgttcagttgcgtgaacttccagatattacagcaagaaaaactcaattagatcgtttagcacagatggcagaacgtaagtttgaagatattttcgaccgtgctttcaactgtgaagaccgttttgcagcagaaatgattaacgctgcaaactctatgttgaaaattgctctcgatgctcatgcaaaaatcattgattctgacgttaaattagtagatctccaactcaagaaagataagatggaaatcgaactaaaccttaaacctaagaaagttgagccagtcggtgacccaacagccatcgaaggccaagcggttgcacataaaacccgcaatgaaatgcttgcagcaatgaacagaaataaataacttaaacgaccttatggagttattaaaatgaatagattacaacaaatcctaacggataaaaaaccagtttttgaataccgagtcaagtttgcagttgaacctaccaatgagcaactaagtaaagtatcacaacgcctaatggatcgttatgatgcatttgatattggtgcactaaagaaaactattttcatggaaagaccactagatttttatgaattagattgtggtgaaatttggatgtttgatttcaaatgccaccgtggtgttcaatcaaacgtactaatgtatgaaattggcaacctactaagtatgactgaagcactaatccgtgtacgtagtaaagatgaaccacgtcaacaagaaatgaccgaactcgaagatgatattgactttgacgattacgaaccagtaattggtgttgattttggtaaaccagaagacagccacgatttagctggtgaagaacgtgctgtaaccgcagttaaagatgcgattgaagcagtaaaaagtgacaataaatactctcaatatatgagtgctggttttggtaaaaaggattgagacatgagtatacttaatgaaatgttagattataatgatgaagagctaaatgaagctcgtccatatagtcgttcacaaagtgcagtagatagtgcaaaaggaaaagtaaaaggctttttcggtagtggtcaagtagaacaaggtgcacaagaagttggtgcagaagcaaaccgtctttgggctgaatttaaacgctatgttggtcgcaaatacggtaaagcacagccatcagtaccatatgctgatgttgcacaattcttcaaaggaaataaccttgatataaaacacctgggaaataacagtcgtcgtacttttactcctaaagatgttggttctgctctattggcagcagcacgtgacttgatgaatgattatcgtgatgatgataaaggtgaagaacaacaacgtcctgcaccacaagctcaacctgacaatgctcaacaaccagcaccacaggaacagccaaaagcacaaggttctagtatccctgatgctctacaaaaattaagtccagagcagcgtgaacaacttttgcgtatgctttcttaaggagaatcaacacatggataattttttcagtactgaaactaccacagtacctaatggatatgtatatacttctcacactggtggcaaatatgtatttctagaaggtttctggtttaacgacaataatatgttaatggtagaccctaaaaaatacccatccatgtacgcaagtgctcgacaacagattgttgagcacaatctatcttctagtgaatataaaattggtaaaaaatatattcttgaaggtaaagagtgtacatttcttggtgaaaatcgtttcaattctaaagatggaattctactaactgaaagtgaaattatcactgaactaatggcagatgaccaccgtgtatataatgtttcaaaagaaactctacaaaaagaatggaactccctaaaattctatatccttccaccatatgctgatgatatttctattccagcaggtatggaagttagtggatttaaattcatccctaaaaatcaccgttttgttgatgcaaaatctggacgtccagttgacccagcaatgacccgtaaactttccgatgaaggtatgcgtattgctcgccaattagcaccaaaaaacaaactaattccaattaaatctactttagtacaaggcaatactcgttccgaatggaatggtaaagaattttgtgataatgatggtaatgttgtaattccagaacaaaatgcacatgtaatctttaatgcatatcagcaatttgttaaggctaaccctggtgattttccttcactaactggtgaacatgaatcgggtgaacaacgttttggttcaggtgaaaagccagaacaacctaaacaaccagtaaaacagccagtattcgcaacaaaagaatccattaatgaagcagatgaagagattgaagaaactgaatctgttgtggttccaaatggttaccgcattacttcaaataaaggtaaaacatacattaaacaaaaagatgcatggtttgatgtagaaactaaaaaacaactaaatgttagtgctgcaaaaagtgttgaacgtgctgctcaacgtgatataattcgccataacagttctggtgcaatgaaaatcggaactaaagtaaaatctaagaaaggcacagagtattcttatatcggtggtaaccgctttattagtgctgatggtaaattgattccaaaatcaactgctgataacattcttgctcgttatgatgcagaacgtgctgataagaaagaagaagaacctgaagagaaagtagatgctgaagtatcaagtactgatgtagttgagccaaaagctgaacctactaaagaaccagaacctgttgcagagccagaacctgaagttcctgctgctggggatgaagttcaatcattagcttcacgaattaaagaatcaccttacgctaagaaaattacagtactcttaacgcgtggtgatgaggtttctctaattgctgctgacattttactatctggtaaaaaggatgaaacagtgcaaattttaaaatcattaaataagaatgattgataactaaaaggatttatttaaaatggctaaaaaaattaatgaagcacaagttaaaatcgatatcgcaggtctagaatctgaagatctagaaacactatctcgtatgcttgcattagctggtcaagcagagcgtcaagcttctcctgctgctgctccagttccttctatggggtctatgaccccttctctaccaccaatcgctccactcgacatggattccattggtgcgggtgctgaagaagaagttggtggtacaatggatggtgcgattgatgcaccagttgaagacccattggaagtagctgctgactcactatctgctgaagctggtgattttggtggtgattctgaagaagtaagtatggatgcagagttcgaagagcctggtgttgcagatgaagaagagttttctttagatctttccggtcaacctcaactagaatcagttgaagaagaggaagaagaagaaatcatcgaagaagaattcgatttcagtcgtatgctatctctagctggtcttcaagacgaaccagaagatgaatattcagtagaaggtaacccagatactgaagttaaagttgaagaaaacactttcctaccagacctaaccatctctgaagatgaagaacaaggtgacagtactgattttggtccttacaacactgaagctgatgctgttcgtgacggtcaagctaaaactaatggtgtagaaggtgaccactttgttgttattaccaagggtaacaagttctactggagacgtgtcgttgatgaagatgttgacaatcgtcctgaaccagagtactatgacaatgacggtaacgagaaccgtgttcacaaatttgaacctaagtttccaggtactgctctaggtgacaacccactcaatgttaatgagagtgatgagtcagtggaaggtaacgaagaactagaagatgaaagcgatgaagaagtcgaagacattttcgaaagtctccagaagaaatatcaacaatttctaggggacaaataagatgggatataattatcgtgaattggttgaagcattagatgaaatcacttctagtgaagaatctactgaagaagaaagttttgcagttgagactccttctgatgctgttgctaccgatttacttaaagatatcaccgaatgccttatccacattgtggataaggttaaatcaggtgaagaccaaaaagaaatcgtagaaaagcttcaaaaagcgtgtgacattttatcggatgttcgatataatgatgaaagtactgaagaagttgatgaatccactgattgctgcttcggaaccaaagatatgggtccgaaaattggtaaagatggtgtccaagactataaagttaaagatgctccttcatatgcagcaagacagggtttcgtggggatgtaatttatgattcctgaaccacacaacagtactgaatttcaaaacgatgtacttttaaaagttagagaagtacatggatcagacgctgaattaacagaccgtatgcttctgatgtcaatttttgaaaatttcagaactggcggtggtttaagacttagcaagtttggatatacaatttgtaaagaaaacattctttatgaatttacaaaaatccccttgcaaagagagttcaaaagttctataatctttacatcgcttgataggatatgtacttcaccctactatgtagaagggcagtacatatacctctcggacgcaatgatagttacagagttaacattgtgtggtgatgattttagaatgttattttcgatgcacatgtagcttcgaaaataaagaaaaaaaatgttgacaacgccgaatgatgtgttataatgaccaccacgaagcaagttttcaaaatcacaagatgtgagattgaaaaagaaataaaaaagttgttgacaagcctgaacgatgtgatataatgaccacatcaagacggcaaagagaaatgcctttttaaatacacggatgattcatgaagtaacaaaggaactgataagttaaaaattcttttaacacagttcctttacttttgcccacggattggctataatagaaacctaaacgattttatccaacaaaaggaaaatatacatgtctactcaaaacaacgatatcctgaacgtaaaactgactcctaagaaagctaaagaagcaatggcactggctgacatgattcaagatagcctgatgatttggggtagccctggtatcggtaaatctgctatcgcacgtcaatacgctgatgagaactacccactgcgtaaagataacgtggcaaaaattgagttcatgaaacaacaaatcgaagctgatactgaaaatgctgatcaacttcgccgtgaactggcagcgtttgaagccaaactaatcgaccaagacactaactttatcgatttccgtttgtctcagattgaaccaagtgaccttcgtggtatcccagttccagagaaagtgttccttgatatggatggtaagcaactgattgaatctgaactggctagtgcacaagattacatcgctgaaacagcagttgtgtgggcagcacctaaagtactgaaactgtctccagattggaaaggtgttattctgtttgacgaaatcaactctgcaatgccgattgtacaggcagcgtcttatcagctaatcctcgaccgttgtgttggtgagatgaagctacctaagactgcactgattctcgcagcaggtaaccgtgaaactgatggcggtgtaacgttctctctagctacaccactacgtgaccgtatgacccacatcgaaatgattccttatcatcaagattggattaacgattatgcgattggcaagcgtttgaacccagcaactgtagcgttcatcaacaacactggtgctaaacacttcaacacccttagcccacaagatccttctcactgtggtggtacttctccacgttcatgggaagcagtagcacgctacgaagatctgaagaaagttaagaacattgataaagaagtgttccgtgcgatgattgcaggtcgtgttggtgaaggcgtagcaactgaatacatcgagtatgttgataacgtagctaaactaccagataccatgtccatcctacagggtgagattaaagagattgatgcttcgctcgatatttccgcgaactacttcatcactctgaatctggtttacaaaattatcgacctctacaatgagaagcaagaacaacgtctaccagtggaagattggggtaagctgtgcaacaacttcatcaccttcctagaccataacttctctgcaactcaagcagaacttgcagtactggcgattcgtaccatcacgcttcataaagtagcgattacgattaaagatgtaccagcgtttaaagacttcgttatgaagtactctgacctagtacgtaaagcacgctctcttggttaataattaaaaagagtgttgacaaggaggataccacatggtatccttcttttatcttaactaaacgaggaaatacaaatgtcagataaacgtttcagtgatgttactccggctctccagaaagaatgtcaagatcgtctgatcttagctcgcacatctttaatgctaacattcccattctttggtgtactggcttctcgtctgcgtccagttgcaaacaacacatggtgtcgtactttggctgtagatggtaagcatttattctacaacgtagaattcatcatgggtattcaggaccaatccaaaaagtcagcatacgaagaagcaattcgtgagaaacatcctgaagtaactgaagaacaacttaaagaaatgacagaaggtttgaccgatgaaaacctgattgcagttatctgtcatgagattcttcactgtgcatatgaccacttcttgcgtcgtggtatgcgtgacccgcagcgttataaccgtgctgctgactatgcaattaaccagattcttgttcgtgataaaattggcaaaatccaaagccaatggctgtacgataaaaagtacgatggtatgactgctgaagagatttataacattctcgaagaagaagataagcaggatcaagacggagaaggtgaaggaaatccacaggctggtagtggtgagggtgaaggtaaatcacgcgggacttttggtgatatcaaagatggtaaaggcaaaggtacaacaatcgaccagcatgacgttccacaagaaggtcaagaaggtggttcaagtgataaacaaaaacgtgattatatggatgatttcaaaacagcaatgatgaatgctgctcgtgcaggtggtactcctgctgaaatcgcacgtatgattaacaacttcaaagaacctaagattgactggcgttctaaacttcaccgcacgctacgtagctggttgaagtctgacgcaacttatcaaagtcctaatcgtcgttcatggggtgctggttttggtagtactggttcattctacgggaatccaatcttccctggtatgaaaccagatgatgatattgatattgcaattgcactagatgcatccggttctatctctgaagatatgctccgtgatttcatcagtgaagtactgggtatcactaagcagtttaaacaatttaaaatccgtatcatgacgttcgatactgaagtttatactgtgaaagattacaaaactggtgaagagagtaagattctcgaatatccagtgaaaggtggtggtggtactgactttgaagcagtatgggttcatatgaagcatgacaactataagcctaaacagcttattatgtttaccgatggtgagccgtggcagtcatggggtgatcctgattactgtaagacactgtttgttatccacagcaatcctaacaaacaagcaccatttggcgaaactgtacactacgaatatgaagctgacaaaaagcgtcaacgtagctaagtactaaataatgagaacggaattttccgttctctacttttccagcgggacagcttggaaaaaggtgatataattatatttgtaacaacatacatggagagtattaaaatggaacaagaaccagaaaaaattcaactaaccctaatcgacctaatcaacgctgctaaaatcatggaagctgctgtggctcgtaattcatttaaagtcgaagagcttgttgatgttgctcctgtcgtatctaagtttgttgagtttgctaactctgcactcgaagatatcaaagcacaagaagaagctgaagctgcacaagctgctgctgaacaaaataaaggagaataataatggctattcgtcacgttggtgtagtacgtaatacaggttcacgcgtatttgtggtatggcgttcactccctgatgatccagatcattgtctcattgtttatcgcgattcactgcctgaagcatatgctcaatctgttgcagatttagtaatgaatcaaggtcaatcaaatgtagatttgtgggaagttatgcataagattggtcatctagacggtcgcaaaatgctagatgtgcttcataatctacaacatttgcgtcgtgcacgtacttgtgatattgatatgcatgttggtggcaacaataagatttctcttgatgttctaaacaacgcaatcaatgataatgatgctaaaacacatgaagatggtaaagttaaagaatacaacccattcaagccacaagaagctgatacttctgttgaagaagctaccattgttgagcaactacttaaagatgcacaacgttatgagcagttggctaaagagcactttgaacgtgcttacaacttagaaccatctctacgtccacaagttcaagcaacacctgtagcacctgatagcaaaactttctatattgaaatcccagaaggaatttcacaaactaaagcaattgagaaagttaaacaggcatttgcagaacgtaaagcaaaataatataaatgaataaaatagaattagatgaagcaatcaatggtttatctaatgtatgtttcagtggcggggcagcaggtgctgaccgccttttttctatctatgcaaaagacaatggatttgaagtaataaatttttcattcaagggtcaccaaagcagcgtagatgaaaatactatattagaaattccacccaatatcctttgtgatagttcaatattaaaacaattaaacattgcatgttactctttacgccgtaaagttcctaagcctggttcgtatgtatataacttacttgcaaggaatagttaccaaatacttaatacaaaaagagtatattgtattgcaaatattacatcacctacgcaagtttcaggtggaactgcatgggccgtacagatgtatatggattcagttgacaatccagaaatatattgttatgatatgaacactcgctctgtattttattatgatacagtactgaaagagtttactgaaacattctcaataccagcaccacacggtaactggactgggattggttcacgtaatgctacacaaaaacacatggaacactttattacatttttcaaggacgtaaaatgaaacaactacaagaactatatcaaagaattctggatcaaggtgtcgaaagcgttgatcgtactggtgttggcactatcaagctaatcggacaacaaatgcgttttgacctaaaagaaggtttcccagcagtgactactaaacgtttggcttggaaagcaatgacttcagaattgttatggtttattgaaggttctcacgatgagcgtcgtctgtgtgaaattttacacgggacacgtgatgtagaaaagaaaacaatttggacagacaactaccttaatcaaggtgtaagccttgggtattctgatggtgagcttggcccagtttatggtaaacaatggcgtgaatgggaagattataaattcagttccagtactgaagaaattcaagaactaaaagataaagggtataaagttattgattatactggttcacatggtgttattatgcgtcgtgtaactgaccagctaaaacaagttattgaaggtatcaatactgatccatacggtcgtcgtcacattctaagtgcatggaacgttggtgagcttgatgctatgactttgccaccctgtcatagctttgtgcagttttgtgttgtacagggtaaactaagttgtattcttcatcaacgtagtgctgatctattccttggtgtaccatttaatattagtagttactcactactaactcatatgattgcacaaattacagggttagatgttggtgaatttatttggaatggtggcgactgccatatctatcaaaaccatattgaacaagtaaaagagcaactccaacgtgaaccacgtacattaccagaattatggctagatcctactattactgatattgaagatttcactatggattctttcaaattagttaattacgatccaatgccaacaatcaaagcaccaatggctgtataaaagaaaagggagacttatgtctcccttttttattatcttaatgtaaccagtgtacgtccggcaaatctcacatcaggagttgcaggaatactgaacactacgcttgttccattgaatgtaacactatcaacttcaacacgagtgtaaacaccagtacttacgagttcttgaatttcagcagttactatgttactagcagttactgttaatgtgtaatatgagccgtttaaaacccacgctgacgcagtaaacgggtcagtacgtacagaaccagaaccaattggaacccattgtccttggaccttctgcatcgatgtacgttcggtatttgagtatgcaatcataccatcaacaccaactgagttatcaattgtagccagtactggtaattgaataccatatcggttgaaacgagtacgaataacaccgttatcatatatacttacatcagcataacttcccatagtgaaacgtaagtctgcaccaagtagttttatatcactttggtttgtagtactttctaatgtgaatacaccattctctagtaagtttatgtttttgaatttgttattagttccattgaaattagtatttgcattataagtactaacaccattaactgtaatagtgtcaccagtagtgtcgcctagtgttgtattacctttaacaactaaattcccgctggcagtgatgttacctgcgtttaaatcaccagttagtgatgttgatccatctacaataatatttccatgaaaatgtgattcaccatttttaaattcaacttgaactttattcattgaacttaaagaaataatattactacttgcacttatccctacgtttgtgtttgatgcattatcaaaacgtattactggcgtagctgctggtgtagcggtagtttggaataatgttaatgttccattattaattctaacacgctcagttccggctgttgtaaaaccaattgcatcatctgctggatggaatataccagtattagcatcggaccacttagttgggtcattacctgggttgttcgttgggtcaaacggattattattaaatgtcaatgctggtgctgctgcactgccatacaccaccccaaaacgcccagagccgtctgttccatcattatacatggaatcgccagttctacgtaaacactcaatcacaacgttatctatggatgtttgaacggtccctgcgtttgttctaaattgacgatgatttgcaatcattacagtattgtcatataatactgaagcagcggaaatgcttgttcttgactgacgaagacgtatattcttatcttcagttataataatccaatcgccatctgaaagtgcagtttggttcattggaacaccagatgcaaatggtttggtcaagtcagtatctgttgctaaattttcaaggccatcatgaccagtactgggaatagatgcagtaataattctagcaaaagcgtatgttactagtttagcaccagatatatttggattagagtcaacataatataaaatttcaatccaattaccttgtccagttggatttgtaggtgtaaatgtaacaggacttgtttgtggattatttgcttcataatgtgcttgtgcggcatccattataccacgcacgacataataatcaccattaagcgatggtgatggtgctggtagtggagtttgtgctaaaggtggatcgatatcatctgggatgggattatatgtaccaacaaattgtaaaccactagttactgaatctggtaattgggaagtaagaagtttaccgttcgcatctaggtttgcaaaacgtcgatatgccattgaaccatcttcaaagtctagtacaccttcaaatgctttccatcctttattgtatctaatcatccctgatctaaccacatcagcggtttctttagtcggtgctttaggtaattctagaaatgcctgactatctataattacaccaccatcacctctaattcgatttatactcatttaaatatttcctcagaatagattatatattaagtatttattttagataaaagaaaaggccaaccatagttgacctttaaaaaatataaattaacgagtacgctcaggaatatcaataccttcatatacccatacagccgcctgttgtgctttataaattgcatcttcatcagcatcaggaactgcatcaatgtcagcacattgcttatcacactctgcaaatagggattcaaccatagcaaatgcttcagtgtatagttgagtcatttcagcagcagatagttttacaattgcgtcatcaaggaaaatagaaacactatcagcacctgaagttacttgagtgtaatagttaagaagcatttgacgaccagctagatcagtactataacgatgaccgttaaacatataaccagcattaatacggtcactacgagatgatactgtgcgtgctttcagatcagatttaactgatgcaatatccatatcaacataattataagttttcagtactgttaactctttatattcaccttctgcttcttctaagaatgtaatgactggttgattactatctagtagtttaatatattccaaattctcattaattgcgttcacgttaccaacattcttatattccaaccaccagaacccctcttctttacgaacagcgttattaggttcaatttcagaaccatctttacttgaaataccataaagtgcacgaatatcgctgtacaaataacgatatgtttgttcatcatctggagttgctccagggcgttcttttaaacccttaacaccaactgggttggagatgatgttacccaattcataattttctttagaactaccttttacatatgtaaacatataactacctcacttgttaagatggtgtcaccataattgatgacaccgttttttttattttaattattaagcagtacgttgtgcaatgaacaaatcagtaactgaacttacaccatcataaattacttggtaaatggtcacgctaccagcagttttgtttagttcaccatcaacaacagcataagtaccatcagttgtaaagtttctgttaccagttgtatcttgtttaacatagatgtatactgatgcagctttaccaccaccaattaggccagtaattggagccaacgtggtatcttggtctagagtgatgaagtatacgttacttgtaccatctggagtccatgttccggttggagcaattactgatgatgtaacctgagttgggattacatcatactttttggtagttactgttgtagtagttaagttagcattagtagtggttagttcaccagttactgttactgccttatcaaacacagcattttctttaaatgatgaagttgcattaacggttagaacgtcagccgctgcgtcacctaatgttacgttaccattcgcagttagtgctcctgttactgctagtgttccacctactgttgcgttaccagtaacggatgcacttgcaagtgtagccaaacctgatgttgtaattgtagaaacggttgttgcaccgaatccagcagtgccagttgcagagatatcaccacccactgttaggttaccagcagtaatacccactgtaccagtgatgtttgcaccacttgacatagttactgcaccaccaaatgaaccagtagtagtaacttctaaagtattacctttaagtaatccagttgcagtgatggaagtaccagcagtaattgcagtacctgcacttaatgtggttccagcagctacgttgttagttgcagtcaaagacttaacagctacatcggaatctgcttggttcaattgtgcatttagtacgccagtaacagtgaagttaccgttgtttacaacgttaccattaacgattaggttgttgttttgtgaaccgacttcaccaattgttgcagaacttgaaataattgccgcaccagcagtaatattaccagcagaagataaagaatcggatgctattactgcaaacggttctagtgtttgtccaccaacatcgatatctgcgttaataccaccttcaacacgtagtttaccagcaatataagtgtctggcataatctgtacagtttcaggctgctcacctaatggtgtaccaactgttagagttgcaccagttttaacagaacctagtgttgtttgaccaactacacctagtgtaccaccaacggttgcgttgttagttactgctagaccagttcctgaaccattcaaggttgcagatggagcagttactgcaccagaagttagtgttccaccaattgttgctaaaccagttacacctaatgttccaccaagggtagtattacctgtcgcatttaatgtttcagatagagttagtgttttagcagagatatctgcaccagttagatctaagctaccaggagttagtgttccaactacagttacatcgttaccaaatgtcgcagcaccagtaacgccaagagtagtactgaaagagccacttgttgcagatacaccagaagttacgatagaaccaagtgatgcttgaccagttactcctaatgtaccaccaatagttgcattattagttactgctagtgcagtaccagtaccgcttagggttgccgatggagcagttacttcaccagttacacctaatgttccacctactgttgtgttaccaccaaaggaagctgcaccatcagagtgaatagtttcagatactgacaaactcttagctgtaatgtcagcagttgttaggtctaaaccacctgctggtgtgaatacaccttcaacagttacatcgttgtcaaatgtagctgcaccagtaacatccaatgtagaactaaatgtaccagtactaccagatacagcaccggaaaccaatgaaccaacagttgttacaccagtaatattcgcaatacctgttacactcaatggaccagaagttaatgaaccagttacacctaatgttccaccaacggtcgcattgttagtaacacccaaactaccagcattcactgtgccagatgcagtaacatcagtagtacttacaccaccacttagtgtgcttagaccagttgcagtgatggttgaagcagttgcaagactattagcagaaatatctgcaccagttaggtcaataccaccttgtggaaccaattcaccttcaactgttagtttctgaacagtactatcaccagatacatttaaggatgcagcacttagtgcagctactgtactttgaccagttacatttaaagtggtgtttactgtagtgttgtttaaagttgtatcaccggatactaatatagcgttggtattgataccaccagcatcaacttgaataccaccagtgcttacagttactttcttgccgatatttacgatatcagttagggtagttgcaccagttactgaagcagtacctgcgactgaaaggtttccagatacggatgggctaccagttacaacaccagttgttagtactaggttaccaccaacggtagtatttccagaactagcaagggtaattgctgaaacattggaagaacttaaatcaattgaaccattaacaactaggtcaccaccaattgtagcaccttctgtagtacttagggatttagaactaatatcggtagtacttaggtcgatagcaccaggagtaacagtaccagatacggtcaaatcaccagtaatagaagcacttttcgcaatgtcaattgtatcattaacagaactaatattattaacatttaatataccattaatgtttgcattattgtcaacacgtaaaccttcaccaactccatttagtacaatacttgtagctgttacttcagtagcagatacttgttttagtgtacttgaaccagttgtttcaatagtatctgcacggacagcaccaatagttgcatcagtagtaattagttttggtagagtgctagaattcactgtatcagaaactgtaataacaccagcacttgtaattgtctctgcacttgcaagagatttcacagacacatcagcagcacttagatcaactgtacctgctaccacaagatcgccaccaattgtagcaccttcagttgtggttagagacttagaactaatatcagtagtacttaggtcaattgcaccaggggtcaatgtcccagatacgtccaaattaccagtgattgtagtgttattgttaattgctacaccatcagcattgctgattgacgcagtttcaacagatgcaccttttaatacgccagtagcggtaatgttagttgcagaagtaatagcaccagaagcgttaacaccagctagagttgatgtaccagttacatttagtgtggtagcatttgcagtggttgcagttactgtggtaatattagcttcagtactggaaagtttaggtagaacactacttactgtaccttcagaactaataactgcaccagtactggttagagatttaacagcaacgtcagcagcacttagatcaactgtacctgcaacaactaggtcaccaccaatgttagcaccttcagtagttgttagagacttagcatcaatatcagtagtgcttaggtcaattgcaccaggggtaacagttccagtcacagatagattacctgcaattgaagtgttgtttgttattgacacaccagcagtgttgctaatgattgcagtttcaacagaagatgcctttagagcaccagtttcaacgctaccagatttagaaagaccagttactacagatgatgcaccagaaatttcaccagttgctgtaatagtagagccagaaattgcagtacctgcaattgcaccagtactattgattgaagttgctgtaacaccagcaagagttgattcaccagcaacagatagagttgttgtaacatcaactttgtttggagcaatatcaagaccgtcaacgtcagcgattgcagttacaccagttgaagttccagttactaccaagtctttaacagtgattgtttgaccagttacggttacatcaccactgaaagtaccagctacagcagataaatcaccactaaaggttgcgttatcaccactaacatccccagtaaaggttgcacttgtaccggatacgctatcactgaagatacctttagaaccactaacatcaccactgaaagtaccagaggcagcagataatgcaccagtaacagttgcagcaccaccaacttgtagagatgaacctacagttgtttgaccaactgattcaagagtttgacctttgattgcttcagcagcaactactgatttaggagttagatcttgtccactcacatcaacagttaggccagttacagtacctgtaaattcaacatcattaagaattgctttaccaccaacttgaagttgtggagttgcagggttttgtgttgcgttaccagtaattgttagataatctaatttgtttagaccattaccagtaataccataggtagatagtgcagcagaaccgaaggttgcagtttgtagaacgttcaacttagcaggagacattagttcagattgaacttcgtttgctaacaagactgttggacgtgcactaggtgcagtatatgcaaaacctagcttaacgttagcatcagcggtattttgacccaaattgattgctttgaatgttgcagtacttgcaagaccagtgatgtttgcacccaatgtaactgcaccagttagtgctgaagcaccggatactgataatgttgttgcttggatatcatctaaatcaaaactaccaccaatagtaccagatacgttgatgttgttaaagtttgcagtaccagagctttcgatattaggaatagttgcaacaccagttacttctaaatcaacaactttagttttacctttagttacttcaagtaaaggagtagttggtgattgaatttcgttaccggaaatagttacataatctaatttgtttaaaccattacctgtaataccgtaagttgaaagtgaagaatcaccaaatgttgcagtttgtagaacattcaacttagctggtgacattagttcggattgaacttcgttctgtagaagaacggttggtcgttgtcctggaacggtgtaaccaaagtttagtctatatgcttgacctgcttcattaggcccgatacgaatatcacggaagtttgcagtacttgcaagaccagtgatatttgcacccaatgtaactgcaccagttagtgcagaagcaccagtcacattaagtgttgtggcattaatatcagaaagattaaaagtaccaccaagtgtgccagaaatatttacatctttaaaagtagctgtgccagttgaagtaatatcagttgattcaacagaatcaaatgatcctgaattagcttctaagttatcaaattttgcagttgtgccgtcagcagcagtaatgtttcctgcaaatgtcgcagcacctgaaacatcagcaccaccggataaggttgccttaccagcaacatccaatgcacctgtgacattcacagaaccagcggtgagtgcagtgaatgttgcgttagcaaaagacacttctccattaaccgttaggtcattactgaatactgcattacctttgaccaaaagatccttacttaccgtggaattaccagatacatcaagatccgttttaatcgagtacatagagtcccctcctataacgatgaactatatattcataacccatcttttgttaatatacttatatttagtttaattcacaaaaacactattatctaatacaaaagaaaaagccaactaaaaaagttggctttaattattaatttaaaatgttatacacgttgagcaacgaaggtatcaaacacagtactgaaaccatcatagattacttggataatacttgtttgaccaactacagcacttactgtaccagaaactacagagtatgcaccaccgaaggtgaaagtcgtatcagccacagttggagttacatagatatacactgaacatgcttgaccactaccaattagacccgcgatagaatccattgtaacactttggtcaagagttaagcgatatacgttagtagtaccatctggtgtccaagtgccacctacagcagcagtagaagcagtaacactagcagggataacagaatatttcttagttaccacgttgtttgtagtgaagtttgcagtggtggtgttaatagaaccagtcactgttaggttcttatcaaatgttgcgttctctttaaatgtagatgttgcatttacagttaaagtatcagcagcagcatcaccaatcacagtgttaccatttgcagttaatgtaccacctacagttagatcaccagttacagatgcacttgccattgtaacagcaccagttgtagtaatggttgttgcagttagtgcttggaagcttgattcttctgttgcaattactgaaccatcaacatgcatgtcaccacctgaaacatcagcaccacctagtaggcttactttaccaccgaacgaaccagtagtcgtgataacaagagagttaccattcaatgcaccagttgcagtgatagaagtaccagcagtaattgaagtaccagccgctacgttgttagttgcagtcaaagacttaacagctacatcggaatctgcttggttcaattgtgcatttagtaccccagtaacggtgaagtcaccattagttactacgttaccattaacagttaggttgttgttttgtgaaccaacatcaccaattgttgcagctttagaaacgatggttgcaccagaagtaatgttaccaacagcagatagtgttgcagcagcttcaattgcatatggttctagtgtttgaccacttacgtcgatttcagcgttaataccaccgattacacgcaatttaccagcaatgtaagtatctggcataatctgtacagtttctggttgttcaccaactggagtacccacagttagggttgcacctgttttcactgcaccagtagctgttagagaagatacagtagttgctccagtaacgtctagagttccagttacacccaaattaccaccaactgatgcgtttgcagtagaagttaaacttccaacagttgctagaccagatgcagtaacagttgaagtactaacaccaccacttagagtacttaggccagttgcattaatagttgatgcagtagttaggctattagcagtaatgtctgcaccgcttaggtcaataccaccttgtgggatcaattcaccttgtacagttagtttctgaacagtactgtcaccagaaacggttagagatgttgcagatacatccgctagagttgaagcaccagtaacacctagagttccagtaatggaagttcctgctagtgtggttgtaccagaaacgttaatttcgttagtattgataccaccagcaaccacctgaataccaccagtactcactgttactttcttaccgatattaacaatatcagttaggttaacagcaccagttacaccaagagttccaccgattgttgtattacctgagatagctgggctaccagtcacaacaccagttgttagtactagatcagttccaacagtagtagaaccagtacttgctagacttgcagctacaaggttagttgcacttaagtcgaatgcaccatctacagttaggtcaccagcaatgtgtgcgttacctagtgaatcaagagatttaacggttacatcagtagtgcttaggtcgattgaaccagcagttagtgtaccagatacagctaaatcaccagtgattgcagtattttttgcaatattaagagaagcagcagttgttgttaaagaaccaacagttgcaatgccaccaacagataatgcaccaccaacgtttgcatcattatcaacttgaagaccaaggccaccagcagacaattcagcactagtagcagttacttgagttgctgatacactttgtagtacactgttgccagttgcattaatagtacctgcatttactgtaaagagtgttgcatcagttgaagtaattttagggaacgaactagtattggttgaatcggtaacggtaatcacaccagcacttgtaattgtctctgcacttacaagagatttaactgatacatcagcagcacttaggtcaaaagtaccatcaactactaagtttccaccaacattaacatcagcagtagtagttagtgagtttgaagtaatatcaacagttgttaggtcaagaccaccttcaggtttgaatacaccagtgacagttagatcttttgccgcgacaacattacttgctagatttagtgtaccagcaccagcagcttcagcttgtaaagttggaactgttacagaagttgtgattgttgcagtaccagaagacaaacgcgaaccagatactacaccagtactagttagtgttcctactttcgctgcaccagtagtagttagagtaccacctgaaacgtcaccagtagcgacaacagaagatgcattaattacaccaaatgtacttgggttagttgcactaactgattttgttactacatcagcagcagacaaatcaatagcaccagttactgcaagagaaccaccaacagttacgttaccagtagttgttaaagaagcagcacttacatcagtagtgcttaaatctatactactcggagttagtgttccagtaatagttacgttattagcaaaagtagtgtcaccagtaatactcggaacagttagtgaagccatagaaccagcaccagttactgcaagagaaccaccagatagtgcaccagccgcagttactgtattaccagatacagacgcaccagtaacatcaccagtactggttactgaactagcagttaggccagctaaagtagtgtccccagcaacagatagtgttgttgtaacatcaactttatttggggcgatatcaagaccatcaacatcagcttgggcagttacaccagtagttgtaccagttactactaaatcacgtacagttacagtttgaccagtaacgctaacatcaccactgaaagtacctttagcagcacttacatcaccagtgaaggtagcagcagtaccagttagtgcaccaacaacattagcagttccaccaacttgtaggttagttcctacggtggtttgaccaactgattcaagggtttgacctttgattgcttcagcagcaactactgatttaggagttagatcttgtccactcacatcaacagttagaccagttacagtaccagtgaattcaacatcatttagtactgatttaccagctacttgtagttgtggtgttgccggactttgtgtaccattaccagtaatagatagataatctagtttgtttagaccgttacctgtgataccataggttgcaagagatgcatcaccaaaggtagcagttttttgtacatttagtactgctggagatactagttcagactgaatttcattttgtagaattacagttggacgagcaccaggggcagaataagcaaaaccatacttaacgttagcatcggctgcgttttgtcctaaacttactgctttaaaattagcagtactattagcaccggaaatatcagcacctaaagttacaccaccaactaggctagttaaaccggatacagttagtgtgtttgcttcaatatcatcaagactgaaagtaccaccgagtgtaccagatacgttgatgttattaaaattagcagtaccagtactttcaatgttaggaatagttgcagttcctgttacttcgaaatcatgaactttagttttacctgaagttacttgtaatagtggagttgttggatcttgaacagagttaccagatactgttaggtaatctagtttgtttagaccattaccagtaataccaaaagtggataatgacgaatcaccaaaagatgcagttttcaatacacttagggtagctggagacatcaattctgattggatttcgttctgtagaattacagttggacgaagacttggagcagaatagttaaagctcaaacggtagttagtgtttgcagcattagaaccaattttaatatcacggaagtttgcactactattcacaccagtaatgttggaacctaatgtaacaccaccttgtagactggttaaaccagaaacagttagagttgttgcattaacatcagatagactaaatgttccacctagtgtaccggaaatattcacatctttaaagtttgcagttccagttgatgtgatatcagtagttgcagtgtttgtgaatgttgcatcagttgcagttattttgtcaaatgctgcggtagtgccagtttcagcagtaatattacctttaaatgaagaagttccaagaacatccattgatgccacttgggtatcttttagtacagcagtgccagcggtttgtgttaggttacctgccattgatactgggctttggaattgtgcattagaattaatcgttgcagtatcagaaccaacaggcaaattaccaattacggaattaccatgaacttcaattccaccattcaatgatgctttaccagcaacatctagtgtagatgaaatgtctacagttcctgcttcaattgcagtgaatacagcgtcagcaaaagttacagttccattaactgttagatttttattgaatactgcatcacctttcacaagaagatctttaccaaccgttgcaccaccagttatatctagatctgttttaatcgagtacatttagttccctccaaataggcaaaaagcataaaatacatttgaccttgttaatatacatatatttagttattgatataaaaaatccagactcgatggaacgccgtctggattattttttttatttacctgaaattactattttaccactaaacgcttcatcagaagtgaatgtaacattaccacttgcatcaatttgagtttcggttattaccagttcaaatggtgatgctgctgtactgcctggtgttttatttgaatatatagaaatatacaaattgtcaggtgtttggttatgttctgacgctggaacagtaatggtgtaatcatcaccagatgctacccaatctgctatattaattaatttactataaggtactgtcattgttgttgctcctatgatgttgactttgacacttgtataatcagtgatttgaccaataacatcaatcgtaatgtcaccaataccactcacagtgacgttagtttggaatacagtgtcaagtgggatgttaccaggatcaccctgtagctgaaccataatatctggtccacgaccatgtactgattcaggtaaagaataagtatattgatctgttgttccaggaactaatgtaaatgccgatacaggaacgatttcagtagtgacgtaagaactatcagtacctggagttgtgctttggagaggcttccaaacaccaaggtctttaatatagatctgaataatattagtactgtcaactaagaagtaagcgtcaccatctacaccgattgattcagatggtgcaatagttccacgtaaaataccggaaccaccaccaccaccgctatgtgtattcaaataacccaatgtaaccaagtgtgtatttgcggttgggtcacctgctgaaacaggaagaagttgtgtacccgtgtagttctggatttgaacaacattaccattagtggcaatttgtgcaccatttttaccaagtatgaaggtcttcttcatggttccttctaaattagaaaaaactgccatttttataatctcctttaagatagggtgatatatgttattggttgagcagctttcaataatgcccctgctgcggtagcagtaacaatcggatcggcaatatcgatacgatacgcattattaacaacataaactgctctagtgatatatgtttttaaatcttcgccattttcccctgctcctgtgattaggatttcggttccagcagctttagcatattgattatcaccccatgatacacccaatgcttcgatataagtttgtcctgcaactgtttgtctaattgtgtcatatcgaccaaagaaagaaccacctactgtaacaataaattttccacctgattgtttatggataattgttcctgctgggaaatatctcccaccaggaaaaacatcataaggcacgtaatactgttcaactacaggtattactacaggtccacgatgacccgttccatcaattgcagtggttactttaaagttattagatgattggtcaatacggtcaacatacattcttgagaaactatattttgatatgttacaatcatcttgaacaacacaattagtccagttggtatatgtatatttagagcgagtatataagccccctccttcaccttcagttgcaaggtgttgtccaataacatcaagttctttagtactgatattattaaacttggaagatgacggcaatccacgccattgaattctactacatgtaatattagaaagttcagtagtatttagccaattatcagagcctgaagtatacacaataatagacgactcaggaatgtggagattacataatttaaagtttcgtggaggaccagcaaatttaccagatgttacgccccagttaatagaaaccatacggttagttactgatggatcatttaatagatgcccagataggccatcaataataaaatcaacagaaccataagtaattactccagcggttgtcaaaccagtaccaattgataccaacgttgatggataaacttcattattgagaattttaaagtctttacccaactcaacgtgaatacattgacggacattgtacaagcggttattttttataacgaatttttttacatattgtgaatcatcagcattcacatcataaggaccagaacctgcaacaccgataccaataccccagtttgaaagaggaattggtgcatttgtaccatctacgttttcaatcaagttaccttctattacaaatccgtctgggtaatgtgagttgactacgttcaattcaattgcatcaccatatatatcatggatgtggttgtatgaataacgcccaacggtcattttctcaccagtgccttgctgaagaacaccgtacttacattgtgtcatttcattaaagcagaagtcgatagtacctgattcagtcataccttgcattagaaatgcagcagtacttgtaatattaataaatttattaaaataaaatttaccattaccaccaaagaattttaaataacatcctgttaatgttgcttgttggattgtactattcagtaccgataccattgtgccaccgttaccagtgattgtaccaccaaaccattgaatatcattcaaataaacagcagttctgatacgataattaccaccagcttgaatttggatttggtgttctttagcataaactgcacatgcgttaaccgccgccgtgtcatcagtgatgccatcaccttttgcaccaaactcttctggagttatgtaaaactgtgcctgttgaagtgttcctccagtaataagtccgatataatcagcaccgttaacactggaaaggacatttttattaatgtataatgattttacccaaacatcatttgtttttgcaaagatatcaacaataccctcagaatcaacttgaaaataagtgttgttatttttaccaatgtcatttgttggtggaagtacgccaaataaagcatttgggttatcttcaagatacctaacgtttactgcggaatcatcgtcattaggagttcccaccttaacaggtaggaacgtttcgcctaaaaagtctttgattgcgacagaatcgtttacaaaattaatagaagcaccacgtttacccaacttgaatgttggcatcatggtcccttctaaattggaaaaaactgccatttatcaaccctcttttaaatgttatcttgaataggctgaataggtgcttgccatgataaagtacaaacgatcttcatttcaccaaatgaactgttgtttacggaatcattgaatacacaagaaatgatttcatctttacttgatacttcgtggttggtttcgttaacaatgtaacgcattttgcggttgatatcgaaataatcaacaggtgcaattacagtaccgccaatatcttcttgtgcttcaccaccgaaacgtacaaacatttcatttactggttcatcatatgcttggttaatgtcaacttcgatattagttactagatatccagcagggcatgtaccaataactaacaatgcgttagtccatgaatgatcaatagtgttgatgataacaactgtgtctttaccaggttcaccctgaataccttgttcaccttgcttaccttcttcaccgtcttttccacggaataagataccagcactccactctttagttggggttgatgatgtagttacgatatcgacataatacaaattaccatctgtcgtgttatagaagcaataatcttgtggtagattatcaatgcttgggaattgactaccagtactatcaatatggaaacgaccacgtagaccctgttcaccacggaaaggaacaccatcactccatgttgcagttacgctttgatagaaatataatttaccatcttcagtattatagaaggtatagttattgacgaggccagttgttggaaacaccgtaccagaactgtcaatgtggaatggcttaccagcttcaccagtatcacctttaccaaactctacacggttccaagtactaattgtttcttgtgcatcgtttgatttaaaatataaagtactagtgccgtttgcaagactaagataacaccaccctagttcttcaccaacacggaagagttcattaggaacttcaaaacctatctcatttggataaaagtttctaccgttagcaccattttgtccaaccactagacctaagtcttggattgtattgtcggaataggttacaattaaatgtccagcagagttaataactaaacttttgatgccagaattattacatgaaccacctgacccattgttgaatgaaattgtcataatatttcccttgtatgagttaatgtcatataccaatatttatcagtacaaaatacatttcgttgccattaataaataaatgaaagttcactactaaaagggcttaacaatggcattaagatcaaaagacttcctcttcaaaagaaaaactaaagatggttcatggcaagaatttcctgaatcagatagctggtatcctgctaacttagattatcattggaacgaacaaacattaccattagctagtggcggctattatggtagtactacaggattacatacaatatcctttaccctacgtaacttcattggtagaatttacgtactcgctacactggcaagtaatccatcggacgatgattggttcccaattaaatttaccgaaagctgcaacttctatcttgaatttactgataatgtcattcttaacccaaatggtggtgaccttattagagaacaaggtacaactggtacattcgctgaaaccttaaccggaaactttacctatttgaaagttggtattgaccgtgattacattagcaagtatccatctgatgtacaaaaaagtttagctggtaagttagaacaaattttaattaactactaaggattagaaatgaaattagaaacagaacaaccaaaactatttgttaagggtcatgtactaattactgacgttactgatccatctaaccaaaaaatcgttttggataaatcaaacgcaattcaccctgaaaatatgagtactgctattgctaatgcgttggcttataatcaagatagtactggtattcctattggatctattagtgaaatgcgttttggtaatggtggaacagtagttttgagtactggtcgtatcacatacaagaaaccacgcgttacttctttcggtggtctatattctcagacttatctgaaaaaaatcaacccacgtatctctgctggtattgattcacaatataacaacattacaactgttcacattccaggccaagcttacactgatatcgtctgtatttgtacattaggtttaggtgagccatctgaccaaggtgttagctctggtactagcatggatgggacatatgtatttgacgaattgggtttatatacaaatggtgatagcggtattccacttacccatattatttttcacccagttgagaaaagtgctaaccgtgttttgcaaatcaaatacacagttcgtgtccaactacaataataaggtgatgatatgagtgtaagttatacaatttatagaagtaatggtagcgtttatgctaccattccaaataacgtaatattaggaccaaaccaacctggtagtaacccagtaccgttaaactttgcaggtcgaaataaagttggttacggtcaagcatggaacgaaaacttcctccacttggttgagaacttcagtggggctactgcacctcgtggtaacgttaatggtcagatttggtacagaaatactggcaacactggcgaactacttcttgcattagttgataatgctcgtcaaccagtagatactgcatctgaagctgactgggcatctatcccaatgatttcaattttcaacacagtaccagatggcgaaaatagtattatgggtcgtatggttcttaccagtaatggtgattcccttcgtgtcctaatgaaaaataaagaatggcgtgaaattcaaacatctcgtccagaaaataaagagtactccacactacttgatatcaactatgatacaggtaagaaatatattgaatttacacaaagtaacagtactaaaccattggcttacttcaatatgggtggtacttcacaggtcgattcaaataactggacaacattcacaaatggtactggtgtgtttgaatttggtagtaactatttttatgaattgaaaattatgattcgtgaagttagtgattcaacaggtgaaattgtttctcttccatataattcaaaaacatttttcatcaaaggtcagttctatgttgataaccaaggtacatttgttcctggttcaattggtgcaagtcagattccagatccacgtcgcattacacaactagaatcaatcaaggatgtaattacaagtagtcgtccgaattgggatgtttctatggtaattaatggtgttgacccaactctcccaaatccgaatggtattacaaaagcggattacgaaaactgggtggttaactctcttaactctaataaaaacttagggttccgcgtcgatggtatagtaaacaacctttcggcaggtgagtcagttaagcttcaagcatctgttctacttaatataacaggtatcccactaattggggtataaaaagaaaaaaggagccattggctccttttttttattaatatcgatatggtaagctgttgacaaactgtgtaccttgtcgtatactttcccacaatgaatagaaatccttcattaaatttgtgttaagtaatgtgttttttgcaccaggatgtaatggtttgggccatgagccaatcttaacccatgcataacctgaactctcatgatttaaagtaggtacgaattcattttcaactacaatgacaaatgaatagtatttaaatttaccattcttagtgcagaacacatcaaatggtataatatctattatcgttggaatagaatcacctagttcttctttaatctcacgcataagaccctgtaacggagtttcattatactcaagcttcccaccaacaaatgcccagttgttagaatacgtacttctttctgatctcaagtttaacatcatgtgtccagtacttttagataaaaatatagcacctactgcttcattcataacaacacctccttatttgtcagtgaaagttattttccaatacccctgacgatatactgacataatactcttatgccatttgaatttgtcattatatctataatatccactatcttccatattataaacatagttgtgtactagtgatggctcaataagttctgctccatcattggtaattttaaacaaatagttcgctgggatttcagtctctttgtaaatgatgttatgtatgctattatttacataatattgttcaggtagtgcgttatataacaaagagcttttactaatgaatccatgtattgtataatcaacagtataattactattatcaagctgaactacaatcttgttagcatcagccccttctccaaatgaagagatatgtccttttagtgggttatcctcttctatagcttgttggaatttaatacctacagtcttgtcttcatattctgggtccaagtacttaaggtatttttcccatgaataaatcccaccatttggtgatgtttctgatagtgattgactaacaagagtaagttggtaagtatctggtatattaagttcagagtttgttatttcatccactttaatacataagttctttggtgtgaacacatcagtaatgatatcggagtaattaccaatttcaaaatcaagttcatcacgagcacctttaatattggtggtgatttgttggataagttttggtttctcaacaatagctggcaaagagaaccaaattgtggtttcaaatgtcaataccattatatccaaatcgctatcggttccttgtgggaaaccacgagtagtaaattgacagtcaatcaactccacatcactcaatgatgtccaatccaatgggttctcggagagttgtaattgaatactaggagcaaacaatgttgaaatttgctcaaatagttccattttagtttgtgtttgtgtaacccaaatattaacatcaaacgtaaatgtccaaggtactgggttatgacgagttactttatactgtttatctaagtctttagtatattcgttaattccaggggacttgttagtacccataactaatgtttcatttgcgtttgaacgaactgacttgcgatctagtttaagttggtttacactaatggtcatgattggtgctgttggaagcacgttctcactgttaccattaataattgctgctgccatacgtgaaatatctgcatagcgacaaggaactttcttatattttggttttccgtcagcatcaacaccattttgtacttgaaattcaccaaacactctgataagatgtttcagtactcgacgaaattgaccatcataataataatctattttcattctgaatccttatgtatacgatacgctgtattaggtttaactgcatcatgtaatggtacacggttcgggctattaacaaattctgttagagcaagatctgcaccttcccacggttttctaccaccgtaatcgaaaatcacccaagaattcttggacgcactgtattcccatagggttactggtgtataatcggtacgatagtagtaatcaccatcaactgcatcacttgggaacatattaccttcaggaactgtacctcgtgctggaggaatcttaggacgataatcttgttgtgaatcgatatttccataaacactattagaagtgaatgggtcattaacgtaagttacttctggttctccccatttaccatttaagtactgataaatgtgtggttctttgtattcaatataaaaatcatcaaccccttgtggtggtgtgctttctgtagtacactcaacatcacaatttagccactttttggcagatttatcgtattgatacaatgagaagccagtaacatcagcctcgttttctttaaagaagaagtcaccatccatcggtttgcgaggaaagatggttccacgcttgacttccacagaaatccatgtatcattagatagttctttcagtactgggtaagttttcttgaggaaatacattttatttgctggttcctctggtaattcgtatccatttagcatatacttagacaaatcaacagtatctggtctgtcatcgaacaagtgttcgttagtaaaatgaatgtatggtacttcatcatcagcttgcataatgatacggttcataatatccatttcattaccatagctgctgttctctgaagagccatcatcagtattaccattgccgttgtttggatcatctgggtcatcagggtagttattgttacctagaaggtcagagtactctggtgaatcagtaagaggtttaacacggagtttgtaaatgtgatgttgccatgtaactgagtaaccttctgacgttctaaacccatcttgtactacatagaagcggtttaaaccagaatctttaccaagtacatcaaaatcacgtaagttaggaagttcgattacgtcacctggcataatttttcttcccaaacgctgaatcattgtgttataatgaattgtgatgtccattgtgttaaaattgaagaacaatcctgggattttcaagtcaggtgttgcttcttggacttggtagacgcaacttaaggtgatagcttcgagattatagttacggtttggagtgtcaccaaaaattaaatcaccaatgcttgacacaacggtactatctgatccataataatcaccgccgtaggataaatcagtgttttcagcgacttgttttggtccgacataggcataaagccacatgtcaacaccaccgatgttgtattgttctgctatggcagagtcaatgaacttgtaatcattggttctaccttttttccacattctgtatgccatgtttgtctccaaaataaatcgggtatatctttatttaccttgttgacaaactcaaagaatgtgatataatgtttattaattagagtgactactcatttaggagaatacatgaatcttacccaattgttcaaaaaaagcgacgaactggcaacttctctgggccataccttcttgactattgaccatctaagtgctacagtactgacaatcgatagcatcaaagcagtatttgaagatatgaacatcgatgcagacaacctacacggtcgtttgattgcatatctgaagaatacaacattcccacatgcacctaaaagtgctgatggtgatgaagcgaaccgcacatcacttcttgtgaaccgtgtagttcaggaactttctaagaaatcagtaattgagcaacttaaacgtgatgatttctcaattgatgcttattttgtactgtttgagtgtttgtccttcccaaatactgcactagaagcagcattgcgtgaagagggtatcacttgtactgaagcagcacgaactctacagaagcacgtagaagcaatcgacaacggaattaaccttcaaagcattagtgatgaaccaactggggagaaaaaagtggcacagcagcaaccatcgtccaaacaaaaaggtttagaagattacaccactaacctaaccgcacttgcaaaagaaggtaaacttgacccaatgattggtcgccagaaagagctttctgcactgattgaaactcttgcacgtaagactaagaagaatgctattctgactggtgaagctggtgttggtaaaacgcaaatcattgatggtctagcacaggcaatcgctgatggtgaagtaccagagcatcttaaagatgttgaaattctgtctctgaacgtaggtgcactgactgctggtactaagtaccgtggtgagttcgaagaacgtatcgataacctactaaaagaactgaagaaacgtgaaaacactattgtgttcatcgatgaaatccatattatggttggtgctggttcagcaagcaacggttctatggatatgagcaacatgctcaaacctgcattatctcgtggtgagattcgtgtaatcggtgcaaccacttacgatgaatatcgtaaaaacatcgaaaaagatagtgcactaactcgccgtttcatgaaaattgatgtagttgagccaacaattgatgaaacccgtgcgattgtgaatggtttgaaatctacttatgaaactttccataatgtagagttcagtactgaagcaatggatgcagttattacactaagtgataagttcctgaagaacaagcacttccctgacaaagcaatcgacctaatggatgcggcagcagcgaaagtacgttctcgtgaaactgatgataacatcatcactgttgcactgattcaagaagttgttgcaggtatcgcaaacctagatattaacgtggttgcttgcactgaaagtgaacgtatgcgtaatctaccagatgcactccgttctcgtgtatacggtcaagaagaagcagtacagaaactggttgataacgtgatggtagctcgtgctggtctgcgtgataaatcaagtgttcaaggtgcattcatgtttgttgggccatctggtactggtaaaactgaaattaccaaagcactggctgatgcaactggttctgaactgattcgtttcgatatgtccgagttttcacaggaacatactgttgctaaactgattggttcacctccaggctatgttggtcacgattctggtaacggtctgctactcgacaagattgagcagttcccgaatgcagtactgttgcttgatgaaatcgaaaaagctgatcgtaaagtactactaaccttcctacaggttctggacgaaggacgtttgactggttcacaaggtaaaactgtttacttcaataacgtaactgttattatgacaactaaccttggtgcagcagattcaaccaagcgtagtattgggatgagcggtagtgatacagcacaagataaagcgattaaagcattcttgccacctgaattcatcaaccgtatcgatagtattgtgacattcaaagacctaagcagcgaagcgattgacagcatcattgataagttcatgggaagtttgaatgaacaaatcaaagaccgcaaagttaaagtttcactgaccaaagcggcacgtgagtggttggcaacaaatggtgttaaagttgggatgggtgcacgtccaatgaaacgcactattgagcaaaacatccgtgtcccactagctaaagagatgttgtgtggttctctggttaatggtggtaacgtaacgtttgatgtgattgatggtaaattggctatcaaacctaaacgaactaaagcagtagaaaaagttattgcgtaaaaaagaaaaggagagcaaatgctctcctttttgttatttaacttctaatagatttttaatgtcattaccacttatttgcaaactattggagtaaacagatagttcgattggataactgttaacactataacgttttagtaaattaactttacctaagttcaagccattaaatgaatatgtcacattctctttaaagtcgtgttctgcactatacattaccccacggagtaagttatttgcaaatcgtacttcaactttttcaaaaccaagagaaataatatcattcatacttgcaccagcaccagatagaacattattagtaacactatatggactaactgaatctggttgtgaaacataagtagcattttcttcactgatagcagtaatgttagttactgttccaccaactacaccaatatatgtatcactaactagtggatatgcatattcccataccccttcagtattcagtactggttgaataataccaacatcatactcgaacacgttaatttccacactatcagtcattttggttctcactaactcactaagaacacctgcaccagtaattggtaagttatatccgttatcaatggtaacaccatcaacttcaaatatctcgttagacactacccaaacatcaacgtcatctggtgtaattccatcattataagaaccaccgtatagtgttgtgtcgtagaatacttcatagttcattgcgtcgatagcataatttctatttgtttcatacaacttaacaccatcaaccaagaattctggatcagcaaaggttctaatacgaacgatgttcaatgctagaggtattgctggttcattctgttgttgtttagtgatgttatcataacgaagtacaactccagtactatctagtagttctacagttccgttcgcagtgtttcttactgtgtacaaggttggtgtggtgtcagttttgatttttgatacactcaagatggtttcccatgcattgttttggtatctcacataatcttcaccatcagttgtgaatatcataaccttatcaccatcagatagggtattgtcaattacttcagcttctgtatcactaacaattgatttaattttatagaagtatttttcatcatacttactgtatgatttactaatatcattttcaatcttagcgtaagaaggaatactaacaattgcttctgttgttttataagggttgataataaccatgccttcagttttatatctactattgtctctcaattgaactagtgaaacactattgaatccataaccatcaactgtgaagcgaatctgaccaatctttcttcctgatgggttaatatcagaaatgtcgattatgtacggatctacttcgtcaccttcaacttcccattttaactcggaagtttgtgattcaagtgctaggttatcaaatgcattcatatcatcgtagtacttagcatcggtgatgctatctaggatgtgctgataatcactgtacattgggttatttctatcaagaggtaagtcatcaagatttatttctgccaattgaactagttgaccgtcagttatgaatttgtcttccatgaaatcatcaatgctttggtcatctgggatactctcgtatacaccattaacattaacataaacatattttcgtggcatcatagtaaatgcatgaatatcaataggcattctacttagtatttcttcagccttttcataatggtcggtagcatctttatcatacaaaccacgcataccggacaatacatgaattgcgtcattgtagaatcgttgatttccattttcatctacatggcgatatgaataaacaccatattcaacttcaagtataattctaacttcatcatcagttgcagtagtattgttttctttaattaaagaaacatacttattatacaactcactactaacttcaaagtaaccaaagttataatcagtactggatgcgtaaccaaacggtagtctggtgcttggattatcatcgtaggttaacccactaaatccacatccaacctcatcatgaattacttcatcatctgcacctgtgtacaatttcaaacggttagagagtgtgttatactgaacataatgatttacgtcattaaacatttcattctgtgttgattctttatatacacgattcaacgtttctgtgaattctgctgttgctaccaaatcatctgcatgttctgcataccattggttaacaccataagcaatccctagagttacgttcaattctgggtaatacaattgcatctgataagcaaccaataggtcgaaatcttcatcactgtattctgggaatgtatatttgtaacgttgtaattcaaaatcactaacaacatcttgtgcattagattgatattttttattcacttcttccaatacatcaacacttgccaaattatcatttggtttacattgtgtgttgtcgtagtgcatgataacatcaatttcctggaaacggcgattaggtgttacgaaatcacttggtaattcaccaacttgttcccaacgttgagttacctcattgaattgagcatattcataatcccaaatgtctttttctgttttaacccaagttccatctgcaaagatatatccgtttggatctaagtcattacacaagccattaattaaatcatcatctgaagttttctgttcaatctgggaacgaatcttagttctatatggtttaacttcttcaaagtactcaacgatttgattaatcaagttgtcgttggaatagttctgtactaatgattgttctaaacctacaatataaatgtaagatgttttgaatacccaatcaacaacgctttgttctacgtgtacatacttaaccatatcaaacacaatttcactctgatgtaagtcgaatgagttcttcaataaagctagtgctttacgaacgttaatctcacgattactcaacgaaccattagcatcacgaacggtatagtcagcgtataacatatcattcaattcaactgtactattttcacgaccaattgctttccagtaaactgaatcacgtgattgtgctttaatgtacaaggtccagatgccatcaacatctgtaattctgataatgtcaccaacttgatagttcttagtgtttgcatcctctaggctggattcttgtgtatatgtagtattactatcgtagccaatatcataccaatctgctagtgaccagtactgggtcatgtccaatgaagttcctagtgcctcaacatagtctgattgtttaatcattttctgttgaccttcaccacggttttccaatgtaatggtaaccacactaccagcacttgatgggctattcattagatgaatataaccattagcatcaatatgcacaaaatatacagagctagttgatagtgggttaggtaatacaccactagtacttactagtactgcgtcgttttctttgaacttgtcactttcaggtgcaatgactaattcactattgtaagttagtacacgatatgatacttcattcgggttaacttcagtagttttaacattaaacacttcgtccattagaacagtgttagttgttatattctgtgagcgataatagttatttgcactttctacaaagtttctacgagcttcaattacatcttggaaccaagtcttattagaacctaaaccgtttggtactaaaggatatagtaaatcaattacagttcctgattcagtagtttcttgaccaatcatagaattccacatagaagtccagattgatggattgaagttatagctatcaccttctttacataattgatactggtcatgtttaataacttcagtattatccatgtaataagaaacagttaaaatacttgtgtcatcgttgacttcaaattgcatattacttagaatgaacgagctttcattgattggtgcaaaccaaggaatgttaagctgtgctggttctttaataatacgagcaatatcagtacaagatttagttctggaatgtaatggtggtacataaattgtatcacgaacccagaaataatattttgtaacataagtatcagttgtgctatcatattctaagaacgtactataattatcttccaatgcggttccgcttggtaggtacatagtgttgtttttatttttgttagcaacgtctttacagtatttgtcccagttatatggttcaactggtgaacatacccattcaagaacatcaatagtactgtgcggtaacaatctaccccagttataacgtttatattcatttgttgcatcaacatccacattaccatcagcatcatagattgcacgagtgtaatctaagtagaaagcagtgctggtgttccaccaaacctgaccaactttatcagcaccccatgcttgaatcaattcaccattgctgttgtattgtgctgggtcaactggagatgtgtaggtaacgttctgcatcgctgcaccaggaataacaccgttgattgggtcaaacacgtttaggtacaacgcagtaatgttagtacgttcatcatatgtagttggacggtcaaacaaagtactttgtggagctttaaaactatattttctgtcaatgtattcctgacgcatctcttcagtactgaatcgtgaaacataacgatacaagcgtgggcgagtatcaggatcagtgaagtcaatagtgattgaagtgtcaaacggaactaccataactctagggtcattacccgcagtataatattgactttcaattgtcaatgtatctggcataaagttagtttcatcaacaaagtaataataatcaccgtcatttagtgggatatcatcacttagagttactttacagaattgttctgcatatacatcggtattttcaattggaacgatagagagcatctcaacttcagtgtctactagttcgaaaatattccacaaattgttaccatctttgaacatccatacagaatctggaatttcaccgctgttattcatataagtgatacgatcattatatgcagtactgaaatctttagtaacgtatgaaatttcatctagtgttacagggccaatgtctggaagttgaatattctcacttcttccactacgcattgggaatgaaaacttaccatttgggcgagtaatccagcgtgggtcaaccccttgttcaccgtaataaacaataccattaccagtaccatttgatgtagcattaacatcaaacgaaaccatctgtggttgttgtttaaattggtcattgattagtttaaattgtagatttttcttaccattgatattaccataagtaccaatcttaaatgcccattcctgaagtgctttatattcatcagtgtcgtaagatttagaaacacgtagtactttttccattacttggttagtacctttgtcatgaatgaatcctttatagaaatcaacacgactaacatcactactaatcatacgttgtagataatcacgagtttgataaccaatcaagtgatttgataactcttgaagctgaacatcactcacaggagtttcactattataatataattcaaaatcagttactaatttttcaaatgatggtaaagttcctgcttctaggataatgaaaccaggtgcttgtaggcgaccagtccatgacccagtaatgtaaccatacattttaatcaattcttgaatagcaccataagttggttggtatatgtaatcaccaaagatagttttatcatcaaaaacaactgcgtgttcatatgaacttaggctcaaacgaatcaacgccatacgtttttgtgattcgggtgtagttctcactgtgaatacgttaccgatacgcgaagtttcgatttcatattgacggataccttggttttcatcatcaagtaatgaccaaacaccaccactgttctgtgtaacagattgaactgaaccaaaatctgcaccaaatttagcattagctgcacttggagtacaggatatgaactcgccagtacttaaactattctgactccaaataacaaagtctttagcaatagttgtccagtcttgttgagcaccactatcatttacatcttcaaaaatccagccatgttcttttagatattcaccatatccacaaatgaaagtataaacttcttggtatgtattgaatattttaccatattctaatgtaccttcagatttccattcattgtaatgaacaacagttctgtcttccaatttaagagttacttttcttccatttttaactggaattttatatttaaatttagcaccaactaaatcataaccatcaatttgatatgcactaccattccaagtaatttttactgcactcatttgctcatcgcgaatgttattggaacgaactagaccgatagtttggttttcttgtgaaatcaaaccgaaagatttagcagtgaatgtcaattggtctgctttagtaaagccaccaattttgtgagcaacattaacataagaagaacgaacaacgtcaccgtatttggtggtaatgttcttgttctgatacatcaaatagtcactaacaaacatttgataaccgatagtacgggtatttttctcaccatgtactaatgtagtactgtcaaagtttagacgcttacgagtttcaccataaaggaactgtgaaccatcagtataaactggtttaaggttatcattacgggtatcccagtaatagtttgcaaactgtgctggttttgctttgtatagaagaagcatttggtcataagcaaacatcgcagtgttcatgtaagtgaattccatgtcacccatgtcaccataagcccacggttctgcacgatgatccaaattaccactaacaagacctaaaacttcaggtgcaatatactcaacttcacaaatatcaataccagtactggttttctcgccagtcttagtgattttaaatggctgtacaccgaaacgcttgtatttgtcatattgaccacggcgttcacctgacaaaatagtaccagtactgctgtcaccgatagtaccatcaatatcccacaaaccacttgggaccaaatcaccactttcattcattactagtgcttcatacacataaacaacatcaccttcacgttcaccaacttgaactgcggttggttcgtattcttggttccaccaagtaggacgttgagagaagcccatcatttcccacggatgggttgctggacgatatgtgccgtattggtcagtatagattgcacgccatgaaccacgagcaggaatttcagtacgttgaccatcaacaacataataactaccagtatagttccaagttctccagttatttgcatcataatcatgagtactgttactaataccattggttgctgtgaagttaatataaccacgtagcaatagagttttcttttcttctgcactataatcagtaccagtgaaatatggagttgggaataggtcttcactgtttagtactggtttataatcaatatccttgaaagtaaggtcaatactattaaagatacgattctccaattcgaaaacaacgtcatccattttatcaacaccattgataacacggtatgcttttgaaataataccagtatgactgatattataccagctagatttactaccagcagttaagaatgttgctttttgtggtgtataagcttgcaaaatacccaagaactgtggagttggtgggacaaatgcacgaataaacccagcagtgcttgcaacgttgtcatagtagaatgggaatgtactatcacgtcccatattaatagctgttagaatcgcatctacaatgtttgatgcactattaccaagaaaagcacttgggtcttcttcatacaaacgaagcatttgagtgttgaacttgttaatgaagcggaagtattctgcttgcataaacatgattgattcaaacaaatcaatatcttcattagcggtatgtgccattagtggtaacatggacgcttcgttttgaataattttagtgcctacgccattattaaccaaaccagcagccaaacgttcttcgtaattgttaaagtcatcagcagaaccagatgtaatattcttttgaataatatcttggaagtgctgggtgtaatcaccttggttgatgtattcaatgtttgaattatatgggttattttgtaggttaattggaacttcatatgcacccaactctttattaggagtgatagtgctactataagttctgatttgtacaacagaatcttcatccaaatcaacagagctatcaattgtaatactttgtacttgattattaactacagttttggtgtattcttttatttccacaccatcaacaactagttcgataatatcatcagaattatctagtactttttgtgccaattcaaatgtatgattgtacttaacgctttgtacaccatcaccaacgataacatgccaatcaagatatgtttcacgttctgctttgtaatattgatatgttctatcaacttcaattacataagcatacattccttcaactggatctttgaaactttccatgtcataaacagtactgaatacgcggaacattactgtacgttcaacctgtggagtttgtttaacatattgtttggagtattcagtactacgaacccaatcagtttctaggttcattgtattaccttcaccaattacgttatagtaatatagtccatcaatttcaacttccacacctaaatgctcgtaagtataacgagttgattgtaggaaattctcatatgtgtaataattgtaatcacccagttcaatgttataaccataaacgctatcagttgcataattatagttaattttaaaaccaaataatgaagaaccagtaaaagtacttgatggataggtagtagtgttgtttagtttaacaccattacggtcatacaattggaattgtggaaatacgttcacggaagttttagactgtgcttgaatccaatgagaaccgtcccaatacatggaactgttaccaaattcattacctttgataataagaactacgtcaccatcttgtggttcaccactcggacggctttcagattcttcgtctgggtctaatgctagaccatacacacgtgtcccatcttgcatacgtttaacatatactttataaattcggttgttttcaccattgttaccaatactggtgaaaagaatacgcataccatcttgtggaataataccatcaatacgtataccgctgttaatatctttttgtacgatatcttctggtttaataatatcagagaacaaatcaactgtcccacggaatttagtaccgtagttcattagttctatatttttattgtattcgataattggtgcacgagcacgaacaaaacgggaatcttgcattagttcttcagataggatagtaccatcttctaaagtttcacctaatgtgtaccagaagttttgtagtgaccaagtgttaccattttctgcaccacgttccattacaatataatctggagttgtgatattatagctattcttggaatcccataggtatgaactgtagttgttcattttatttgggttaattggtggggtccatgaatagaacttaccattaaacaaacggctttcattttcggttagtgcaccgtaatgattcatatagccaactagatcatcataaaattgaattgaacgaatgctggagtcatcatttcttgagacatacgcagtggacaactgatatagttgacgtgcgactgttgactcgtgtaagaagatgttccctgctgctgccggagaacccatgtcaccaatgtagccgtcaactaattcgttttcagccggattaaaccattgttggataacatcatcactgactttctgaatatcttctaagccttgcatccactcaggcaatctttttatgaaaagcttcttctgtactgcttcagccatctgtgtaggttgaaacttaaaattattagtcatttttggactccatataattcgttcattcatttgatttatttatgatataaaaaagacgttccgaagaacgccttaatgtgttatgaaccaatgttaatgttactcttagccaaggaattgactatctgtacgttatcaactgatgcagtacttaagaaaatctggtcagaacgtgaagggatttcaaatagtgagccaaatttagagttagggttttgagctacgataacaatagtactaatatgtcgtcctaattgggagtgaatgtatgtacacaagtctgtgtaatagaaactttcaccaaaatcccagttgtcaacattaaaatactcgttagttagtgctacgacattttgacgaatttcatcatcactcattgtactgttaggcaatttgacgactttgaaatctgctttataatcttcagcagcactcgcaccaaataatggtagatattctgcactatgccaaataatactgtcactgatgactattttttgttcaacttctttaaaaatgtctttcaattcaacagatgttggcggtttaggcatattaccttgtgttccattcttcaaccatacatcaacttcagttttgtatgaattggttaatacatacatgtcaatcaagtttgttctacttgggtcaatgcgattatcatctggtgcataatgtttccagtggaaatcaataccagttcttgcattcgtttttacggtatattgtgaagttacatctttataaccataataatctaacttttggttaacatcagcattagtaccgatattaacaatagcacgataaaacgcaagttcaggagttgcagcagttgtatcatcagaataggtcaagttctcaattaattggtttaaacggtcattattattaccaacagtttgttctatgaagtaatatttaccatcgtatttaaagccaaccataaagcctgaacctttactatagataccactcaatgttgttgagcgaatagcattattgcgaacaaattcacttctcttatacgcattagtttctgcaagtgcctgatccattgtataagcccatgaagaatcaagaatagtgaaagtatcgctcggtaatgacagtactgatatagtgaaatcatcattttcttggaaaaccaatataccaccatatttaactgcatcttcaccagtccaattaggtacaatttctctgaattgattaggttctagtgggattccattactatcaacgttttcagaggtgataaccacacgagaaccatcaagatacccgttttcttgttgaattgtgtcataaatttggaaatctatgttacttgtcaacccagcattactattgcttgtggtatttgatgataaaatttcaattttgtcactttgaacactaccagtactaatatcagttatctttttagaagaaacgaagtaaaaacgaactttatcaccaccaacgaacacatattcaacgccattcgcatcaaattcccaggtttcagcagtatatttgatgttaatcataacaagaacttcatttccattataagaaatagtatcttcatcagtactgatttctaatggaatccaagaagttgtttctttatcatgaataataacaaaatctgtctttttatcaagcattgcagcgattgcttgcacttcgacactattaaaacgtgttctgtattgtaaaatgtactcttgtgcttgcatatttgatgaaactgaagtacttagaacgtaatatccattatcaagaacactaacaatactagcccacacagtagttccggcatttgaaaacttaatcaacgtaccaacttgataatttccgaatacgttacctgttgcccccataatacgaccatacgtattagttgcgtaattagaattgtattcaggtgtccatttttgttgaatttcaataccaattgtattcggtggatatgcttgataacgttgtattacagcattctcaccaatcaatggctgaatattatcaattacaatactagcatttgttttggtagttggtaattgtaaagatttattaaattgtgtgttttcttgatacattgaaccatcatcactaaacacatcagtgttttgatacttaccagttgggtcattaatatcaatgaatcgtgactgtccactatataaacggttaattgctttagatttaagaactgtgttacccaaactcaacggagcaatgttatagtcttcaccgttaacaaaacggttttgagtgtaatacatttgtggagcacgagccttaatttgctcaattgtttctgcactttgtgcacgatctgattcatattgcaatgtgaaacgaatatccaaagtactggattcgtagcttgattgtgttttggttctataggtgtattttacacttttgttctggatttcagacgttttaatgttgtatgtttcaccattactaacacgataccatacacgatacgtcccacgaggaacaacaccactacgagaatcaggatacttaatagtaatctggtctttatcacgagttgtgacagcaaagattgtttttagttgacggttaacagtattgtatgcgatactttccatagatggaactttggtccatttagtacgaacaataccatcttcgttgatttcctgaacccaaacatcagtttcgttgatattatcaacattgatatcttgaattcggttttcttctcgaatattatattggtaatcttgatatgtcaatgtcccttgaacaaaataaacaaagaaaccagtatttggtgaactaaatccgttaccatcattctgataaactatatatttttgctcttgtggttcagggtgacgctcttcaacaccaactgccgtaatatcagggttgacaacttcaaatgtcatcgattcaccattaactgtagcagtgaatgggagacttggggctgacattggaattgtattcatgcgatatagatgtcgagaaacaccattgatatcgatacgtttaaccggattaccaaattggttagtactgacaaatgaactgttcataactagaatgaagttctcataccagtttgtgtccattgggtcattccaacgaatgattttatccttaagtgattcgttaaagctattacgaacatcttggttggttttaatttctgttaattttgctactgcacgacctggatatgaacggcgtggtgagtaagaaatcatttttgcgagtttcagtactgatgcacgacgagtagcagtatctaggaagttctcacgagtgtttaaatccatacggaatgccaagttctgtcctagcatagaaatggtatctagaataaagataaactggtcgttttcgatccagtcgttgaaagaatctgggtacgtagcacgtagatagtcaatcatactttgacggattgtatcaaagtcataagctgttagattgatcttataaaagctttcatatacttgagtccaatcttcaccagcgtataaatttgattgccttttttgttgtgacataatttattcctttaaatcagtaaagtactagttcagtactgggaattatatatagaaatatttatccaaaaagaaaagcaccccgaagagtgcttttataatttacaaagatgatacagaataggtagccattctgttgttacttcttgcatcaaaaactatagttaattcttcaagagtattgagaacaacatattcaagtactatatccatctgataaccgtactcaattcttgatatttgaagtttctttaagcttaaacgtgggtccaagctaataattctacgggcatctgcttccaaaaggttgattgtattataaccatccaattcaaatagcaaatcccacgcaatgaacccataatcagcatcaaatgcacgttcacctttttttgtattgaaatgattcattaaatcctgacgaaccaattcactgtcatacaatgtttcagttcttccaactactggagttgaaaaacctttaaaaacaattgccattatgtgtttcctttattatacggattctacgatgcgagccatcttctccgctctggatgtggtttgtttgtaccacgtactatcacgcatttctttaccagcagttttataatcaccacgaccgagagcagccattgcttttttgaaatttaaaacttttgatttacccatttggaacaccataaaccacaatacacgctgaacctgtactggagcagtcattccaaattgatcatagattgattttgcgtcattgtaagcggtctgagcatcttttataaggagagcatcagcttctgcttcagtgagtccatttttgaaactttcacccttaagtacaaggtgaccgtaaccaatggtatcaagacctagactgtctttatatacccaaaacttatcatttttaaaataaccaagttttttctgatacgcaatagtaccttcaaattctttaatttctttaaaaaattgttcgtcggtatttttgatttcccatttactcataaagatttcctcattattatttatagtactgaaatatttattgacatgcctctaatctacgtgccattaattcagcacggcgtgtagtttgacgataccaagctgaatttcgaatttgagcagcagcttgcttgtagttaccttttgccatttcagatagcattgacttaaatttcattacaccacctttacccatctggaagaccatttgacataggacttgttgtgccatgtaaggtgttttcatcttataagaagcgtagattgatttggcatcatatatagctttactactatcacgaactaacatatcattggcttcctgttcggtaataccaccagagaagttttctccaccaacaatcaaatgtccgtaaccaatggttgggaacccacgactgtctaaatatctccagaatttaccatttcggtaatatcctttagcttgttgatacgccattgtcccttcatattctttcaattcggaaataaattgtgaatcaccaggaacaactttccagtcaattgccgtcttgtcaacattaccaacattgtatgattcttgtgcagttggtgcggcggtactaccacctgaacgttgtgttcttctacgacgagggacatgcctagaaccacgttgtgaatatccagtaccgatggttttaattttagtggagacaactagttcatcactatcaacagaaggttgaacaacagctttcggtgctgcttggttcgttgcttgtcctgcaattaatgttttatttcccgcttcagaacctgtaccagtctgcgatgcatagaataatccagggtcaactgaaccactaaatcctagtacgttggcagaggtaactcttatttcaaattgaataacaccattagctttccccagtacttgtcctttttgaacaacgtctttattgagcaaatctgattgaatattataaaatacagatttatatccagacttatgttgaaccaataaagcaccattagtgataacaactacaccaccatctggagctacaacatcacccttgcactgtatttcccagccacttctatcagctttaccaccaccactagtcgggacacctttcccccaataaccgtattggcgaatggttccactacacggcatgaacatatgaagaccctcatacgtaatgctataaccagtcatgccaggatcagaagtcattaaatcttgtgtttgaacttgttctgtttctgttgtataatttacatattgaattgcttcagtgtcttgtactggagctaaagttggagctacatcattagcaggttcaggttgaactggggattcactattcccactaccaccaccttgacgtggaggttcaacagtactgccgtgattctctgcatcaacccaagccgatatatcatgtatatgatcattcaagccaacagatggggtgcggaagtttggtgcattaaattcagcagtaccactattaccaccactgttaacagtaagagtttgaccaccaccactaataatagctgatgaagaaccaataagattagcactggtagcagcagagattgacgcattagaaccagcagttatatcagtactgctaccactttgcatacgtaatgaagctgctgttactaaacgtaaatctgctccagcgttaataacaacctgaccaccaactttagcatccaatgcaccaaccaaatctagtttagtgtttgcaccaacacgagcattgaagtctgctccactttcaatattatatgagcgacccgcaaccatgttaatatcttgtcctgcacgaatgttaatattcttatcacagtgcatttcaatgtcaccttcaccagtgaatttaatacgtgcagtaccatcacggttaattaaaagaacatcgccagaggcttcagataacaacaactgtgcaccactacgtgttttaattacaacgccttcatttttacgagaaccaacacgagtatcgttcactgggttattgaattgggtatcctgataaccatctggatcttgatcccatgtaggtgctgttaattcttcttctgtgtaaccatcatcaataataaaactgttaccacgaggtgaggaaagaccataaacagtactggtagtttggcgagtactgctacggttagcaacacccgcttcctcatcataaagtaagttttgttttttcagacctgcaataattggaacgtttgcatatttgtcttgagtactggtagaaattgtattacggtcataatcagttacgggtaatggcatatcagtaccagcatagttgcttatttcagtagccattccaggaaccatcgtattcatacgttggtcataaacacaaccaatccaatacgcttggaatgttcttgcttgtgcaaatataacaacaacagtacatccgacatcaggtggaaccgcccaaaaaccatatccctttggatattgaccataagcatcagcacttggtatccctggagttttaccagcgaatggagacatgtatgatgcttcaatccatgactcttttgaatttttatcactttgtgaaccttgaatccacacttttagcttaccggatttagttgggtcacggttatccatcacggttgctagttgtggatacgaagggtcaaaacgacccaactgttgttgggcatatttcttacttgtatctgccatcttaaattattccttattcaattatactatcgtgacgtttgagtgcacgaattacaattgcagcctgaatttgttgtgtaaatgaaccacctgcaccaaaatcatgaacaattttgttaacacgatatacagtttggttaaatgtagttggggtattaatatcaagaacaccagtgttatcatttatagaaactacaggttgtaatttcaataaaagatatgcttcagatgtaatatagtttgctacatggtaatcttctggattgatttccatatcttctccattaattacctgttcaagatattggatatatgaataatcactccaacccaaccagaatgggtcaccaacaacacgcatatccaatttacacaagaatggacgattgtaatagttgtcacgaattttacggcgatccatttcatatgtgctactgttatcgttcaatgatgcagacaatgttgtttcattatttgttgcttcagttggcattgtgaatacttcaccatatcgatgaccaattccatcggtcccaccgtcattttcttcatatgtagttacataatcttcaatatactgtggtagaacgtttacttgatagttattataacggtcctgttcttcagcattaccaacctgcatttgttctcttgctaaagtttctactcgatttaaaagttgctcttgatcctgtgttaatataccaccaagatcacgtgtgacgcgtaaatcacttgtttttgcccacgcatctggtatactgttgtactgaacaccttggatattcaattcttgtgatgcgtgtgtaccagcatggttcgcaacgtcctgtattggaccagggttacgagttgtagctacaaagaattgctgatcaaacttcaaatcaaggtctagaatctcactattgagtccactaaactgataattgtaagttttcatgttaatctttggtttttggtcatttgggtctacatatttctcggcattttcaaagaaatactcaaatgtaaagttttctggctgtaaatcggattcatgaacaatatcaccaattttaaaacgaacaatatagaaaacaactttgtaaactgatgtatttctgtaattatcaaatccaacatattgtttcagtgggattatattaacaaattgacgaacactagtactatcatcagcctgtacagtacaggtatctattacgtcatcgataattcgagaaattggagtacttggattccatgaaaagtttttagaaccctgtgcaccactttttgtagctccagcttctgccatctgtttagaatcatagtttataaacaaatcctgtaaatctggtgcaactttaaattcaaagaacttcccttctgctaactcaccaaatttataacgcaaataaccatattgctggtctgccatttgattcaatttatcttccaaatcaaaacaaaaatcaccaaagttttctgctgtgcagttaaatggttctttaagagtccattccacattatccactagagcagtacggttatgaacaagactcatagaatacatcatagtactaccactttgtgatgcactagcagttacactgttaatcttcactgaccatttacgagtggtttctggtattgtttctggtacaccattagtattaaatccaataaatttcaattctaatatcaaaggtaagtccatgaacttatgataccttagtttattacttaaagaaattagttcatcatataaactcatactattgttttcagaaaggttcagtactgctgtgttgaagcaatagttggttgtcatccctggagttgaaggaccagcttgcgtcatctgaacacttgtgatattatactttccagttacaccactttcagagatgacatggcgttgaacttcagcatctgggtaaagccagaagtttttgaaatcatccttgtctaatgcgaaaagggaaaagtgccaagttggattgtcatactttaacaatttattgtcataaggaataacaaactcagttagatccaagtcttcatacacttggtcaacgcttgcactttgctttggtaaagactgtacgttactaaccttagctttaaaattgttttttactttttcaagatcattttgcaaagtattagcagttgcttttaagctttcaatagtacttgttgcagtttcttttgctgcctttgcagaacttgtgatgtttgaaatatcatttttaaaattatcaacagaactttgtaaatctgccatactttactccattaacctatgttacgagtaccattcaagtagttttgtactcgttgatttgagggaacacgaattgtgataccactattaaaattgtatattgggtcttctcctaatatatcaggattcaatagggcaaatacataatacagacgttcattaccatacatttcgtatgctaaacgccaaggttgatgctcatacttcaatggaattacatagaagtcgtcagtatcagcaggaaccatatcacgtggtaaattgtaaccaagataccacgtttgtttaacctttgcataaggagagtattgactatagttggacattagataaatcctccattacgtaatagttcaccacgcttaaatgcatttaggttgaactttttagtcatgtaatcagatgttggttgttcttcaagttgaagcgttacagatattttctgtggaacccatacctcatcttgtggattcatatatcctgtacttctaagctggtcgaagaattgacgactatccatatcagataaattaaaagtactatcactactattcaatggaacctgaatgtaagacacatcatttggatatgtaaaattatatgctttcaaaataacaggaatatcattatatgtataacgaccatacccacttaatagtaaaattggtggtggtgcacctgcaattgctagttcgggattattagcagatgctgcttgacgaccaaagtccattaaggacacggaacgaataaaatgaacacaagccaatgcatacattgcttcagcagcagtgttcgcataaaactcaccttggatagtgaaaacagtgtttgttgtattcttgtagttgttatagttactgttagtatgtataggggactgtgtttcatattgaacagacctttgttcagttacagttggggttacagtccaaaccaaaccatttgttggacgcagaaacgatagcaatgttggttctgaactgttgccaaaatcaccatacacatagttagcacctgcggttttaggtcttaatcggattctacgatcaatcatctttttgattctccataagaagggaacatttgatgtatttatacgtgggacaaagacgtttttggtgctataataacattgatggtacaaggaatgtacctattggatttaaaacatggagagttgaaataatgacaaataggccgaagcgtaaaaagtatcttaacaatgctgatttacttcgtgagatacaaaaaagtaaaatctcatattgctggttacttgataagtgctacagtatgtatgattatatcgtttttgatgaatccgaaattacagcagaacttttagataaagctaaagcagcacgtattaaacgtctcaacaatgaaatgcttgatgcaattcgtgaaaaagaaggtatgagtgcgaagaaagcgaaggaatacgcagatgagcacaatttagtactaactgatgtacctatcgatgaggtggttattcgtgtaattaccgatgaacatatcccagcagatacaagagtaaattttgaaccattcaaacattacattgtagatgaagaaggtattctgtatgaagttgttcgttctcactggaaaggtgatcttgaagacggagaattcagtactgttcatggtaaaatcactaatgaactaggtaaaatgttcattaaactggcagaggaaatctctcacaaatccaactatagaaattatacgtatttggatgaaatgatgggtgatgccagaatacaattagttaaaaatgcacttctctttaaagagagtattctttacaaaaaagataagccagcagtacagttgaatcctttctcttactatacttcgttcgttaacaacagtttccgttcgattcttaatagtgagaaaaatgttcgtaacatccgagacgatttacttgagatgcatggttttacaccatcacacactcgtcaaatcgaaattgaaatgaacatgattgaaaggaaaaacgaagatggctctatttgataaagcaattacatttactgatattcatttaggattaaagaataacagcaagcagcacaatgaagattgtttgaacttcatcaagtttatgattgaacttgctaagaaaaatggcattactgtatgtgtgtttatgggagattacttccataaccgcagtaatatcaacattcaaacattgaactatggtttacaaattctacaattactaaatgacaactttgataaggtttacttcttagttgggaaccatgacatgtatcataaaaataaacgtgacattactagtattaatatggcacaagtttatgagaacatcgagttcattaatgaaatcacaacatttgatgattgtactttcattccatttatgattgaagatgaatacaaagttctacctcaacttaaaagtaagtatgtttttggtcacttagagttacctggatacttgctcaataaaatggttgagatgccagatcatggtaaagagactgaaggttcttttggtggttgtgagtatgtttttagtggacatttccataaaagacaagcaaaaacaacatcaaaaggaactcgtgtaatttacacaggtaactgtttcccacataacttttctgacacttgggatgatgcaagaggtgtgatgattttagaacatggtaaagaaccaactttccattcttggtcagaagcaccaaaatatagaacatttacactttcagaactattaacagatccaagttattatcttcaagacaatacgatttcaaaggttcaagttgatattgctatcactaccgatgagattagttttattcgtgatacttttactaaactttataacattcgtgaatttaatgttgttactagcaagcaaagtattaaagaacttattgaagatggtgaaagctttgaaagtactgagtcagttgatgagattgtgttacaacaaatcatggaaattgattcacctatgttcgataaaaatcttctaatccaaatttacagatcactataagggaaatttattgtgctaaacattacacgtatatcaatgaggaacttcttttcatttggcaatgcaccacaagtaattgatttgtctggtgctgatatatcgttagttcttggtcaaaacaatgatgcagttattgaaggtggtgatagttcaggtcgccgtaatggtgttggtaaaagtgccatcattcaaggtttagtttttggtttgtttggaaaaagtattggtaacgatatcaaaattccaaacttagttaataaaactaatgctaaaaactgtgaagtatctgttgagttcgagaaagatggtgtacaatatctcgtcgagcgtgggagaagtcccacgtatttcaactttattacattaggtaaagataataaggtcgaagatgagtcaagaggggagaagaaagatacacaagaagatctaaacgagattcttgggatttctcaactactatttgaacatattgtagtacttaatgctaacgtagagccgtttcttgcattatcatcacagaaacaacgtgatatgattgaggaacttctgggcatcacacaattaacagagaaagctgaactattaaaggatatgtataaagattctaaacgtttagctgaacaagaaaagttcaaaattgaaactgtggctgcaagtaatgaacgtattcaaaaaagtattgaatcattacaagaacaagctaaccaatttgagattgataaaaataatagagtatctaagttgactgaagaattgaatatctacaaaactttagacttcaacgatctctatgatttggcagaagtgaaagagaaagctcttattcataatgctgctcgtgatcaaatagaaagacgtgtgcaagagttagctttgaagtatgatgcatatgaccgtgaactagcaacagcaaaattagcattaaatgtaagtattgataagctaaaaactattgatatcagtactgaattagaaaatcacaatgagttggagatatggaaacagttggagggtattctaaaagagaataataaccaaaaacgtttcaaagaacaaaaacttaacgcattaaaggtggctttaaatggtcatgagagttcgttacgtgctgaggtggacaaattagcaacagtggagagtagtaaatgtccactttgtatgtccaaattagaacataatgaacatacttcgtctattaaagataaaattcaaaatactattaatgaacttcaatcgaaaattgacagttccacttctgaaattgaaacaatacttcaggaaattgatagtattgagatttttgatatgccacctaagcctgtgacattctattctacactaactgaagcacaaatgcatgagcataagcttcaagaacttattaaaaagagtgaagaagagcaaattaacatctatgctaatgaacttatgtcatcatatgaagaactgaacgcacatgttcttcaagaagtaccagatacattgaataaatctgaagtaaaagagttagaaatgacagtaacttcattatcacagcaattagatcgtgaattgaaaactactaacacatttattggacaaattaatacacttactaccgattcattagtaccaatcgactatagtgactataataaccttgataagatggcaaatcaccaagatttcttggttaaattgttgttaaacaaggattcttatgtccgtaagcgtattattgaacaaaacatttcgtatctgaatacacgtcttcaatattacattgatatgtgtggttctgaacataatgttgtgttcttgaatgatttgagtgtagaaattgagaaaagtggtcagtactttgactataaacagcttagtcgtggtgagcgtacaagggtaaacattgctttatcttgtgctttccgtgatacatatgagtcattgtatcaaagtatcaatattcttatcattgatgagatgattgaccaaggtcttgattcaagtggtgttcttcgcgtgtggtctatcttccaagatatggctgctgtgcgtggtaagaatgtatatgccatttctcacagagaagaattgctttctaagactgagaaaatcctaaaagtagttaaagaggatggtttcagtactgttgagtatacaactcttgatgatgtattctaattaaaaggaaagggagccttagctccctttttttatatctaccatatttaatttgccttccttgataagctttctggcttgcttaacacgagcagcattgtttgcaccagggataacacctaattcttccagtattgcgttctgttgtcctgctggaagccttttaaacttattcgtatcgattgttagtgcagtgtgatgtataacttgctcatcttcaggaatgctgttattacgctccagataatccgcaagatttcgtagtacctcgtataagggtttatcggttaagtgcttcatatagcgattaaagctgttctgtactttaccttcccatgcgttcacttcgttctggagaacttcacgacagtgttgattttcgaagtgatagtgatcaagtactggcttagttattggttccttaattataggatcaattcctttttgcttctttagtaattcatttcgatagtttgcagcttctttactatcttttaatcttttcttcataaatccccactaaactaattcttatcaaaatatttatgcgttacttcaatgttcaagaattatgtactttttataaattttttatcataatagtgagacacttttgaatttggtgctataatgttaattgtagtgatgacaatcctgttgaatgcagaaatgcatataaattagaacctgatcctatcgaaaatgtagatggcagatgagcagttcaacagtgcgatgagcagaagaaacccgttagatgtgggcatagtttgaacccctcacggcgacacggctcaataaagaactccgataagcacacagagagttcctcgatagatgtataaggatcgcaccttaccagatttgctaagggagtttattaagtgatttaataaacagcctgaagtttgattgtatagactttcaggtgagtgtcaggatgattaagactgacgaccgttgcacatgactgcgatagagagaaacagagcaacccgctttcgttcttaatgaattttaagaaattcgcaatacaataaatgctgaaaccatcagcgtcaagaattaagagacttaattgtctcttttttattgtcttcattcccctgcggggggatgaaaatgtcttcaacaaatcccgtcaagtattaaatcttttaaagttctttataattaattataagaaatgaatatgagttacgtagtaacgaatattcttcagctaacgaatgaaatgagttagatgagttcactataaaataattaattcctttcataattcaattcaatcaattctgtagtttaaaaccaaaaaaaaaccagcaacaatgtgctggctccttgtgagttagtgcttctcgttttgttttttaattttcttattaaaagacttaactaataagtctctatcaattagtggcatattaagtagtgttccgtaatcaacactttccatataaacagaacactccattaatgcagttttaatatctgacttattcaactcaaattccttaagtacttcttgtatttcttcaggagatgagtggagaagcattatgcgaaaaaatgacttgggtcatatttcagtccattaatttcccattgatgattacagtcactgcattcaacttccatagtatgggaaacaccaatttcaagtacttcatccattttttcacgaattattttaagtgttcctttggactgctgacctagccattcagaaatgaattcattttcagttacttcatcaccttcaggtgtaattaccttagcaataactcctgcgatcatatcaaagttgagttgtgccatactttcaaatacttcaccaaacactttaactttttcttcctgctccatttcggcagtttcaaggaatttagttttttgttgttctgtaaacattctttctgcgaagttagaatattccttccaagtaagtggtctaaactctaaacttagtccattatccaattgtacagtaggaacttcactgaaagtttgtgctgtttctagtagatatgacaagctacgctcaaaacggccttctttgttacattcagggcatgtcacattaatatcatatgattcttctttagaagctactttaatagcgataagtaattgctctacgtcatttacataaagttcatctgcatcaagtacgttaggtacgcagttttcaataacacgagcaattgcatcaccatttagaagcatatctggtgtattgagtgtcatttcatcacgtgcactacgagcacaaatgccacatttgatacctttagagccaagaactccttctttataaggaatcacgccatttgtgaccaattttgtaccaagttcttcaattttagtatacttagctagtgggttcattgccattttattaaatctccatgtaataaatgtctttgtagtatttattaccaaaaaatgggacaaattggacaaatgttatagatgggtcttttttattcgttatagattcataaatatttctataatacatctattaaaagggaatgttatggctgtcaatacaagtgattacctactacagcagttggttaatcaaactaaagataacaatgatagtttgactgctatccgtgagttattagctgaaaatataaaaaatgataagaaaaaatcaggttcaaatagtaaaaagaatggttccagttccagttcttccagtaatcgtggaaatcgtggaagtgcacaagccgatgatgggaaagcatttggtaaattgttcaaatcactatcttctgaagtttctaatgtaagcaaaacaatgatgaactccagtacgaacgtaagtactgtagtaaactcattgggcgttagtgcatcctcatttgcaggttcattagcaatgatgccaggtccaattggtgcagcggcagcagcatttaaactcgttactggtgctggtcttgctgtatacaatgcacttaatgcacaattggaagtatataccagaattaacagtgctggtgttgcattggctgaaggttatggctcagtactgaaaggtgcaggtgcatcgatgttgagtatggatgcattcagtgaagctctacaaacacatagttctgtagtagctcaattggatggggcatatggggatggtgttgctacctttggtaaattgttaggaactgttcaacaagctcaaaatgaacttggcctttatggtatttctcaaaaaacattaactgatttaactgcaagaaacattaagttccaaaaacaatatggtggtcgtgaagctcttcgtagtatggaccaagctaaaagtactgaacaattcatcatgagtatgactaaattcagtaaaagcatgggtgaatccgttgatgcactattaaacaaaacacaaaacctagataaatcactcgatacacgttctatgcaaattgcattgcagaactactctggactatccagtaaagctgctgtagcaacatctaaggcgttcaacgaagctgcgggtgcaatgggtgatgcaggtgcagatttcctccgtttgatatcacacagattgtctattggtggtgtaccggatgacctactcactccagtactgaaccagttcgctgatttaggtgaaaatcttgtgcgtagtggtgtaactgattcacaagaaattcgtcgccaacaattagaattcgttaaaaagaataaagaattaattaagcaagatttgcttaaccagattcaattaggaaacacaacggctgcaaccttctaccaacaactattggatatggaagctacagtaaatgatcctaaaaataatccggctgataaattaactcaatttactaaccgcttcaatatgtggattagtaaagaattcactgaaccatttaatacaatgtatgctaatacacaaaattcaattgtggattatctttcagacattgcagacagaactgatggtgcatgggagtttattggggaattggctcttgatggatttgggttagtacctattgctaaagatgcaattgcttaccttgatcgtattggtgctgaatttacagcttggttggatggattgggtgcagatatattcggttcaggttactctaaagtgtcagaagcatttgatacctttatgaataacttaatggatttacctggtaacctatggaattctgttaaaagttggttcggtggtggttctgataatgatataaaactcaataacagtactgaaaccccagcagaaagcgtaaacaacatcattgacaacggtgtaaatagtgttagtgattattttgcagggatgtgggataagttcaacaaatggaacacctcacgtaactacaaagaaccaaaaccactaccatctgattatgctgacagtttattcaaccgtccaggagtagaacgtattcgtcctgttattgaaaaaaccaataacgttgctccagagataactgtatctcgtaaagattttgataaaactgcatgggcaccaggtgaaccaccagttccaccaaaacctgacgatacagaggcaattaagaagatgataaataatggtagtgcagtgacatcgagaactggaccaccagcaccgatttctgatgaaatgaaagaaatactcaaaaagcttgccgatgttaatgaacaatcactatctgctgtacaacagacaaataattatctaagaactatctctgaaaacacccaaggtgagagaaacagttaaggacgaacaataatgagttggaaacgacatatgacaatggggagatcgaagttatcggtcgtccctaatcagtccagtaatagcaacaaatcaacaggaacgaaaaccaatttcgcttcctatcttccagtagtatacaatggtttagctaaccgtactgaacgttatagtcagtatgaacagatggaccaagatcctgaaattagaacagcacttaatatcattgctgacttctgtacacaaagtactgaagattttggtcttccatataaaatcaaatataaagatgatattggtgatacagaagtaactactattgaagaccgtttggatgcatggactgaacaaaatgattttaaaaccagaatgtatgaaattgtacgtggcctattaaaatacggtgaccaattcttcattcgtgacccagaaacatttgactggtactgggtaagcccaaaaaacgttgaacaagtattcgttaacgaagcaaccggaaaaacccctgtaatttattatatccgtgacgtatctttgaatcttaaagataaagtgtttagtaacttgcaagttggttttgacaaaactgcatatcctggtgcaatccctaccacattaggtggcggtggttcagtagcagcaggtggtgcatctggctttactaaccaaggaaactctgctgacccattcagtactaacggtcgtcttgatgttattccagttggtgcagaacacgtaattcatctaaccctaaatacaggacaagatggagtttggccttttggtactagtatacttgaagatgttttcaaagtctataaacaaaaagaattacttgaagatagtattattatctatcgtgttcaacgtgctccagagcgtcgtgtatttaaaatcgacgttggtgatatgcaaactcaccaagcaatggcatacgtagaacgattcaaaaatgaaattcaccaaagacgtatcccttcaaataaaggtggcagtacttctctaatggatgcagcatataatccattaagtattctagaagattacttcttcccacaaacttctgaaggtcgtggttcagatgtacaaacacttcctggtggtgataacttaggtcagattgatgacttgcgttacttcaacaataaattgattcgtggattgcaaattccagcttcatatctaccgcaaggtccagatgatggtggtgtatcactatttggtgatggtgcaacacaagcaatggcaagtgaattacgttttaataaccaatgtatgcgttatcaacgtttggttgcaaaactatttgatgcagaatttaaacgttttatggttaaaaatggatataacattagtacttcatcttttgaagtaattatgaatccacctattaacttggcttcttatcgtaaagcggaactagatgctaaactaattaacacctatctcccacttaacgatctgccatatatggcaaaacaaactattcttgaaaaaatgggcttctctaaagctgatattgttaagaatgagcaaatgtggctccaagaaaatccacaagatggttccgctccgtcaagtggtgaagaagatgctgctgggttgcaatctgttggtatagatgctcctaacgatcctggtatggatttgggtattgatggtgacggtaacttagaaagtgccgatgctgaataccaagaacaacaaggaagtgcaggttttaacccgaataatttaggcgattctttttaatcataaataacaatgtataagaatgagggtacattagttgccctcattataatgcatattcaaaggagatgaaatgttaaaggacatctttgaatctagcagtgattctttatacgaccctgaagatgatcagaacgtatataaaattactgattccagaaaaccaaaactaacattacaagtacttaataatttaagaaagtaccgtgaatttaaagctaatgaagaacaacgacgcaaaaatgttgtcgctgttgtttatgcagcagcaccatccggtgatggttcaggattaatgtaaacaaaaatcgcactttttaaagcttttaaaaatggcgaaatttttcagtactaaataatatcatactttatatgaatgtaatatatctatggaggatataatggcgaatttaaaactactacaagaagcaattgaagcgtttgcaaacggcgaacaagatgttgctgataaaaaaatgcgtaagtactttgttgagcaagctcaagaaatcaataaagaactagaagaaagcatggacgaagaagaatgtgaagttgaagtcaaagacgaagaaaaacttgacgaagactttgatgttcaaccagacgctggtctaaatgctgaaatcgaatacaccctaggtgaagaagatgaaagtgcagaagaagaagttgaattctctgctgatgctgatggcgaagaagttgacgctgaagcagaagttggtgcagaagttccttccgaagaccaatgggaatctattcaagatgctttccgtggcctacaacaaatgtttgacgaaatcggtggtgatgaagttgacctaggttctgatgacgaagaagttgaagttggtgcggaagaagaattcggtgctgatggtgaagaatctgaagacgaatttgctgatgtacaattcggtgatgagaaagttggtgagtctttcaaacttaagcaagttgctgcggttgataagaaagaaaaagctggcgttaataccaagtctccagttgctccagaagctaaatctccagttcaaggtgttgctccagtgaaattcgctaaagcttccgaaaaacaagtagattatgattttgaaaacgaagatgctatgtctcacactgatgaagacctaggtaaaaatgctcgtggcgaaatgaaagatgttgcgaagccaaaaaataccgcttctaaatctcgttctccactaccaaaatcacaaccaaaaatctaacactaaataaagaaaaggaaaggagatcattatgagtatgattcgtgaatggtcttcattcaatgattctaaagttgttttggaacatcgtgataatggacttggtgggcgtgattgctatcttcgtggtattgctattcaagccgatcaaagaaatttaaatgagagaatttaccctttagccgaaattactaaagctgttaataatatggctcaacgtttggctaaaggtgaaagtattctagttgaatgtgaccaccccgaaacactaacaattaaccttgaccgtgtagcagcaatgattactaaggtctggatggaaggtgctaacggcatggcagaaatcaaactacttgatactgctcatggtactaatattcgtaaaatgctagaagctggtgtgaaacttggtgtaagttctcgtggttccggtaacgtggattacaatggaatagtttctgattttgaaattatcacaattgatattgttgctcaacctagtgctccagaggcataccctactgcggtttttgaatctctgatgagtaagtacggatcaccttgtaatagtcctaaaaaaatcacagaatctaaaacagtaaataatgtagattctgaaatttacgattttttcaagaaattaaaaggttaacattttaaaaatataaatatttgtatgttgaagtacagatatttcagtacttaaaggagagaacgaatgtctaaattagaaaagcttctaaaagaatcatctctttctgatgaggcaaaacagctaattcaggaagcatggaatgaagaaaaaaacacacttgccgcagaaatgcgtgaagaaatgaaaggccgctacaaacaagatttgtctgagctaaccgaaggtctaaatactatggttactcaagttatcgctgaagaaatgggtgcagtatatgaagagaaaaaacgtcttgtagaagatcgtgtaactctccgcaaaaccctaagtaatttctctgcgttttctaactctgttttggctgaagaagttaaacaaatgcgtaaagaacgtaagcatcttcaagaatgcatgggtaaattcgttaatttctctaacggtatcctagcagaagagctaaaagaattccacatcgagaaacgtcaactagttgaaactcgcgttaaactactagctgaaggctcccgtcaaattgctgaagcacgtaacaacttcatcaaacgtacatctgaaagtgctgctaaatatattgcagaaactactcagaaaaacctatacgctttgaaagaagatcttgttgaagcaaaacaaaatatgtttggtcgtaaaatctttgaagcatttgctcaagagtttaatgtcaaacaatttaatgagaattcactactacgttccctaactgaatcaatcaagtctaaagaagacgaaattgctcaagttaagaaagaactaaatgaaactgtaagtgaagttaaagctgctaaaaccaaactacgtattatggaagattcacaagctcgtaatgcgattatgtctgaactagttaagccactaactacacaacagaaacaaattatggaatcccttctagctacttctcctacagaaaagcttaaagacgatttcagtaagtaccataagtcagtacttaacggtactaaagtaaatgaatctgctaccactcgtcaagcagttcagtcttccgctaagagaactcttgcagaaggtaaagtaatcactggcaaccgtcaggctattgttgaaagcgaagaaatgaccgctgacgatatggcattcctaaaagaactcgatgttctttctggtatcaataaaaaataaacattttaaagcattttaataatcaaatttttcagttctataaataatatcatactgaaaaacgaatataacatctttaaggagataataatgtcacaactactaaatgaatccaaatgggtagcagttaaagagaaactagttgaaggtctacaaggtactcgtaagtccgtaatggaaaccgtacttgataaccatcgtaaactaatgctaaacgaatctgctacttctggtgcaaccaccgctggtaacatcgctactctaaacaaagtgattctaccaattatgcgtcgtgttatgccaaccgtaatcgctaacgaaatcatcggtgttcagccaatgactggcccagttggtcagatccacaccctacgtgttcaatatgctgacaacgctcctggtgttatcgctggtgaagaaatgctttctccatacaaaatcgctaagtcttatactggtgacctaaacgcagacaacagcaacccacaagctgcccctactagccaactagaaggtactatgggtcgtcgcgttaacatccgtattctacgtgaaactgttgaagcgaaatctcgtcgtctatctgcacgttggactgttgaatctgcacaagatgcacaatcccaacatggtatcgacgttgaagctgaactaatggctgcaatcgctcaagaagttaccgttgaaatcgaccaagagctactaagccgtctacgtgcactacctggtgctgctgctgtaacttatgaccaatctaaagttactggtgttgcgaccttcgttggtgacgagcacgctgctctagctaccctaatcaaccgtcaagcgaacgaagttgctcgtcgtaccaaacgtggtgctgcgaactgggctgttgtttctccaaccgcactaaccattctacagtctgcaactacttctagttttgcacgtactactgaaggtactttcgaagctccaactaacgttaaatttgttggtactctaaacagcaccatgcgtatttttgtagacacgtatgccagcgatgtcgaggacattttgattggttataaaggtaatgctgaaactgatgctggtgtgttctattgcccatacatcccactaatggcttctggtactgtaatggaccctaacactggggaactcgtaacaactttcttaacccgatacggttatgttcagttgactgacagtacttcatctcttggtaacgctgctgactactacagcaaaatcgctatcaaaaacgttactttcatgtaattgtaatagatttaaaagatttaatcaagaaattaaaaacaatagggactcttcggagtcccttttcttttgtaaatatacttgtggtgtgcatcattttgtgatattattattttattgtaaccgaggattttaattatggcttcaaaattagatgaacaacattatgtggataagatacttaacataataaaaactaataacttaaacattgtatttcataaaataattaattttaaaaatgccaaaagtaatttttcatacacatgctgggattgtaagtcttctatattgtcatgtagtatagacaacttttcatcgagaaaaaaatgtcaacattgtggtataatgaaacaacaaaatggaactagtgtcccaaaaactgccagccaatacaaacacgcatgtttaactaggatagcaaatgagaacaaaccttgggaattcgtacaagtagttaaatttataggtaagaaaaaatccgatgttgaatttaattgtaaaaaacataagaagcatttcgtcttatcatttgatgaatttttaggtaggtttagtggatgttatgagtgtggtaaagaacgaacgatttcttccaaacgaaaagatgctaatgatataacgaaagagttgaagaaaattcatggtgacaagtacacctatgatgattttcagtatgacgaaacttatgattatcaccatactgaatgtgtttttggatgcacactacataaagatgtaaaaatacataaaaccctagcgaatttcagaaaaactgatagagaacattgtccagtatgtaacgaaagtgaaggtactatgcgtgagccatcaactttatatgtacaaaaaataactcacccaacaaaaggtgtattttataaattgggtgtaactaatgatatcaaccgtagaattagtcaacaaaaacattatgctcatactgaacacgatgttttgttaattgaggactttgaaacacgaagagaagcacaagatctcgaacaaaaaataaaaggtactataactaataaagttgttgaaaaagaagattttccagatggatacactgaaactttcaatgaagaagatttggatttagtactatccatgataaaagaatggaaaactaagtaaacaaccataaggagttgacacggatgttaactgtatacatttttaagaaagaagagtacttaaagagtcagtactcaaaaattgagattaacgttccatacgggactttagttggttatgatgaagctagtgaaactttgtattataatgatgatagactggactatagtattgattcatttattgaagacatacttgatagtaacactgaagatatgttatatgaagaatacttagataagtacaaagaacgtatgtcaaagttacatgctgatgctccagtactgaacatttcaaaaactccttctgaattcgagccacaaaacccattccaacgcctaattgatgctggggtaaatttccgaattacttgattaataaatatcttcatattactgatggagatattttctatgtcacagatatgttatgttatagtaaatgatgcatggcctgattatgttaagataggatttaccagtaaatctgaaatgacagaacgtttaaggacatatcaaactgctacaccttttagagattttgtggtataccatgaagtacactttgaagatgcacgtttagcagagaaagaaattcacaaaagactaaaacaaatgaacgcagtaaggcaacctaacaccgagtggttcaagatgcctaagaagatagcagcgaacatcgttgattctgttcttgacgatatggaaaacgacttgctatagtaataaatatagtatatattaatcattaaagggatttatacatgagcataagttttaataacccactggatactatgactagtactggtgctaatggatctttagaactaatagtgcttggtggtacaccaactaatccaagacctattcgttttaattcatcttctgtcattttaccagtacaggcattgccagcaggtgagcaaggtgctatggtatttgatagaaatgagttggtgttgaaataccacaacggtacaagttggattgcagtatatgatactgatacaattcttgaaccaatccgtatttcactcgatgaagtgaaccgtaaattgaatttaaaagttgaaacagtaacatatagtagtagtgctgtcccgagtgcgagcattagtggtacgaatttaaatattgtattccctactccatcaagtagcggtagtggcccaacaggtctttacacttcaatgaagcctggtgcaattacccagtactcattgacttctggacaaactgttgctagtattcgtgaacagatgtctggagtaactaatggtcaaagtggtcgtaatggtacacaaggttctccgtggaaaacttctgatggttggtgttttgctgatggaatgtggtggcaatgggttggtgaaaatggtacaatcactaaacaagttccaaatcttaaccaagaagcatacttgaaaggcattaccacatcaggcgtaactaaaactgatagtgtgattgcaagtagtgcatcaattagtggtactgcgatatcaattgctcaacttccaccgcactcatttagtttcagtggaactactggtgctgctggtcgtcatggtcatagccaagcactaaaaggtatggacagaagtggtcttaatgcgttaacatccagtaacgacaacggaatcccaactgtaattaataacattaacgaagcacctgatcacgtgcatagtttcagtggttctacgaatactgttggtagtggtcaagcacacagccacggaattagcaatattgacgtaccacactttaatgtggcatacttatataacattgcagagtcaaacgttgcattgagtgaaaaagttgcaaacacccgttatgtactgaaaactggtgatacaatgtctggttcattgactattgctaacagtgcaacaattcgttcgaatgatacttcattagtactttacttccgtaacgctactaatggtgaacgtgcagcaatttatcataattcatctaacaatacattacgtttgagaagtaatggtggttctgaagtttctatcaactcttcaggtgtactaacttccccatcgttagttgttagttctaactctgcaacagtttctggtaaaaacattgtacgttcagttaacggtactgcggcagatgcaagtggtaatgtaactatatctaccacaacaacttctgcgtcattgacacaaaatggctggcataaagataacaatactggtatgattacccagtggggatacttaactgttggtgacgactcttatgttactgtaaacttaccagttgcatatcctaatgcttgtttaaatctacaagtaactggtagagtatccagagcaccaggtaaccgtacttcatttgctggtcatggtaacattttaagtaactcacaaattgctgttggtgcagctaaccctggtagtgacggtgaccacaatgggctaggagtgtactggacaacaattggttattaaaaaatattgagacaacttttaaagtagtgatacaatgtagtcatcttacagaggttgtgagatgacattttttttcaaaacacatggagaagcaaacaaatggcaaaagctaaaaaagaagttaaagttgaaattcgtgacctaaatgatgaacaacgtaaacgtctaggtgatgcactaaacaacgcagtagtacaacttacttttattgacgacaccaaagcatcctatgcagatttcattagttccatctctgatgaactaggtattgatgcatccgatatcaaacaagccgctcaacgtatctacaaaggcgattactttgataaacaaaacaaactcgataacatcgaaactatcctaagtgttactaacaatttaccacaagcagatgacgattactaataagtactaaaaactaaactttatagcctccaatgaatgggggctttatttttaacttaataaacgtaaaggaatacaaacgatgtatatcgatgcttatatggaacgtaaacgtactggtgatattttgcacgtagcagaacgtaaaaacggtaaacgtattctacgtcagttggacccagtatatgaatattatgttgaatgccctactggtgaacacaaaacaatttatggaactaacgcaaagcatttggagtttgaaactcaatcacagatgaataaaagcgttgagcaacataaaaatgaaggtctacgtatttttgaaagtgattgcaacattaccttcaaaacgttggctagagaatacatgggtaaaggttcgccggatttgaacgtagcatttttcgatatcgaaaccgacttccataagaagtttggttatgctccaccatcagatccattcaaccgtgtaactgcaatttctctatatcaatcatggactggtaaggattatgtactgactttgccaccaactgatatggaaatgtacgaagcacaagatattgttcgtcagttaaacgaagaaactaacgaccctaacagtactgtcatcctttatacggatgagaaagaaatgtttatggagttctttagtctaatcgatgactctgatgtaatttcaggttggaacagtgaattctttgatattccatatatggtaaaccgtaccaagaaaatcttcaacgaagcaactactgctcgttggtgtttgtggaataaaaaaccaaatgctcgtgaagctgataactttggtaaaactgtagtaacatatgatcttattggtcgtgtacacttagactatcttgctctttataagaaacatgctggtcaagttgaacagtcgtacaaactagattatattgctgaaaaggtaactaaagaaaacaaagtatcctatgaaggttcattggataaactataccgtgaagattatattacattcttgcgttattctaagcaggatagtattcttctaaagaaaattgatgctaaatgtgactttatcaacctgcacaaccgtcttgctcataaagaatgtgtactaattagtactacaatgggttcggttgcactaatcgacactgctatcatcaaccttgctcacagtcgtggtgaagttgtttttaacaaagcaccgaaggatgattttgagttagatccagagatggagtactatggtgaagaaggtgatgaagaagatgagaaaatcagtgcaaaagctgctggtgcatgggttcaagatccagttcttggccttgttagcgatttgggatgtacagactttaactcattgtatccaactgtactacgtacacttggcatgagtactgaatgtattcttggacaacttcgtcaagactacactgatgcatatcttgctgctaaagtacaagagcaaaaagctaaatccaaatctaaagcgtttgaacctgattggaccgctgcatggcatggtttatttgctgctgtagaatttacaatggttcatgaaaaatctgacaaaactttgattgttgatttagaagatggtagttcgttcaatgcaactggtaaagaattgtatgatattatctttgctgaagacagtactattgtactaagtgctaacggaacactttttgataagtctaagtatggtgtaattccagatattcttactcaatggtattctgagcgtaaagcacaacaaaaaatggtaatcgactacaaacacatgtatagtgatgggtgggaattcaatggttctgagaaggttgaacctttgctatctaactacacaagtggtacaatgttccgtacaaacttacatgacaatgatcctgtttatctattacgtattgctattggtaaaggtcaatgggaagaagttgcaaaactcattgtggaaaatggtttagtactgaaagatggtcgtattttctgtgcaacggaagataagaattacttcaaacagcaaagtgcattctggaaacagaaccagcaaattcgtaagattcttctaaacagtctatatggtgcactattgaacaaaggttcacgtttctttgataagcgtttaggtcagtccgttaccttaactggtcgttctatgactaaacatatggcaagccgtatcaatgaaatcactactggtgtttataatcaccaaggtggctctgtaatttacggtgatactgactccgtttacttcagtgtaactcattacctgaaagaacaaggtattccatataatctttcgaaagaagaaatcgttgacatgtatatcaaaatcggtgatgaagttggtgaatcattcccttcattcatgaacgaaatgttcaatactggtattgagaaaggtaatattgttggtgcagacctagagatggtcggttcccgtggtctattcctgaagaaaaagcgttatgcaattctcaagtactgggaagatggtttccgtaaagatgttgatggaaagcctggtgaaattaaagcgatgggtcttgaaattaaacgttcagatacgccaaaatacatccagaacttcctagaagagactctaattgcattgctggtgggtgagtctgaagctcaacttaaacagcgtgtacgtgactttaaagaggtatttaaagacatgcctgtacacgaaaagggttcaccgaaaactgttaagaactataccaacttagaagcagaatatgaagtttctggtaaatgtaaagttggtcacgtattagcaggtattcaatggaaccgtctacgtgaagtatatgatgacaaaactgtacctgaagtaactgacggtacaaaagtaattgtatgtaacttaaaagataacccgatgggtatcaaagcagtaggttatccaattgactgtgtggaatatctacctgaatggttcttagaactaccatttgatacagagaaaatggaagaaatagttctaactaaaaaattagaaaacatttttggtattctggatatggatattggtattcatgagaaaagcacagcagccgttaataacggattcttcacctggtaaggaaaatattatgattattgcagacgaaactaaactaaaatatgacgaagtaaatgacgtattctctgatgaatcactagcactgtctgaggacagtgttaacgaggcgtgggaacagtacgttttatggagtgcatcccaaggagagtaatatggaaaatatctataagcgtgttggtgcagtactggaagatagtactatcgtaaattcagtacttgcatacaataatgatgatgaagttgttctaatgtctgctggtttcaccagaactggttctgttgaaattgacggtgagattgttgacgtctattctattgaaaagaaacgcaaagttgtcattgttgaagatgttaacacgttaaaagacttagaacatctacgttacaaattcaacattggtgcaggtgcaaacgctgataagccgtaccttaaacgttggaacacaaaatactgataaaaaattgagacaagcatcattcacgagatataatggtgcttgtagtaatctgaagcatacaaaaacatttttgattaacaaataaaacggagaattatataatggatctacgcaacgtactacgtgacctagttaacactaccaacggcatcgacttttcttgtatcgcagttagcagtgaagaccgtggtgatggacagcgtgtttacatggaagcatacaccgatgaccgcaccctagttatgcgtgctcacactaaagaagacgtaccagaagttcaaggtcgttttggtcttggtaacctaggtcttctacagggtctaatgtctctaaaaacttatagtactgaaggaactactatcacttctaatttgaaagatggtgcagttaagagcctagcattcaaagcagaagatgcaagcactactttcatggttcaaccagaaaaactaattccagcccagcctcgtttccacgaacaaccatatgacgtacaggttacacctagtgcagctaaagttcaggaactaaaaagcttctctggtgtgtttaaatctttcagttctctagtaactccatacactgaaggtgatactctttacttccacgttggtgagaagaataaaagtaaccacgttggtgcactagcattctctaaaactgaaggtgaactaggtcttggttttggttataacattgaccgtgttctacaagctctatcccgcgtttctaacgcagaatctgttaccctaggtattaccaaaactggtatgctaaacgtaactctagacactggtattgcggtatacaagatttacgtaactggttgctaatataaataatggggaacatggagttccccaaatttttgatttaaaaataagtaaaggaagacaaaaatgccattatatacatatcgttgtgaaaaagaagaatgtaaacacagtttagaaaagattgtaaaaattgccaatcgtgaagaacctcatgattgtcctcaatgtaatggtgagaagactatgaagttggaagtttttaccccaggtgataaaggtgcaaatctttatttccgtggtaaatggtttgcaaacactggaggttactgatatgaaaattaaaatgattaacgattatgtactggttcgtcaaattgaagcacagaataaaagtactggcggtattatcctaggaaacgttgaaccaccatgtgttggtatggtgatttcagttggtgaaggtaaagtactacctaatggacaaattgcagaacataatatttgtgttggtgatatggttgtatttggtcgttcatcactaaacactcctatcactgaagatcttggtggtggtgaagacacatattatgtgatgaaaattgaagaaatttttggtaagaaatcaaatggctaaaaaaaggtttattcctttctggatggtccccgctcattggggactttctggtaaagcgaaagagattgcgaaagcatactactataacgatgattatgaagctgatatgttagttgcagaacttacatatctaacaccatatgaagttgatgtagcacagttggatatcaaaaagaaatacaatgtattagaaactcttgattatctaatagcacaggcagatgtacaattgaagtattccaagattacccgtgatgagtataatgtaaaattacttgatgccaaattgagtactggtgcaattactcaaaaagagtatgatatggaagtaatcgaactaatgcctgatggtgatgacaaacgtcttaaagctatcgagtttgcatatcgttatgaagagattacacaacaagagtattcaaaggaaatctttactttacgtaaagaaccttggattgatttggatgtagtacttaatccagaaacaaatgaagttgaatttgtttttgattataatgaatacttttggaaaaagttaaaagcggaaggtcatccaggtaatgacgaagaagaaattattgacaacttcgttagagacatggggcgtaaactagctacggatgatttcagtgatgattatgacgtaaagctagtgaatgcgaacgaagggttagagaatctacctggtttacctgaagggttccgttcatacaaataaaaaaaggagagcaaaagctctccttttcttttatctttaatttattaaaccatcgctgggatgaatttgaatagtttgataccgaagtcaccagcagcatcagcagcttgggaacgtagaacaacttcagtaacaccatctttagcgagtagtggaactgcggttaggtcatcaattagtagacggccttcttcgatctcagtacttggaacgccttggaaagattgaatatctttatcaaatacgttagcacgttcaacgaggaaagtaactactgaagcactagcgatatcaacagacccaacacttaggataccgtcagcagcgttggtaaaaccagtaactgcaaatggctcaacgtcgttgccagcgatttcggaagtagcgatgataactgcacgttgttgaacaacatcaacgatacgtttaacgttagtttgtgcagcgtaagcagcgttataatcagcttctagagttgctgcttcaaatggagtaccatcgatacggatgatacctttttcgtttagatatgcaacgatttcatcagctacgtcagtgtttaggaaacgttgtagaccagcgaaagaaccaactgcaccagtaacacgcacgttaacattaccaattttactaattgcgatagatgctagggcgtttttgccacagaagtaacctagaattttatcaaaggaataaccattgatacgttcaaaagaagtattagtattagacatattgtagtccccctattatagttgtactggtagagcagcacgaactttaattgcaacagcgtcagcggcagcagcatcaccaacaccatcagtacctagagcaacataagatttggtacggaagaatttagcttgtgcaatagctttagctagttcaacagttggatcaactggaacagagtaagcagcacctgggcgaacttcttgtttgtcaaatacgtcttgacgttcacagatgaaggttagagcaacagaaccagcaccacctgtaacatcagcaccactagtaccaaacgcgattacgttaccaccaacggttttaaagtcagcagggataacaacagcggtgtctagagctagtacggaagtagtaactagtactgcacgttgttgtagtagttgggtaatcatgaattggttgtattgagcattgctgattgcagtttgtagtgcttcatcttgaatttcggaaccgtcagaagtaacagcggtagtaccaacttcaacatctgctggtagatcaacaacgatggttacgaaaccattgttaccaccccagtattcacgagcagtagcagacataccatagttacggttaaaagaattaagactcataaaaatctccttgtcaaattttgtgcaggaacaccctgcttaatattatttatcaaaaaatataaaccacatttaaatttaaggcaatattccctgatctctatgatattatttatcaaatctgggaaagtgattaaagatgtgctataattatcaacgaaaatggagttttttacatgcaacacacgttcaccgagaaaaggattttacgatgaaaaaattatatctacttgttgatactcaaaactgtttccaccgtagtattaacgtttcttctcaaagtattgatatctggaccaaggtaggtcttgcacttcacatcactttgagtggattaaagaaactacaagaaatgttcgatccacaccatgtagttttttgtgcagaaggtaagtcctggcgtaaaaaattcgacgaagattacaaacgcaatcgtgcagtaaaagcggcaggtcgttctaaagaagagaaagaagaaatggaagtaatgtttgaaatgattaacgatttcattgacttcgttgataatcaaactaacagtactttactacgtgctccatcagcagaggccgatgattttatcgctcgttggattcaaactcacccagaagatgatcatatcatcgtcagtactgacaccgacttccgtcaactactagctttcaatgttcgtcagtacaacccagtacaagaaatgatgtatactactactggtgtatttgataagaacaataacccagcagaagataagaaaggtaatccgattgaaacacctaaccctgagttcttgctattccagaagtgcatcaaaggtgatacatcagataacgtattcagtgcttatcctggtgctcgtatgaaaagtacaaagaaagctgttggtattgaagaagcattcaatgatcgccatactcgtggttatgcatggaactcattcatgaatcacaagtggacacgtcatgatggtgttgaagtttctgttaaagatgcatatgctcataatcagatcttagttgacttaactaagcaaccacaggaaatcattgaaatgatggatgatgttattttcaaccgtgaaccaaaaagtactcctatgattggtgtgcattttttacgtttcgcagcgaaatatgatttagttcacgttcaacgttcacctgaagcatacgtgaaactattcaccaaaaaggatatttgatatggcagtactaaaaaaactaactgagtattcttatatagcagaatctgatggttctgaaaagattggaatacttattgaccacagcaaaagccccactgagtatagtggggtggaattcttcactagtgatggtgtactgaaatttgattctataactgaattggaagagttacttggaacaccattcaagtatgaggaagtacaagtcaaagacaccaatactaaatttattggtgactatccagttaacgatactgatagtgtttatgatgtacaagaaggcgagaacggcattagtactttccgtaagagtgaaaaatctaagaaacgcttcttccctggctggtggcttgttaaatcagaaagtggggtatacaatcctcgttgtactatcagtactgatacgtatgacaatcataaagatgatatctatggtccatacaaaacatttatggaactaacgtatcaacagaaaaacttgtaaggagaatggggagtactttaacgagtacttccctttatttgttatgggcaatttaataactttcaataaattaactaattatgatagttcaactatctttgaaagaatgttagaaaattctgataattcgtatgtggcagtagttccaccaagagttggctcttctgaatcaatttgtgcctatgtactgtacaagattttaaattcaagtgaacgtccaagtattgttttatcgacaccagtttcgtttaaaaccaataggcaatcaatgaattattattttgaaagtatgatttcaaatattaataaccatttagattcaaatttgtcaatcatgcatggcacatccagtagtactattaaatgtaaaggtacttttattggtgaaatattatatagagcgttgtcaggtgataacttgcgaggttttggtagaagtgaaattgtaattgatatgtcaacatatatgagggatgagcatttcatatctatgactgatataatgagatatactcataatatgaaagtaataataaattctcgttcattgtcgttctttacattgttggatagattgccacaagtagagtatatcccgtttttcttgcattctagtattgatatttttgaatatcaaacagcaatgctaaatacattaggtatgaataaatttgaacaatactgcctaatgaaagggaaatatgatgatagacaatttagacaactatgaagacgaacaggagtatagtcgaattaagaagcctggtttaaaaatagagtactctgtttttgaacaggatgaacttgcaaaatgtgcggctgacccaatttattttatggagaattacttttacatagtaagtaaaggtggcgaaatactttttaaaccttatgattaccaaaaagaaatggtaagaaacttccaaggttacgaaaacaacataatgctcactgcccgtcagatgcggaaaaacaaccgttgcagcggcattcatcttatggtatgctatgttcaattcaacaaagacaattctattgttgggtaacattttagcaacagctaaagaaatcatggaacgtattcagttcgcatatgaaatgtgtcctgattttattcgtgatggtgttgagaagtacaacgtaacagaagttcgttttgaaaacaaatcaagaatcattgcacgtgcaactacaccatctgctgcccgtggtctttctgtaaacttactttaccttgacgaatttgcattcgtaccagaaggtttccaagcagaattttggtcagcagtatcacctacacttgtatcatctaagggtagatgtataataaccagtactccaaacaccgaatatgaccagtttgctagtatttggaatgagtcacaacgcttcgttgatgaaggtggcaacgagtacgatgaagatggtcctggtataaacgactttaaaggtattatggtacgctggtcttctcaccctgaccgtacagcagagtgggcagcaaaagaagagtacaagattggtacatctcgatttaagcgtgaatataactgtgaattcgttacatatcaagaaactctaattgatggtattaagttaagtgaaattaagaaacgtagtgttcgtgatcctattaaagaaacggatgatgttaaatggtacaaaccaattgagtacggaatgacttatgtagtaggtcttgacccaagcggcggtactggtggtgatgatgctgctattcaggtatatgaattaccaacattacgtcaggttgctgaatggaaaaataacaagtacttgattacagatcaggtaaaacttttaagacgcatactccttcagattgcatatgaaatgcaggagatgggagctaggaatatcgagaacagtttgttctggacattagaaaataacagtataggtgaggcagctattcttgcggtacaaacattaggtgtcgaaaacttccctggtacattgataaatgaaccaagaagaacacgaactggtcgtatccgtaaaggtatgacaacaactaagagtacaaaaaagactgcttgtatccacatgcaaaaactgatggaaacgttccgtatggatgttgccagtcagtatcttcatagacagcttaacgattttatacgtgctggtactgaagatggtgtgtttaaagcaaaaatgggttgcaaagatgacttggttagtgctacacttcttgtcgttcgtatgatagacattatatccaagtttgaagaaaacactgctgaagttattggagaaactcttgatgaattagatgagtcatattttatgcctctcggatacatgatgagttataaccgataaataatattataaaaaatgaaggagacaccgctatgatgaaaggggttctttgttcagacatttataagattttggcagcaccacaatacgaatatagtattacaatgtttaatgatgatggtgaaggtacgattagtccacaagatgcaaagtggttttatattcgtccagtaaacttcatgattcaagcaccaagtggtgatgacacggtacgtccagaagtatatctatggaaaagtactgatataaaagatgaacaaacattacaagttttaaaacgacttaaaaacgtttcaaaccaatatggttacggtttcactgtatatgactttggatctgggaatttacctaaaaagttttctcatatcgcaatgcgtaatatggaagaaaccaaacaaggtgatttaaccgagagcctttcaggaagtgcaatgcgttcttattacaaactaccacgagctaaaatggttgttgttcataagagtcgtgttgaagaaggggttaagggttcccgttcacgaaacgtaaaagaaattttcgtggagtccaacggtgaacgtagacgaatgagtactacaaatttacatgctgcaaaagcaatgacccatcatttaaatgagggtggcgagtatggtgataaatttgggtcttatatagaaggttcagcacgtgaccttgaaaatctaaaagcgttgctatcagaacttgaaattggtggtcgaagccattatgcttccaaaactatgcaatacattaatgacttaaaaaataacttaaaactcgctggaactccacgtggatatcacgcccaattagggagacacaaggaactaccgagaattggtaatacatatatagataattttgcgaataagttaggaacgattggctccgatcatgaccacaatagaagttttgctaagtattttctacttgatgagtgtaacaagttagctgattatttaaatacgattagacaaaatatcagtactgatgttcctgatcctaaagaaataacacgaagtgcaaaacgtgtatgtttgggttgtgtgccagttgatggtgaattcgaatttggtgatacaccagatgatgaaaacaaagtccttatgtttggtaataaaatcgtggatttaatccaagatggtattattaaggacgcagtacaggggatatgtgagaaaccttacatggaacctgctgatgctaaatttattattgcacttgggaattcacttctaggtaataaacctaagaagcaaattcttcttgaacctgaacttgaatcactaaaggaatgggcaactggtaaaaaaagcgagacagacaataagtaggtgatataatgatgtttgtcagggcaatgagccttgacaaacagagtaaaaaaaccttgggacggttaaaaatcccatgatataatgtaaattgttgatgagtcaatgaagacaaatcaacgttaatagcccgttaaacttaacaaacaaactaatgacaaggaagcccaatatgcaaactctagctgaaattcgtgcaaaactaaaagctgaacaagaaaaagcagaagcacagaagaatggtacatttacaggtgaacgtaaagccgattctttcctagctttctggaatgtcccttacaatgaaccactaaacctacgttttctaccagatgctgatgagtctaacccattcttctggcgtgaacgtgatatgatcaacctaacgttccaaggtattgttggtatgcacaccgataaagttaccgttcaagtaccatgtaacgaaatgtgggttcctaaatcatgtccaattcttaaagaagtacgtcaatggttccaaagtgcgaatgaaactggaaacgaagaactgaaagcaatggctggtcgttactggaaaaagaaaacctatctaatgcaatgtttcgttgctcctgatagcgtagcagtaaaagacgatattgctccagaaaacccaatccgtcgtattctagctaacaaagatatctttgataaagttaaatctatcctgctaaacccaggcatcaaagaactaccaactcactacattcacggtcgtgactttggtattgttaaaactaagaatggtggtggttacaatagctatgacatgtctcaattctccatgtccgagcgtccactcaatgaagaagaactggcagcgattgaaaagtttggtctatataatctaaatgattttatgccaaaacaaccaactccagaagaactaaaagctatcgaagaaatgttcgaagcatctgttgatggtaaaccttatgaccctgcacgttgggctttcgcttaccgtccagcaggtgtacaaaaaccaacaactggtactattagtgaaaacaaacctgctccacaagctccagtacaacaacctgctcctgcacaaactcctgctccgcaagcaccagtagctactcctactcctgctgctgaaccagtagctgttgcaccagcaccagtagctgaagctccaaaagaacaactttctgcatctgcactagttgctcgtttgaaacaacaaggtaagtaatagtatttgaaaagttaaggggcaacggagtttgccccgttttatttcataaaattcaaggagcgaattatgaaaatgacaagtggttttgcaaacattctaaaaaatagtactggtagcgttaaaaagaatactggtgttagcgtaggctttcatgatcctgatacatggattagtactggtaactttgctttgaactatcgtattagtggttattttgaccgtggtattccactgggtaaagtaacaatgtttgctggtgaatctggttctggtaaatcatttatcgtttctggaaacatcgcccgtgaagcacaacaacaaggtatctttgttgttatgattgattccgagaacgcattggattcagattggctacaagcactaggtgtagacacttcagaagaaaaactactaaaagtaaacatgggtatgattggtgatgttgctaaatttacctatgagttcatcgaagggtatcgtaaagaatacgaaaatactcctaaagaagaacgtcaaaaagtattattcattatcgactcaattggtatgttgaatactgaagttgctaatgaccagatgaaagctggtaacttgaaaggtgatatgggtcacaaacctaaacagcttaaagcttacatcaccaactgcgtaaactcgattggttcacttaacattggtatggtttgtgtaaaccatagttatgaatcccaagatatgttcaaccctgatccaaaagtatctggtggtagtggtttgatttatgcatcttctatggttatcgcaatgggtaaactaaaacttaaagaagatgaagaaggcaacaagacttcagatgtaagtggtattcgttctaaatgtaaagtcatgaagactcgttacaacaaaccatttgaagatgttgagattaaaattccttgggataaaggtatggacccacgcagtggtctactagatatgttcgagaaatatgaacttatcgttaaatctggtaaccgtctaatgtacgttgatattgacactggtgaacagattctaaaatatcgtaaagaatggatgcgtaatgaagattcttgccttgatttagttatgaatcaattcaaacgtcaccctttgattgaagaagtcaaagaagaagaaaaaggtgatgaatcatttggtactgatattggaagtagtgaggaataatgaaaccttggcattggatcatcaaagatgataaatctaaaataatcgacatgattgaacacttcgaaaaagaaactgaagaagctcgtcgtgaagttaaaaagattggcatcattgaaaagattgctcaggagattccaggctggcatgagactcgtctcagtcagcttcaagaactagaagcggtacttgaaatgctagaaattgaaatgcgtcaactacaagcggaaaagtttaaatatttccttgaagcatatcgtcgagcactatcatcttctgactgtaaaaagtatgttgaaggtgataaagaagtttgtgaattatccgaactaataaatgaagtatcatatatccgtaatacgttttccagtattgttaaatccttagagatgaaagcttttcagttaaacaatattgtgagactacgtgctgctggtattgaagatgcacgtttagaataactatccataaggacgcattacgcgtcctttttctatgcgagaataaaatgacaaaattagatgagttcctatcaaacgtatcagtactagacaccgaaacaactggtgtcgaaagtgaagatgatattattgaatttagtatttcatatcctcacgatgcacatgagaatattgatactattgataactacactttgcgttataaaccactaaaagatataccaccagaagcaagtgctgtgcattttatcagtactgaagatgtagcaaactgcattggttataaagatgacttagaaaatatcgacgcactcatggggtgtcgtgattattttattggacacaacgttcaatttgaccgccgaatgatggtagataacgaatataaatatcgtaactcagtttcgcagtacttgctcgatgaagataaatggatttgtacccttcgtttagctaagaagatgtttgcagaagacactgaattcaaaaacttaactctaagttatttgtggtataaatttggttgctatcgtgacgtacatcgtgcagtgaatgctcatgcagcaaaagatgacgtattcatgtgttaccaagttctaatcaaattgattgaagttgctattgaacgtggtcatattgaccctaatggtgacattggtgaacaaatagtaacattctgtaatacaccaatgcgttataaattcatgccattcggtaaacacaaaggtgaaccaatggaaactgttccattgaactatattgaatggatgattactaatagtgatatccttgatgcaagtaacccaaactgtgataaagatttagtatatacatttgagtacgaatataatactcgaactaattaataaaggtattcatggatgaaaacttgtaagctaaccttactggacgaggttaattgtaaatttgagggactagatccctcaattcgtcagaagatgattcgtgcaacagaatatgtacttccatacgctaagttcacccctgctggtcgtattggtcgttgggatggtaaggtacagtttatgaacttaggtggcagtacttactaccacatgttggataagttgttgccaatcttagatgaagcaaaaattgatattgaacttgaagatcatcgtgtcaattatggattcaattttgaaccaattgatgaagatatttttagtgatgttgtgtttggtgctggacaccacatggaaggtaagtcaatcaagctcagggagcatcaggtgaacgcagttaatgcttgccttgcaaacccacatggtttattattagcagctacaggggctggtaaaacgctcatcacagcggcattatccaagaaggtacaggagtatggacgttctgtgattatcgtacccagtactgatttggtgcagcaaacatatgatgactatgttatgtgtggtctggatactggtgtgttctatggtgcacagaaagactttggtcaccaacacacaatcactacgtggcagtcattcaactctttgtggaagaaaacaaagaaaggtgaaattgaactgaccgaacaagatgttcatgactttattgatggtgtggtttgtgtgattgtcgatgagtgtcaaggtgctggtggtgatgcattagttcaagtactctctaaagttatgaataacgtaccacttcgctggggattaactggtacaatccctaaagaccaagttgtcgctgcgaagattaaatgtaacgttggtgatgtgatatttaaaatcacagctaaagaattacaagataaaaaaatactaagcacatgtaatgtgaactgtattaaacttaaaagtaatttaaagttcgcgtcatatgcagaagaattgaagtacttagttactgaccgtgatagaatggcatatgtagcatcactgataggtgcgttagcagaatctggaaacactttagtactggttgatagacttgaagctggtgaattgctttgtgaatttttgggtattcctaagtcagaatttgttcgtggggaaaccaaaaagaaagaccgtgaatcttcatatggtgaaattcgctgggctgataacaaaatactcattgcaacctatggggtagcaagtactggtatcagtatttctcgtttgtataatgtcgttctaatcgaaccaggaaaaagcttcgttcgtacaatacagtccattggtcgtgggttgcgtcgtgcagaagacaaagaccacgtggaaatctttgatatcagtggtacaaacaaatatagtgcaaaacacttacgtgaacgtttacaatactataaggaagcacaatatcctcatagtatcatagatgttaaggattgggaaaatacagcgggataatcccgctgtacatgatataatgtgtcgtatgacaacaacaaggaagtaaaataaaaatggaattaagatctagtattgcttttatctgtgaccaagaaacgttagatgtaattgatgtattgttgaatgatgatggtattatggatgacatggtatcttcacttgactatatacctgaactagaaactgacgatactaatgtttggagatgtaatattgacactaattcatggattaatatctatgaattgcaaaccagaattgactcgaaagttgaatcattaaaatatgatatcatctatgcaagtactgatactacaacgtttattgatgttgttagtcttagtggtaattttgattcttacttagataccgatgttgataagattcaagaaatgtgtgaaacgtatggtcttgaattctatggtacatccgatgaagatgaagaagattactacgatgaagatgaagattcccagtactaaggagatgagatgaacgtattaaccccagaaaataattcatttgatatggatttagtaactgaacacattccatcagaaatgtattgtgttttagatttgagtccaaacggtgactctgacttttattttcgccacattttgaacactgtatcatttaatagtatcagtgctgatttgcagattggtgaaaaggttatccaagtaccattgggttggcaaatcatgttgggtgatgaagagacgggtatggttgagatgtgtaccattgaaaacattcttaatatgaaagaaccaaaagcttttgtttacaatccaatccgttcgatgtatcctaagttcgaacctgtaaaagtactgcgtgtattcgcactcactactaagtggcagatccctatgctgcctaagaagaacttactatgtgttcctctgcacagtggtgataatccaccttgtgtttactttgcagatgagaacgagaaaattcaagatttgtatctaggagtgtaatagtgttagatttcagtaatattaaagctaagtcagtagacgaaaacgataaaccaacccagcatacattttctattgctgaatttctaaaacatattgaccgtgcagattacaaatactataatgacatgaccgaagatgagcgtaaggaatttacgccttatactgtacttcgttgggtaagttcacttgatgactcacttcaagtaactttccctagtagtaaagtggaaaacgtatttggtaagtggaaagctggtggcaaagaagcactcactgaacttgtcaaagaactcaatagtactggtgttaatgtaacatcagttactaagtactgtcacagtgactatgattggcgtatcaagtttgccgtacaaagtaatgatgatgctaacaagttgattgcagcaatgaccgaatttagtattgctggtggacagattatctcattggttgacagtgacgttgtacgttatcagttgattatgttgaatgatatggttaatgatgggttctgggatatgaaagaacaccctgaacttgtatatcaactactatgttctgttcatgatatgttgggtggtaaggaattgccacgaaactggttaaacttttccaagagttttaagcgtgctaacaatgaattatttgaactcattaaaagtacacagccagattcaatcgcaactcaaatgaacgaagatgaatataaaattgttttgttgcaatataacaaaaaaacattcgagtctttccttgaagacataggtttgcaagagaaagaaatgaaatcaatgatgaaattatttaaagaagaatgtaagaaatatggcaaagaaatcaagtagtcccgtatacaaatgtaagttctgtgataaggaatttaaacgcgaagacacagttaacacacataagtgtgttaaacgtgaccgctacgaagatcgtgatagccgccccatgagggaggcttttcgcatttatatgcaattcatggagttaaaccatttccctttcaagaagggagttgaaccattaatggcttttataaaatcaaagtactttagtgatttttatgattttgcaatttattatttgaacaaccgtgatattttagatattgatggttttgtaaaaagtctaattgtaagaaaccgtcctattatggaatggagtacttataaagcaaaggatgaatggatattagattgtattcgttctgaatctcccaatgctgcggtttcccgtagtgttgttgcgatggtggaatggggtcagaatctgaacttggagtggaataagtttttttccaatgttagttctgcccgtgcaattgcatggattgagagtggtaagatttcaccttggattatctggttagcaccaaaagaaagtactaataagtttttcaagaatctctctaactctgaaatcgagtatatacttaaatacattgatcctagttactttgaggttaaaactataaagtacaaaaaggaatgtgatgaaataaaaagtatgctacgtgaggctggattatgaatggaaaaagtatatataataaaataccagaagggtatgtacctgtgccaaaagcagataaatctaaatctttatcattgcttagacagggttctataactgaaattacacttgatggtaaaacctttcaggtgcacgatcctgttcgtgtagaaaaaattatcagtatggttgaaagacatgaggaaagattctttggtctaagtcaagagttgtcaaagaccaaacaaaagtgtacaatgttagaaaatcaggtaaccaaattatctaacactgtaaacaaattgcaggagcaaatcaaaaatgcaggattcgacaaattctaattcgtaccgtaaagcacgaacagatatcgacattgacttcaaagatagtaagtcagtgattgcacagcttccttgtgtgcgaagtacagaaaaaattacggaggatggtttaatcccccataacagtggtgttcattttgataatataccaattgaccctatcactggtttagccagcatacaatataaagaagccgaacgcttgggatatcaaaaggtagatatcctgtcacaatcggcttaccagtatgttcgtgatagagcacatttaaaagaactaatgaatcaggaacctaattgggatcttctgttagaaccagaaatagttgaacatctttcacagattaaaaaacatgttacattattaaatgtgtggaaacctaaatccattgatgaacttgcaatgtttattgcaatgattcgtcctggaaaaaggcagtgccaaagtatgaatacatggagtgaagttgaatccactatatgggattacagtactattggcacagaccaagcaggaaataagttacgatatttcaaaaagccacatgcttatgcatacagcttaatgattgtagttcaacttaacgctttagttgaacatcttacttcttcttaagagccacattacgacgcttgatgcgtttttgtggcaaatcacttaaagaaactactggaccacaaacgaaattcaccgcaggggtatcgaatctctgtgtgtaaggttcaaatttctccatctcttcttggaagaatagacagactggaattgacctgttgctttgccaccaccaatcatgtgctatacccaacaattcatcttgcattggttcatccatatcatcaaagcagtaaagagtagtatactgtttactttttatcttgataataccaatgaaagttttaccatcacactgaactaccgtgataaatggtggaatagtattatattgattcatatgagttccataaatattagtataaatttatacctattatttatggaaggaaaaactatggctcatcacggcgtgtttatgtacccttataaccaagaagtatcattgggcaattttaatatgccatatagcaatgagaaacttacaatatacagaggtgcaaataacaatttatcattcacagtgcataacgctgatggaaaatatacattactaaaagataacgaatatctaacattcatgatttttgatgctagaaacaatactaaattattcgatgtagttttggataaacaaaaaccatcatggctatcagaaagtggacaagcaagacaaacattaggtaatagtaaaaaagtatattatggatgtattgttcctgctggtgtaattcaggatactagtcctggttcaaaatatagatggagtattactaaagtaacaatggatggttccttgattgaacctacacagtacttatacactggtcttgattatgaagcctctgctgaattgatcatttccgaccaagctgctcctgtgtttgtgccaagtattgaagtatctgttaataaaaacccagcatggactaccatcaaacgcttgtatcatgaaccaatcgctcgtggcgttattggtgaatttgatataatggcaacatctccccttcctgcacaaatgcagtacggattagttgatggtcttagtactattgcaatgtactttgataaattcattggtagaattcaattacaaggatgtttgtgtaataacgtaccaactgataacgaaaactataaatggtttattgttaaattggatggtaaagaatatatcgaaaatgatattgatgaaaatggattccctaaagcgttagatgggattcaagcatttaattttaaaggcaattacatgtggttgcgattggttgtttgtattcatcctaagatcgttccagttccttatgactatgcggcagtaagaaaagtctatgacccactactgtcagttcctaaaattttgattcgcaggtgagacaaaacaagtgtttgtgctataatcatttgtgagaaataacaaggattaaattatgaacgctgtacaaaacatcatggcacaaatcatgaatgacccagtaccaggaattggtatgtggacacatcacaattgtcctgcttgtgtgttccgtggtcattcacgccccgatactaaaaatcgcggcaatcatatgtttaacgcagatggttctgtttcttataactgttttaactgtagtctaaaaactgggtggcaacctggaaaatatatgagcaaagatatggagtctttgctcatttcttttggtgcacaggataaggaaatagaactagctaaattttacattaaagaaatggttgatagtggagactttgccgaacaagaaactactgcatctaaactatatcaacgtgtaactgttcgtgaattaccaccgaactcaaaaacattctgggaatgggcatcgttaccagaagagcaaataccacaagaatttattagtgttctgaatcatgtgaatgagcgaaatccatatctattagatttagaattgtattggagtccagctaaagaacataaaatgtatgaccgatttatcataccatacgttatgaacggtaaaattatcggatatactgctagacacaaacttaaagacccaggaagtacctatcgttttattaatcaggtcagtactaatattctatataattatgatctgttacaagatgaacgaattaaaactatattagtttgtgaaggtccaatggatgcagcactaatgggtggtgtttctgcaaataactttaaattgtcagcagtacaaatagatgtacttaaagctgcacaagaaaaaggtaaaaagattgttatcgtaccagaccgtgataaggatgggttacaaacaatcgaacaagcactagaatatggatttagtgtttctttcccagattttggggcagtacgtgttggaagtactatacgtcacattaaagattttgacgaagcatgtgctagatttggaagattattttgtttacaactgatacatgatagtatagttgacgagcctttctatattaaagcacaaacggataagtggatgtaacacaggatataaatgagggaacataaatgattcaaagcacagtggacgtcaaacagtatgggattaatgcacaacaatacttactatcccaagttttcagtaatccagatttatttgtacgttgtaaaaatattctaaagccagaatattttgataaaacatttcatgaaagtattcagtacgttcatgattatgcagcaaaatatagttcatcccctacactgaaagatatcgaagtgaaaggtggttatcagtatgatcagtatgaagtacaagaacttcataaacaggcagtactggatacctgtagtgagttttgccgtcacaaagctctagctctagcagtagagaaaggtatggaattagtacatcagaaaaaatatggtggcatcgaagaactcattcgtgaagctatgttagtatctgtacagaatgagttgggtcttgatatctttgaaaatccagaagataccattcgttcattgagcactatgcaaggttcattcaagagtggatgggaaacccttgactataaactattcggtggttttggtcgccgtgaacttgaaatctttgcagcagcgtctggtggtggtaaatcagtagtactacagaacttagcagttaactttgctaaggctggtatgaatggtgcatacatttcactagaactagcagaagagttggtagctgttcgtatctatggtatgatgactgaatctaagctaagtaacgttaagaacgaagctgaaaagattggtctacgagttcaaatggaaggcaaggatagtggtatattgcgtattaaacgtttaccagaatccgtaacaaccactgatgatattgaaagttatcttcgtgaattgcaaattaaaatggaagtcaaattagattatgtttgtgtggactaccttgacctattaacatcaaatcgtcttggtcctaatgataaatctaatacatttacaaaagataaatttgtatctgaagaattgcgtgcactagcaaccaaaatggatttgaccgtattcactgcgtcacagtttaaccgtagtggtatggatgaagataagaaaagtcaaagtcagattgctggtggtatttctaaaatctatactgcggataacgttatctacattgaagcacgtaaagaaactggcgaactttggtttgacttccagaaaacacgtaacagtagtgcagttggttcacgtttgcgtatgtcttacgatattgattcacttcgtgttttagaccatgcaacaacaatccaacaactagaaactgatgggtcaggattccgtcacagtggtgtctctaaggttggtggtggtaatatggcaatgccaccaagtacgatgcaaacattgcgtcatacgctgtctggtgctcctaaaccaagcactacatcaagtgttgaaagcgtaacactaaatacagatagtgatccaatcacttctacacaaactgaatcccagcctcaacagcctcacattggtactgatcgtgtaaatgcaatgaagcaatggttaaatcaaaggaaataatgaatgtctagtaaatccaataaaaagaatctacttgatagtatagttgactatacaccagagaaagatacgttacagagttttggtaatcgtgcagatcatgcaatcaactctgttattcatttattggagagtatcgaagatgaatttaaccaaactgatgctgaagatttgaagaaacgtttatttcttagtattaagaaccgagattataaaaagtttcagaagggcttggagaacatagcacttgatgaaaaacgtaataaagggaattgatatgaagaagaaaactaaactaaaagaaaatgcttctgctggtgcaacatcagcaggtgcagtagcatcagtcagtactggattaaattacccattacttcgaagaatgcctcctacaaatttctttggatataaagttgttgagactaaaaataaggataaggaatgaaaccatatactttctacacaattaatactgttgtagatataggtgatggtacaactccaacaatcatcgattctaagttcactggtgctatgaatttgtcgagattgttggaggctattatggtacatgattatcccatgatggtaagtgtagtaaaaactgaaatagacctatataaagataacaacgcatctttctataatcttccagtttcatggggtaaatgtactcttagtactttcaaattcgcaataccaatggatgttgatttgcgtttgaatggaataccattagttttacctacagaattaaatggtaaaagaattacaaaatttatcacaacaggtaatgatacaaatattagcatcagcaaacagaccttttcttaattgtgataaatatcataaagcaagacagaggtcttttttattttatatggagtaattatggatataaaccaaacagcagcggagctacagaagtttgctgacgcacataatttgaatgttgatgtttctgttgtactggataatatggatgcgggtgatttcatcacactaaatgccgctatggataattcagataaccgtgaaatttttcaaattctacaaaagtacaaagcacaaatgagtgaaagtttctcatacttcagtactgacaatgtaactaaacatattgttgaaagttctgattggcataagacagttgattctatgacaatgaaagacttagttgaagcatacaaaagtaacttcacatactctgatgtttctaagttgagtattcaagaattaaaaactattgtgtttgaagatttatcctctaatttggaaaatccagaaaatcaattaaaatctacacagattgctaaaatgaatgtgtcacagcaacaacagcaagtgaacccacaaacccaagcaaaacttaaacaagcagaactacaacgtaatgctaataacattaaagttagtgttcctggtagtcaaagcggtactgattcaattgaaccagttgttggtattgatgctggacaaaatccacaacaatcattagtagtaaccaaaagtggcactaagccaaacgaattgaatgttttccctttggatgatgtaactccagttgacaatcaaaatcaaagtactacaattcgtgaagagaaatcaccacaagaaattaatagtgaagttatgggtgagcctggtatggaaccagacggtaatccaaattcaccatctccactaacacaacacgcaccaggtatgggtgaaatgattcatgcaatcgctgatatcgaaaaagaagatgatatctatggtgatgaaagtgtaatggcaaactctgcacaacaagagaatgatgagatggtagatcaaatcattgatttctgtcaccgtatgcgaggccgataatgagaactgtacctaatgttcatggtcacaacactatggtttccaacgaagaatacagactattacagaaaattaaggcacgaggttccgtgccagttgaaaaagtaaacgaatactatcaggaactagcggataaaatggtatctcgtggagtcctaaatattgttgagaaagatgacggtactgaagagtattcaactgttaggagtaataaatgaattacgagtacgatcaacaatcagttaatcagatggctgatttgttaagcggtttgaatgacattgaagctggtgcaacccataatgcgtctggtgttccttacaagtcaggtggtgatatcggtgcaatgaccgacatattgacatcattaaatgaagctggtatgaattatggtgttgatccagaacagacacatccacatgttgttccattccacgccccatacaatgaacacatgcttggtcaccaaccagcacaacctgttgtacaacgtgcacctgctaaacctaaaactaactggagtttagtagaagaaaaaattcaaggtactaaatcaacaaaagtatacagtgttaaatgtaatcatagttctcaagttatcatgaataatattatgatgtatgaagctgcactaacactagtaaaccttctcaacgaaggaagaatgttgacagatgcaaaagttcttggtatcatcagttccggtttacaatacaccaatgtaattaccgaagcattgaaggctgcacagaaacgtcaacgtgttctgaatgagtcgaagtacgatgaagcaaaagatttagatatcatcatcgctgaaaagaaagctgaagcatacaaactcaaagagcgtgtactgaactttctaaagagtgaaggttatataaagtaaataaatttagtgatattttataaggaaattcaaatgtctaactacaaaaaactaatggaatctgcttcacgtgttgaagcaatgaagttcatcaaattgaacgaatctaatattgagaaagctgaaatcgttctctctgttaaaggtgaaatcgttgacaaactacaacgtcagtctgaagtaatcaataacatgggcgttgacgttctaggaccactacttgaccgtatcaaagcggaacaaggtcttgatgctgcacagaactttagtgatagcgttcgccacctacttcaacatgcagttactactctaatggatgttaaagacaaaatcagtactgaaactttaaaactaactggtgatatcactgatggtccagcagtttctgatattggtagtgaagatgttgatatcgacattgctgctgacaccccaacgttcgacatgggtgctgatgctgatttcgaagaagatattatttctgagccagtaccaactgagcgtgaaatgaaagaatctgtaaaaccaactcaaattggtattaagatggaaagtgttcgcggtactgtaggtactaaattcttcaaaaacaaagaagaaatgaaaacttggctatctgagaacgagaagaaagttaaacgtgtactaggatacgttaaaaaataattaaggatgaatctaaatgagatttcaagatcttacagaagaggctcctggtaaagacatacgcaatatgattactactattgcgttgtctttagtatcatcgggtcgcgaagaagtgaacctacaatctttaatcgctgaaatcaaaaagcgaaccaacattgatgttccttataatgttatgatggatattctaaactctttgccatttgtgcaagatgcgaattcggatgttgtaacatttactggtaatgattcagaaagtactggtgaagttgaacagaactctgaagaccaagttgaagattgggcaacaaaagctgctgttgcagcaaataagcaataaaaactgagacaaacaaaaatacgatgctataattaggagtacacggatgtacacaccaccaattgttagcagatatacatacgttgattacaaaagaattgaaggcggccccgaaggtcgcctttattcaactccaacagggaatctgccgtcagtaacaacaattcttagtgccacctctgacaatgaggggttgaaaaaatggagagaatttgttggtgaagagaaagctaatgagattacattagaagcatgtactgttggtacttttatgcacgagaacttagaatatcgtctggatggaaagccagatcaccaaggtggtatgccgatacgagttctggcccgtagaatggctgacaaaattcaagaagaagcatggcctagaattaatgaagtgtggggtcaggaagttccattattctatgaaggattatgggctggaacaactgacttagttggagttcatgatggtattccttctatcatggactataagaattcccgtaaattaaagacatgggaacatatcgaaaattaccgtatgcaaatcgctgcatatgcactatcgcataatcaaatgtttggaacaaatattgagcgtggtgtaattttcatctgtgtaagaaaagatcctaacaatttacaatatcaagaattcgttattgaaggacaagacttcaaagatgcggttgatatgtggattggtagagttgaacaatactatattttacgtggagaaattgaatcaaatggaacagcataaacaaatgaaacaagacctatatacaattcgtgcactagaaagtaaaggctactccttagatgaagtaatcaaactaagtgatgaagaaattgacaaactacaactttcaaataaacttctagttaatattaaagattataaatctcgcggtgcaaaacctgtagaagtaatcaaagagaaaattgctgaagatattagtgttgacgaagtatctcgtaatgttgcaccagaagtaatcgaatcatatgtagtagatactgaagaacaaattaaagtatctgaagaagtacaagtaatcgctgaagaactagcacctgttgttgaagaagaagacgttgttgttattgaacgtgttgaagcttcaaaagaagatttggatattatcaaagaagcactaaaaaccaaagaactaaaaagtgttgcaaactatgtaaaacacttgaaatccctagttcctgaatcaattctttcttccgttgatagctctgttgtatctcaactaatcaatgagcgtattgctgaagttaaagaaaacgctaaataatcctataatactataggagatagtttttatggcacaacaacaaattgcgttacagcaagtaagaactggtaagcaacgtgacttaccagacgcgttggaaaaaggccagataggattcagtactgatgtgggtcgtgtattcatcggcctaccttcctcatcagacccagcaagcttagttgctgggcgtacatgggaaactgatccaaactctggtaaagagaacgtggaaataattaccgaattctcaccgtggagaacggtatccaaaatcatcaaccgtccatttgaagtagacattccacaaaaccaagagagtgttgaagttattattgaaagtgaaagtcgtgtattcatcgactacatcgcgtataatagcaatgagactattttagaatcaggcacagtgcaaattgttgctgctggttcttcaactatgattgcacagtcaaataacacaagccgtactgatgcaattttatctattctgtttagtaatccagtttatgattcaagtactggaaatatgcaatttgacatagttaatgcggattatttaaattcaggataccacatagaatttgtatatcgtgggtgggacaaaccttaaaaggcgtcccgcctttttcttccacaaaatttaagaactgtataaacaatataacaaggatgacacatgattaacgtaaccaagcgtaatggaaaaaaagaaccgttatctttggataagatccatcaaattttattttttgctgccgaagggctgagtggtgtatctgtttccgaaattgaaattcgtgcacaacttcaattctttgaaggtattgaaaccaatactattcatgatattctgattaaatcagcagcagaacttatttctgaagatacaccaaactaccaatacgttgctggtcgcttactaaattatagtatccgtaagcaagtgtatggcgactatgaccctatcaaatacactgcacatctacaagaaatggtagatacaaaaatctatgatccagaaattcttgagaaatacacacttcaagaaattgaagagcttggacgttacatcaaacataaacgtgatgataaattcacttatgttgctatgcgtcagtgggaaggaaagtatctatataagaatcgcgtaactaagaaaatatacgaaactccacaaatggcatatatgaccattgcagcaatcatctttatggagtatgatcgctctgtacgtatgtcttatgttaagaagttttatgatgctgttagtaactttgatatcagtctcccgactcctatcatggctggtctacgtaccaatacacgtcagtttagttcttgtgtagtactaaacgttggagatagtctagatagtattggttcttctaaccacgctatactacgttatatttcccgtaaagctggacttggtatcaatatgggccgcattcgtgctctggactccgagattcgttcaggtgatgcagtacacactggtttgattcctttcattgcatcaactgctaagaccgttaaaagttgctctcaaggtggtgtgcgtggtggtgcagcaaccgtccacttcccattgtggcatttggaatttgacaatcttgtagtactgaaaaataacaaaggtactgagttcaaccgtgttcgacaacttgactattgtttccaagtgaacaaaacactatatcaacgtttagttgatggcaagaatattacattctttagtcctaatgaagttcctgggctatatgaagcattctgttctaaccaaaaagaatttgaaaagctgtacaagaagtatgaagctgatccaagcattcgtaaaaaatctgtatctgctgttgaagtattcagtactctaatgactgagcgtgcagaaactggtcgtatctatattcaaaatattgaccatgcaaacacacactcaacctttattgaatcaattgcaccaattgaacaatccaacttgtgtcaagaaatcgcactaccatctgtgccatttgatgatattaatactggtgaaggtttgattagtctatgtactttgagtgcaatcaactggggtaactttgatcgcccagaagatatggaaactgcttgtgatctttctgtacgtgctcttgattctctattggattatcaagactacccagtagttcatgcagatcgtgcaacaaaaatgtaccgcccattaggtgttggtatcattaactttgcatacttccttgctaaacgtggtttacgttataatgaagcagcattagaaacagttaacgagtgggctgaagcatggtcttattatctaattaaatcttctgtacagcttgctaaagagaaaggtaagtgtgaaggttttgacacactaaaatatgctaaaggtattctaccaattgatacctataaagaagatattgatgcgttggtatctcctgaactaaaacaagattgggaaacattgcgtcaggatatcaaacaatatggtattcgtaacgcaacaactatggcactgatgccagcagaaactagtgcacaaatcagtaacagtactaatggtattgagaaacctcgttcacttgtaactaagaaactatctaaagatggtattctgaaacaagtagttcctgaaatcagtaagttgaaaaacaaatatgatttattgtgggaccagaaagataacatcggttatctacaaatctgtggtgttcttcagaaatacattgaccaaagtatcagtgtgaataccagttacaatccagcacacttccctgatggtaagttgccaatgtcaacactactaactgaattaatgtatgcatacaaagttggtttgaaaaatctgtactatcataatactaatgatggttctgatgaagttgatgttgagaaagtactaaaagaagctgcaaaaccagaatcaggacagtttgtgttgcctacactacctgacttagatgaaggtgattgtgatagttgtaagatctaattaaagatcccgcttcggcgggattaatctttccaaatataaaggaatatatatgtcagttttcaaaattaatgagaagtctcacctagaaaagaatatgttttttgatgaaagtgttgatattcaacgctttgaaagtaacaaatactctgcacttgaaaaactaactgaacaacagaaaagtttcttctggacaccaggtgaagttgacgtatctaaagataaaattgattttgctaacctcaatgattctgagaagcatatctttacatcaaacttaaaacgtcaaatccttcttgattcagttcaaggtcgtggtcctaatctaatgctactaccatatgcatctctacctgaacttgaaaattttattgaaacatgggctttctttgaaggtgctattcatagtaaatcatatacacatattattcgtaacatttatcctaatccatctgaagtttttgatactatgttggacattccagaaatcactgattgtgctgctgatgtttcaaaatactatgatgaccttgatgaactaggaacattgtatcgtgcattaggtgaaggcactcatactgttaatggtaaaactattgaaattaatatgtatgatctaaagaaaaaactatggttatgtttgaatagtattaacattcttgaaggtgttcgtttttatgctagttttgcttgttcatgggcatttgcagagaacaacctcatggaaggtaatgcaaagattattcgtctaatttgtcgtgatgaaaaccttcatctcgcagcaacacaaatgattttacgtcttctaaagaaagaagatccagatatggtaaaaattgccgaagagtgctatgatgaagtactggaaatgtttatgtctgctattcgccaagaagaagcatgggcagatttcctctttaaagatggttctattattggattgaactctgaaattcttaaacagtatgttcgctggattggttctaagcgtatgactgcacttggtatcaaatgtccatatactgtatccaagagtaacccactaccgtggactgaacactgggtaagtggtagttctgtacaggtagcaccacaagaaactgaaatcagttcttatatcattggtggtattgtgaatgatattcaaggagatacattctcgccatttaaactataaaataaaactaacagggattctatgaatcccttttcttatggaatttatatgagtgatatttttacaattgagcgtaatgttatctatgacttctacctaactggtggatttaaggtaactggtgcagtatctgatgtttgtcccaatggccttgtacttgtagatggtactagagtcgttcaggcacacattgtcatgtttgtaccaaccgaataaaatttaggacaaacaccagaactgtgctataatgagttttgttaaacaaaaggagatataaaatgaacgttaacaatctaaatgaaatggtagaaaagaatatcgacgctgcggaagaagttactggatacgaattaactcctgaagacctagagttatcgaagaaaatcattgaacaactttctgggtattatgtacgtaaagaccagaaaattaaagaacataaaaaagcaaaagctaaaaaccgtgctcgtagcaaaatggctaacaagtctaaaaaagcaaaccgcaaataaatgaggtattgatgatgcagtatatattgtctaaaattaatgagaattttcctaagtcgaacgtgaaaagaaccaaccgaacacttaaaaaaatgcatttggatgaatatgctgtgtcgttggcttcaatcactattccagtatatctatttggtctagaacaaactcaaactgaccgctgccttgatgtgatttatgaacatgatgttgggtgcttcgtgtgtggtagtgatgatggcttcactatactacatgaatttgattcattggcagatgataccagtactgaagaatatattaaaaacttcactgaaaaccttattcgcgaattatcaaatattgaaatggaattcgcaactacacaaacagtcactatccaatacggtgacgcatattatggagaatggtaatggcaactacactagaacagtataaacaagtaactgaatttatggaagtgtgtaatcaagaagtaaatactacccgtaaattccaaactgcaaaagttgcaaaccttcgtgtgaatctaatccatgaagaaatctttggaactggtgaattagttgaatcagtaaattacgataataaaacaggcattttagatgcattgtgtgatattctgtacgttacttatggtgcaatcgcaacgtatggttgtgtagatgcactaagtgattatgaagtatccatcggtctaccagaagaacgtgaaggaattttactattcaaacatgcttcctcatcttatattcgtgaaatctcaaactactttgagcagttcaaacgtggtgttgagagtggtgatagccgaactattagtgatggtctagttcgcattgtcgcttcatgtgttgaatttgcacgagttagtaatttcgatctatccggtgcatttaatgaagtacatgaaagtaacatgagtaagttctgtgcaacggtagaagaagctgaagaaagtattgctttccgtttagcagaagctgaagcacttgaaaataaagtgaagggtctagaacaaacacgtaactacactgatgcttatgtggagaagagtggtagtgtttatgtaatcaaacgtaagattgatggtaagggtctgaaaggtaaagacttctttgagccagatttggctaagtatgcataattaaaaaaaagaaagggagcaacacaagtttgctcccttttattcatttaatgttttgtattgaatcatcaaagttcttcatatatggtcgaatattgttaattaggttctgaacttcatgctgattaaatgttctattggttgtaatcataacatacccagcaacttcaaactttttcttatctaggataggaatagttattattgtgttataagtataacgaatgtgtttaacatcatcgcatgaataatctttggtattatcatagaataaactacattctagttttgaaccaatgattgtttcataatgaactttattaagaaatatttcttgatatgctctatcgcttctgtctaaagtgtacatatcagtacgcattcttcgtacaccagagcgatctctaagtgctagtccgaacttggcctttatacattttagtgtcttcatctggtacaaatttgtatagaaccaccgtactaatatctgaattctttgatagaatttctataaaagactcatttaccttatccagttcaaaagaacttttgaaaaaatatttttcaatactgggtattaccgttttggtaattctattttctatctgtgacctattaagaaagagaaaaatactcaaagtgatacaagaacatacaattaacactcttagaattgaactacaaattcttttatgtgttgacatgtgtttcctcttttatttaaaatgagatataatatcctacttcattaactactttcgttgccatttgttgaaacttttcagcttcttcggcattttttggtacacgtttgaaataaacactaacatatccctcgattgaagtgtacttgattggtacagaaacaagataaacaccaccgtcttgaactattgctgggaagttaatcggtgatagatattcatttcgtgcttcattttcaggatttaaatattctgtgtaaattttagaaatctcaacacaaaatattttcccccttagtaatgtatttgtttcagcactaaaagcactaattggtagccaatctaaattgtatggtttaatattgatacccatagatgcattagtttcatctgtgacaagtactctaccttgatagaatgtgttgttatctggaacaaacttataaaccaaaaccattgcaatatcttcagagtttgcagaaacgtacttgtaaagacttttatcaatactttctaatttctctggagaaattgtgtatttgtgtggtttaaacgattcatattgttctgggttgtttagtttgttgtttatgtaagtttcccatgaactggatgttatatatactacaaaccccaagacaagacacagcgttactactattgttctaataacaggcattccgggagataacttcaaggattttgttaattatactactatctaagtcgatattcatatacccgttaatctccaatcttattgttatttttataaagtatttacccaaatttacgtttttgatagtttatatggagttaaagtaataaatgcttattttacaagttatgtggattgatattatattaatctttgtatgtgcagggtatagcactacagctagtatattatactgcatatcgttgatttttcttgcttttatggtaatgttccataaggagataatttgtgtttacaaactaaaagataaatcattgataaacaattttgaatcaattgctcatatctatccaattggtagacgtactgttataaacataattatgtcatctgttattaacggtttcatagcactagtggcattgaactcacttgcaatcaccattgggattgtggtattatgcgtatatcgcatttataatgaagaacaactggagaaattagtatgtcaaagatgattctatgcactgacgaaaactttggtattggatgtaacaactcgatcccgtggcacagttcagcagactttgctcatttcaaagaagaaacaaagggacgcatgataatcatgggatataatacttggaagtctctaccaaaaaaaccacttccaggtcgtatgaatatcattctaatctcacgtgaatgttatgacattgaacagtatgcagatgatactagtgtgatgtttttacctgaacgctgtttacctgaattgcttcaattcaaccctgaaagtatcgttatcggtggtgctaagatttataaagctgcacttccttatgtacaagaagtgattcacagtactgtaaaaggtacatacaaatgtgatacgttcgttcgattcaaagatgacaagcgtgtaaaactatctcgatatgaagccaaaacattgtcggatggaacactggttgattattatgaagtcgttcgtgtttacgatgagtggatggatgcatatcaatgaaaatagacttatatactgatggctcatgtcttggaaaccctggaccaggtggtgtgggtattgttgttattgttgataacgaagtccaggacaaactatcatttggtgatataatgactacgaataacaagatggagctacaagctaccatcgctggtattcaatatgttaaagatgtgtacgataatccagatattactgttttcactgattccaactacgttgtccgtgggatgaacgaatggattgttggatggaaaaagaaaaagtggaataacgttaagaacgttgaattatggcaaattttggatagtatcagttcaggttgtaaatttgaatgggttaaggcccatgcggataatgtatataataaccttgctgatgaattggcacgtgccgctgctgaggaaatcaagaagcagtcaacttaaagtgtaataatcagtcgagggaacgatgagtaaaatcaagcttacggataagcaacaagaaatttttgataattttgtagatcgtgtttataattatgcaggtaaaactatatctgtactgtcagcaccagcgggtacaggtaaaacattcactactgctgagattgttaaagcactatgtaaaaattacaatattgcagtaacatcgccaacacacaaggcaaactctgttattcgcaatatgctaatcaacaatgctgggttaactaaagaagatgcacaggttagtactattcactcatttctaggtttaaaactagtatatgaaaagaatcgtcaagtactgaagcatgacccacaaagtaaagttagtaatactaatgttgatattctaattgtcgatgaatgtagtatgatttcagaagaactgtttcaacacattcaggatcaattgtggcgtgttcgccgagcggttttattcatcggtgatcgctgtcagttgccgccagttgaatcagaaggcacaataggagaaactaagctttcccctacttttgatgttccagtacaatatgaattaacagaagttttacgtcaagcgttggataaccctatacttgcaattgcaactgcaatccgcgagtgtataggtacttccaagaacccgtttgatattatgcaccagacacatggtctgagtactattacaccaattgaagatgaagatcttttcttggaagtttaccgtgaattcattatggagaacaaaggttcagctaagaagatatttgattttgttaatgaaaataaaatcttggcatacaccaactaccgtgtgaacttggctaacatctacattcgtagccaattgtttgaagtaccagaggaattcacaaaaggtgaaccgattgtctttgaaagcatcactgagaacagtccatatgtggttcagcaaatcatccaatgtcctgatgtgaaaaccgaaagtttcatgggtattgattgttggcaattccgtttaccaaatggtagctacatcttaggtgtaggaccagaaacgagagttgcaatggaagctaaactcgatgaactagttaaaaacattgagaaaaaagaaatcaacccattgacaaagaaaccatatatgtggcaagattactatgtgattaaaaacaaattacatattatcaactatccttatgcaacaactgttcacaaatcacaaggaagtacattcgataacatctggtttgatactgattttattgagcgtatcggaactaacgatacaaaatgtagaatcctatacactgctatgacacgaccgcgttacaatgttatgttgcgtcagaatgcacgattctaatagactaaatgatatacataaataattttgattcttaacaataaataatcaaaagtgttttgtattatggagaagaatatacaatgaacaatttactacaagtattcaaaattgaagttgcagggacaaatctagataatattccttattatatgtatgaagattatgattcatcttccccaacaactgcaccaaccgaccaacaaacaattgacaagtctgtagcactactacgttacctacaggttacacgtctactatcaacttattctgtcccagtgtattgtactgttgaatttgctaccccaggcacagcagcaactattccaactggtgcaaccatcaatgtgggttatatcagctacgagccattcctaagcactctaagtgttgaagaacaagctgcactaaccactgttgatcttaaaactgctaaagcagcagaagttattcaagaattgttaaacgaatcacttaaaggtgatggtactaacgcaattgagaatgaagaaatttctgtacagaaaacaatccaacgtgttaaagatgcactatctactaccactgttgatttcattgagtacgagaatgtgtacttaaacgtaccttctgtaactgatgctgctgtagtttcttacgtaaaattataatttaaccacatggagttcttgacatgactgacaaaaccttttatgatcgtattattgaagacaagggtgttttcgataaagtagtttatgacttagaacttatgatcaaagacgcaccaaatccacgtgtgcgtactcaagcagagtttgctaaaacttatctagtgcaagttcaagcaatctgtgaagcaattaaaaaacataatgatagtgcttgacagaacattagttcttagctataattactatcgaattgaacattaaaaccatatcggagcttttattacatgaaatctattattgccaataacgaaatcaccgcaaaaactgtccgtctagttacggaaggtaaaagtgaagtcatggcaatctctaaagcacttgctttagcagaaactgaaggtctggatttggtggttattggagcaggtgatgaacctgctgttaaaatcactgatctgaacaaattcaaatacgaattgaaacaggctgaaaaagcctctttgaagaaacagcgtcaaaacactgttagtactaaagagattcaattcaacttcggaactcaagagcatgatttgcttattaaagcgaaaagtgcaggtaagttcttagaagaaggtaagcaagtacacattgtaatgaaaaccacaggtcgcggcacaaacgcaactgttatccaaaacaacgttgatgcaatggaatcattcgttcgtcgtttgggtaacgtaacgtatgtccagaaagttgaattccagggtaagaaggtaacctgtactgtcaaagtaaaataataaggacgattctatgaaacatactatcgaacaacaagtgttttcacttcaacagttcagcgttgtgaaagctacatataaagattcagtttactacttagcggggagttataatattactccttatgtaactaaactacaatccgaacatagtaaagttgacaataaagtacttaatgctggactagaactatttctaaaagaacatccagaaaaaaatcttttggctgttcctaagttttactttattttgttagatgacccaaccacctccgctgaatttgttgaatgtgtatgtagtgaagtttttcatcttagctacaatgaaacgatggatgttattgatgcattaaactcatcatcacattcgtacaatatgggtacattcacagatgaaatgtgtattacattttcagctatgattgacaatggcaatgaacaattgcgtcaaaatcttaaatatgacaaaatcccagtacagggtaatggaaaagattatgacgcagcactggaagcactagaaactctaattcgtggtgactatccagacgatatttaacagtatataacctaaaaaactccaagattagatatctgataaatatctaaaacaaatcttggagtttttttattatgaattatgaagaattatataaagcaataatggaagcaatcgctcctaccgatgtagagtcttctcacttaaaaactattgaacacaatggtaaagacttgtacattacttttaagaatggaagtacttatgaatatgatgatgtaccagaatcattagttcgccatatgttaactgtagattcaaaaggtcgttttttgtggagatatatccgtgataaatttccgtaccgtaaaacagcatctatttctaaaaaaacatatgcttccaacccaaatgccattaaacagcgtttacgttatgatgttgatacaggtgaatgggaagatgcattaacccctgatgttattaaaactgttgatattccggttggttatgaattccgtgcacctaacaatcaagattatgtgtttcagggaaaacaatggagaagtaaacaaacaggtaagattgcacctaagcaaattggttctaaaataactgatattgctaaaagattgataaaattaaaagggaacgatcaggaagggacagatgaaatataatcaattacaggagtctatcattaaagtccccagtactactatgacacagattaacagttatgtggcaagtgttctgtactttaaaataaaacaatttattcagcaatatgatattcatgtagatgctgaaacacgtcagcatcctgccgccgaaaaaataaaagcgaatgttattgctgagtgcaaaaaaacactaaatgtattgagttcaaagtatggagctaaaaatattagttcacaatcattcaatacaattgcaaaccagtcagttaaaataccatttgatgctgaacaatatattaaagaactaaactttaaaaagttagctccagaaattgttgatgaaattaaaaagacaaaactatcattagttattgcaaatgattcttctgctaaagaacgtggctccatgactgaaattgcagataatgcttatgttattagaataaacattagattagcaccgaaagaaatatattcatcttctatgcaaataatgagtactgcataccacgaagcacaacactttgtgcaaagttcagtaatcaagaagatcaatagtaaatcaaaccaattacaggttaagaaaaactatggcaaagaccatgatgaatacttaagttctggtattgaatatactccacaacttggtaatgtgattgatgcaatgcaaagtgaagcacaactgctgattgatgataataatttaccacaagacccaaaagaagcatttaataaagtacttcaacttgtgctatcccgtgatgataagtataatgctcgtggatttattattagtatctataaaaattcacaaaagaaataccgtactgttatgagtactttatataaaaaattcatggatgcatttgaaaacattaatgctaatagttctgaacatgaagaaggtccagaagaagacttaggtgtttctgtcaacgaaatgaaaacactaagcgatgtggctgaaaattctagttatcttgaaacccgtttgtatggacattcaagagatgaaattactaaaattcactcacaaagtattgaaaacggttgggagatgatagttactaaaccatccgaaaatagtgatgcaattattattcaaataagaagtgattctgaaaatgaacgcaataagatgaattacaaacaggctcaaaactttgtaggttcagttgcgaacatggatttcactgttgatgaagttgtagaattccttgatgaaattttacatatggatgcagatgaagcgaaagctgttaatggtattgtgagtaaggcagagcaatgggctggtatgattggtctaaacttcgagaaaacaaatgaaggatttaaattaaacgatactgaatttgtgattgagccttatagtggtcgtatggtaatatcgtcaccacaactaccaaatatgtatctagttggttcagataaaattatcaccgacatattgaaatacattctacgtttcatgaaagagcagccagaaaaattactaaaaacattgaatcaagatatctcaattgttaagatgagaagagagttagggagtttataatgccaagtaaaagtaaaagccaagcgaaattcttcgctgctgctgcccataatcctgaattcgccaaaaaagcagggatttcacaaagtgcagctaaagagtggaatgccgccgacgaaaaagcgggaaatcttaagaaaggttcaaaactccctaataaggtaaaagaatctagtatgcgtggtttggttgatattgtacaagatgcagaattagctgatacagaagacagaactagtgatataatggattcatgtgaagaagaacataaagagaaattggaagaaatgccacaacgtttcgatagtttccaaggccaagaccgtgatgagttcgttgataaaactgccgagatgacaggtaagcacaacatggtcaagttcgcagaacacaaagattatgatgtgtttatgaataagaatggtactgggtttattgcatatgataaggctggtaaacagcttgctatcgttagtggacatttgtctaatgatgcggtggtaggtgtaccacaagtgtttgagattgctgctacggcctccaaaactggtactaaaggtatcatctataatatctttatggatatggttgctcatggtattaaagtactaagcgacagtcttcacactgatgatgcaattaaattctggacccgtttgattggttcacaccaagtctacattgttggtggtggtgaagtactggctaaggctagtccagagaaggttcacaagtactggagtgatgatgaatttagtcctagtgctgaattacaattacttctggtaaaataataattgtcggggcatttaatgtcccgatatttttttgagacaaacaaagcattgatgatacaatgttgcatgacaaagagacattaaaaaggaattcaaatggctaagaaagaaagtgctgttcttcaggaacatgatgtacaacgtctaaacgattatcaacatgctcgcttgcgtactgagatgtatctgggttcacgttctgttcacgaaagtcaagtactgatctttggtgagtctggatatgaagttaaaaacgttgagtgggttcctgcaattctaactgctactcgtgaaattatcgataacagcttagatgaatttaaaaaagctggtacaaaagagccagtactcaaagttgatttcaatgaagaagagttatcctttgagatcagtgataatggtcgtggtattccaattgactatgttcctgagtatcagaaaaacctttgtacaatggtaatgactgaaactaaaactggtcgtaactttgatgattcgaagcgtgatgaaacaatcggtcagaatggtttgggtggttcagttgcaatgattgtaagttctaaagctgaacttgaaatccatcgccaaggtcgcccgtataaaacacaaagtagcaatgacggatatgacggtttttataagttcaatcagaagttcgaagaaggaactattatgtttcctgaacttcatgtacatgaaccaactattcgtaaggttcaagcagataagactggaacaacaattcgcttcactctgagttctgaggtatttcctaaccgtaaactgccaaccgaattgttatacagtattttgaaagaaatgtctgctgctaaccctacctataagattttccttaacggtaagcgtattgcaattaaaggaactactgaaaaagcactattcaacgcatctaaactgatgcaattgaacgttaaagatgaatcattcaactttaacagtactttctacattgttcctaatgcagtatcgggtatgaacactaacttccatatgcatggtttggttaacaatgccccagcatttgatggtggtacacatcttgatacattcaagaaattcttctcattaggagtaggtactgctctagagaaagaatcaaagaaacgcaagatgaaacctaaccgctctgatattgaagaaggtctgttgatttataacgtaacaacgatgaaagcaccatcattcaactcacagattaaatcaaaactaactaacgaaaacgttattcgtccaattcaacaagcgatgaattctgaatggttcgatgaattagtcaagaagaacaaagagtggattgatgaaatttttgaacgctgtgctgctcgtaccaacaagaaagatgcagaagaagatcgccgtctagctaaaaaactattgaaaggtaaagttgcaaaactacttgacagtactggcacagatcgttccacctgcatcctactaattgctgagggtgattctgctatttccaacatggcaagtgctcgtgatcctaaagttcatggtattctaccattgcgtggtaagattatgaacgtcagtggtaatgagaaaaccaaagaattaatggattcaatggcattgcatgatataatggcgagtatcaacctgattcctggtgtaaaagcggaaagagcagaccttaactatggtaagctttatatctgtgccgatgaagatgaggatggaaagaacattggtgctttagtatgtaacttcctatacaaattctggcctgaactattccaagacccagagaatccatttgtgtatatattcaaaacaccattcatcattctagagaaaggtaaggaatccaagtactactatggtcatgatgtacatgaatacaacccagatgattggaaaggttggaaagcaacccgtgcgaaaggattgggtacgttagaaaaagcaaacttccgtgatgcattcactaacagtgttgcagtagcgattacagatgatggtcgtcttggtgaaactcttgatttgattttcaacaagaaacgtgctgatgatcgtaagaactggatggaataatatagattaatggggaacatggtgttccccttttacaaagagacaatggaatggctaaaagtaaaaaaaccgaaaatcaaagcatcgataaccaaacactaactctactagattataacagttctgattatgtgaataccacatcactagaatattcaatgtacacactagaccgtgcaatccctgggattgatggccttaagagttcacaacgtaaagcaatcttcaccctctcaaaagttagtggtgaaatcaaaactgtatcatgtgctggtaaaatgattagtgatggtatctatctacacggtgatacatctgcatctggaactctccagaacctagcatcaccagtggtaaacaactacccactcattggtaaacgtggtggttttggtacacaagtaaacagtactccagcttctgctcgttatacttatgttaaaaagaataaaagtactgaaatgttagtgctacgtgacgctgacattattccaatgaaagagaactatgatggtactacaatggaaccaagtttctttttacctatcatcccactatctttgtttggtaacgatagtatgtcagtgggttataagagtacaattctaccacataagattgaagatgttattgataactgtattcgtgctattgataaaaaaccattaaaagaaatgactccatactatgtttcatgtggtgcaagtgatatcgtaactaagcttgatgaaaacaaatatgagttctatggtaaagcacaagtaattgatgccagtactgttaaagtgacaggtctaccaccaaactacagtattgagaaattcatcgagaaactcattaagatgagcgatgatggtgatattcgtgattatgataatgatagtactgatgttattgatattacaatcaaattaccacgcggaacatctgctaaatgggtggagaaagacgtaattgaatactttggtattcataagaaaatgacacaaatcctaactgttctaggtgagaatggtaaggttaaggtctatgataacacaatggatttgattaaggactttgttgaattccgtttcaaatactatgtgaaacgctatgagaagaaacttgacgattgtgctgctgaagtacgttataagattctaatcaaagaatgttttgataatgatatgattgccaaggttaagggttttgctaaccgttcagaaatggttgagtttgttaaatctttaaacactgaaatcgaagcaacagatgagaatattcaaagcatcgtaaacttcccatcatatcgttggacccaagacaattatcaatcagtactagctgatattcaacataacttggatttaatggatgaatataacaatctcctgtcgaatcatgatttgatttggaacatctataaagatgagttgaaagaactacgtaagattgacttcacgccaaaaactgaagattgattataaacagggaagacctttatgggtcttccttgtcctttatataaataatctatagataatggtagcttggctatggagaattataatgacaacttttacccctagatgggatataaaagccgatgctcgatatatacaagaaggacaagacattcttgtgcgtttgagtatcaacaaagaaaccacaacggatgatagttatatacttaatgaaaacgaatacttagagatgattctaactattcagggtttggacagttctgatgcagtatttcaaccagaagatcactacgcagtgtatgttggaaatgatgaatctaatctcacacctatatcatcaggtattactggtaacaagttgattaatggtaagcacaaatgtaaaattgataaaactcaatttgatctatcggcaagcactaataccgaagatgtttattttattaaattgcattgtaaagatgatggtacatttaacaactctgaacagattaacttttatcttcaagcagtaaatgttatgtactatggtaacatttcccctagtggtgaaattggttcaaatgaagtaacaattgaatatgatagccaggaagtgtgggttactcctggaatcgaaatcggtgatgatgacaaattatattgtattggcgatattgaatacggttccaacagtactttatttgtacagggatttggtcgccgtcgtccatttattttaggaactgatacatcaactgacctatctcctagagtattttatccagcgtatcgtctactcgatatgaccccagcagaagttcctgctcgccacattactgatgattatgcaatcctacgtcctattgataatatatggcctgtatttggtattaataaagaaattaaggttaatattcaaactagctctggggagttactagattcaggattggttttcaacccaaatggacaatttctgcaaacatttctatatgactctgatgcatgtgatgcatatttcaaagttgaaattgttgatattttgagcacatatagttatgacactgaccgcttcgctataaaccaacgtttcaaagcatatcaaatgtgggtatgtccagacaatgtagatggtatatacgctgatggcgataaacctttacctaatcatttgtatcagttgaaagataacgttgtatatccatatgtaatcactggtgaatatgatctaggtgaaacaaagccagtgtttaaaagttcagattggattgatttaggatattatgattcaagcttaggtgagaatattataggtgcagagaagatgttccgtgttctagtgaacgcagaagaagaaaactcaatagacttcacaactgatagtgatttaggtagtattcatgtgggtgaatatttcggtcacagtacttatccacaaatacaaactaccagtcctaatcaggtatcttatgtattagatggtggacctgatgatattcgcaaatatggtttggatctcaccgcagatgggttcttggtcgggacggcatatgcaaaaagtttagatttcagtgcaaatgatgatataaatttagaattcaacatcaaagcatatgacactgaaggtggtgttgcgtccaagttatttaaacttaaaattgtacgtggttttggacaaaactacttaagtgcacatattgtaccttctgtttattttgaacgtgaatggtttaagtgtattagtacaccatcatttacaaatcaagctttccatcgccaatcagatgatagatacgggttacaaaaagtaccacgtattttattaaaagaaaactttttgagtcagaactatacttacactacgttgagtgatattaaaaaagtacttagggaaaatatcataaaccaaactggtgcaactatacctgatggaaaatttagaatggtaatgggcaactataaagtaatgtcagcacttgacaaccaaggtaacttgcagtatgatatattataccgtgaagttttaccagcaggttcattggtgtcagtttctaagaatccaagaagttacacgcaaattgataacggaacactcggtgaaatatttggcttgcgtcaaaatatttttgcagcaattggcgaagacacaactaaccttgtgaaagacccaactgatttacagaaccgtggtttgtatgtagatgctatacctggaatttctgatgagatgctagatactgttcctcgcttcatgaatcacccatacgaagaagatggagttaaaaagaaattcatgccaatcattccagttgcatactgtgcaccaggaaagggtgaagcattctttaacactttacttcagaacaatgaacatggtaagatggttggtgttgagtttgaaatcacaggagttgaatttggattctttgcacatgaattcgaaaactacgttcatgatacatttttgatttcattacaaaacagcaatttaggaggatgatatgttcaatccattttttgatccatcaaccatgaccgagaaagagttacaattgaaaattaacgaacaatcgatgcgtattacgtctgctcgtgcagcaggtatgagtgatatgattgttggtaacatgcaaaccgttctgaatcagtgctatgctgaattagagattcgtcagggacaaaaagaaaaaacctcctatgatgagcaagacccatgcatatttgacatgaactcttacttaacggataacgaagaggatcagaagaagaaaaatgaaagtacaaggaaacagatttataagtcccaatggtgatgtaaaatgtaaccttaatgcagtcgtgtatgcaatcaactgtggtgcagatattcagtacttacagctacaggagattgatgaaccggaacgattgaaatttaacgataattgtaaaaaatttggtttagaacagcgtatgctggattatacaatagaacatgataaaaaccatgaactatggcgttatgatccagtgtacgataacatcaacttgcgtgagtactttttacagaaatgtacatcggatgaagcccgtgaacgtgtaatgtatgagattgatttgtttgaacattacaacatgactaagcttttaagatgtatgatctggttagttgattatatggaagagcacaatattttttggggtcttgggcgtggtagttcagtggcttcgtattgtttgttcctgattgatttgcatatggttgattctttgaagtataaactagatgtaaatgaatttttgaaatggtagaaaaacatgtgatataatgttgtttgaggcgttatatcactcacatagaaaaaggatttttatatgtcaaaacacacaacttatcgtggaaccaccattgatatggatatgctaaagtatcaaaaccagcacaaagtagcactaggtaatgcaaacctaaatgctcgtggtgataagattggttcgggtggtacggtcattaaaacccgtgaagaactaatccaagaaaaagaacgtgaaatgcaaattcctgatttcattcctgaacaccaacttcacagtgctgaatatagtactgaagaagtatgggatgatgaaagctttgaagttcaaccacaagaaccagaagttgaagtatctgaagagaagaaagctccacgccgagcaaaaactaaagatcaggagtaattcatgaccaataaagtaatgacagcttgtaaaggtaaagttattgtaactgaactagaacatggtgagcgtaaaaccgcaggtggtattgtactgacaagtgatgatggtaagatacgtggtattcgttgtcgttgggctaaagtatattctgttggtgaagacattaccgatatcaaagaaggacaatggattctaattgaccacggtcgttggtcgagaactattgagattgatggtattaaaatgaatctcgtggattatccagcagcagtaagtttggtatctgacactgatccacgcatctctgctcaaacatttggtcgttaaaacataaatctaaagctcggatatattatctgggctttttatttggatgaaaatacatgataactgatgatggaaaatatagtttttctgacgttacgttagtttctaaaaatggacgatttatgtttgaagatagaactaacacgaagtacgtatatgaagtttctcatgatatgtttaagtacttacttatcgtatcagcccaggcagaagcaatgggtgtgaagaacaaagcaaactcatttaattttttgtttaatcaacttgaaatgacagaagacttattcactgcattattgtatgattatgcagattggatttcataaacacctaatatacaaggaaataaaacatgactacattatggactgaaaaataccgcccacaaactatggaagattatgtatctaagaacgaagccctacgtcagaagatggaagaatggattcgtactggtgatatcccacatattggattttttggaccagcagggacaggtaaaacttcagcaatcaaagtactactgaatggtctggaagctaacggacaccttgaccctagtgatgtaacaacactgaatatgtcagatgaaggtatcgatgctgttcgtgataaaattgacgcagcagcaaaactatcatgttttggtcgttatcgtgtatttgttctggaagaaatggaacaaatgaaccacaaagcacagggtagcttgaaacgtgtcatggaagattaccatgaaaatgctcgtttcattcttaccagtaatgaaccacataagattcagaaacctattatctctcgtgttcaggtcatcaccattgagaagcatgatatggaacaattcatgtcacgcatctacaacgtactattggcagaaggagtagatctaagtactgatgaaagtattgaacaagtacaaaaatacatcaatgcttcatatcctgatttccgcaaaacactaaacgtattgcaaagttcagtagtcgatggtaaacttgtaaaacttgaagacagtattgagaactctgctgggtatcgtactgccattattgatgcactaaaagctggtaacattcgtcaaatgcgtgagcagatcgtgcaaaacattcctgatgatgagatggatgcattcttctcttatctgtatcgtaatgcagaaatgttcagtactgatgaaattactctaatgaaaattaaggttaagattcgtgacgctgttgttaaacaagctactgtgtctgaccgtgaaatgaatctcagtgcattactgtgtgagattgacctaatctgttcggggaacatgtaatgaaagaccgttgtattgtattcgactgtgatgaagtactactagatcacattggttcattaggagaatacgcaaaactccaatatgatatcaacccaacaacaccatacccactcgcatacgatttatctgaatggtttggtgtttcacgagaaaaagttcaagagatcattactgaattcaatcaacgttcgtatatgtttggattactaaaacctgtagaaactaacactgtaagtattatgcatgaactgcgtgatcgtttttacaaggaaaaattcatagtactgactaagtgtggtaagaaaggttatagcgaggtacttcgcaatactaatcttatgcatgtatttggtgagacatgttttgatgaaatcatcattgttgaaatgaatgaatctaagcatgaagcactagtagaattaaaagaacgatatgacgtaaaactgatgattgatgattatatcaataatattgaaacatcaatggaattgggtatcccatcagttatgatgcgagcgtcccacaatcatatgtataaaaatggttatgggtatgactatgttaacaactgggatgaactacgtttaaaaatctattcagtactgtcgaaatattaccaataatatagtaaaaacaatggggattatttaatccccttttattgttttttaaaagtagtaaatagtattatatgtgctagttttttaaggataatataaaacatggatgatttagattatacagataatgcagtccagcagttgtatgataacagcggtatgctagatatacttctggctgttgaaaaatattttgatgataatgatttgtacgcatatcatggtatcatcgaaggtgaactcgttgaaggtccgattgttagtaagtactggtgtactgtgacattcaaatactatcgtgagaatttccctgatcctactgcattctcaattcttgagaagcacgggactaaggtatatgtgaaagcagattatgaaattacacctattcaagaacctaaccgtcaggctgatatgaagagtgtggcaacgcaatctggttctgttcgtattccgaaaaatgaacgaattccagttctattggttcgtgtacaaattcctagaaacctaatcaaccctgaaagttttgatgaatacaaactaatggcttccgagttcaatagtaatcctatgaatgcacaagaaccatcagatgagccaattactggtgaagatgttgatttagatgtagaagtatctgatgatgtacaacaaggtggtatgcaatgaaaaagaaactaaatgaacaaggtttacgtccacaagtactaaaggatttgattcatcctattattagtgtagatgaatatactcctaagattgaagatagtaatatcgttgttatgtttcaagtactaaacaactttgatgctgcatatgacctgtcatcttttattgagaagtctccaattgatgcagttgatactgaagctgctgaaacacctaacctggatggtcgttatcaggtattcgttgaaatggaacgtgatgcggaatttccagaaaacctacttcgtcttatcaaaactattgaaaacatttgcccaaatcctggctggaagattcagctttatggtgtgaatgatccgattgatgttgattttgatgaaattcaacaacgtatcgatttgggtattcctaaatccatcagtgaatttttagactttgctggtgtatctgttgttaaagaaggtcacatgcttgcactaaacactgcatatggtaaactacattacagtactggtagtggctttgtgtcagaagcatacgtaaaacagcttctatcgaacgatacgcaggtagatacatctcgcttaagttcggtactaggtgaaagttatagcgtcctacgtagcggtaatcagtatgtagtaggcaaagatgggaagtatttggtgttacgatgagaattttaaacatgcttaaatctctccatgagactaccaaacttcaccaagacgacaagtatcatcgtagtacaactaaagatttggcatgtaggatgtatatgagacgattcgaaatttctcgaatcggtaaaggatgggacgatatcaaacgtgaagatatcgaccctgatgcggtattcaaagcatacatggcacgaaaagtttttatcaatgagaaaactttttatattgacagcgataaagaacttgaagtaaaatttacgaaaggcttgtggaagatttggtgcttagagacgttcggtgaagttttaccagagccaccagtaccagaaacttacaaagatctaaaagctatatttgacaatgaacatatacatacaaattactcactatatgaaactgtttccgaagcggtattttatggagagttgaacggtcataacaagtactttgatagtatggtgagttttgatttattctgtcatctccctggtatctctagttggacatgtgaccagcatcgagctagtaaggtagacaagcgtaagttctctgctcaacgctttatgcaagctgctatgggtatgtacaaattggattatcttgggtgtccagaaccatataaacatttttggaaagaacgtgcacaaaagtgcatgaactattgtataattcgtttaatggattcatacattttaaaattcagaaatgcaactgtgtatgatatgccggaaccaccaaagaatgaaaagtacccaccagtaaaaacatttgtgtggtacaaggacaagagtaacaaaaggatgcactaaggtgcgtcctttttttctttaaaaaatggtttgacaaatacatcgtgtgtatgtagaatgtacgtatcgtatcaattttaattaattaagaggttagtaatgaaaggaaaatattttttcattgacaacggaaaagaagttgaaatcaaagaatttaacttcaactacgttcttaactcactgttaaaacagtatgatcgttcatcgaatagaaaatatatgtataccattgttgtggacagaacatacgattcattgggaaatccacatttcgacacccgttcactttcactcgacgagatctattttgataatcgccgtttgaaggtaatggatttgatgaaagataaaattcatttctcaaatgtgagaatcgttccagatctcccaattcctccgttagagaaggagtaccgagactggaaggaaggtaaacttcgtccaaacatggcagcagtagctacttcaccagaagttccggctcctattgttcttaagaagaaacctatcgatcctgaatgtgatatggttgctgacattgaacgttggatggaattcccagatacaattaaaaaagattcggtaaaagtactggattggtatgttaacctcccagtatgtgcacaagaagttggtatgaagattcagaagatctctgagcgacaattggatttgaacgcagcactacaacaacacagtgattatatccgtttattaatgggtaaccttacaacagcactggaaaagttattcccgttgaagcctacctttgcacagaagttgtttgggaaagcagatatcaaagttcaaccatctgatttgccaaaagtaatgaaagcattgaatgaggccgtgaagtacgatactaacaagtttagtggtattacgtctttattcactgaaattcgtgatgaagttcgtgaaatcaaaaatgaacttgagtatggtaagattgggtgtgaatatgcaattcgtcgtttggaagatccatttgaatatgaactaacgcttgaacgtattatgaaaatgggtatttcaacagcaatgactgaaactagtattgttggtgttagtaagcagtatcagattgacatgagccgaatgattgatattcaaactatcactatcccattgattataggtcgtttacaagctcaaactggtaaagcagtcgatgaagatactgccaatatcattcgcaacctagcgtatggaaataaagagtaaaaaaatagttgacagtactgagtgttgcctgtagaatgtttatcactgagcaacactatcttaaattaactgaggaatacacaatgtccgagaaagaaatcaatccgaaaaaagcaacagttaaacaagccaaagcaaccaaaactgccaaacgtactaccaaaacagcagcacacacaattgacgcaactgatatcttcgaacaacagtccaagtcacttccagtactgaaagatactaaaggcaacagtatggctttaactgtgcagaatattaataccatcggaaccactgctggggcaggtgtaggacgtttggctgatgaaatcatgtcaaaagttaacgtcactgatgataataccgaattcggtaagtctattactactatcttgacattgactcgtgcagttgatattgatagtctacaggatgataaatcaatcgtaggctgggtcaaaaaactttttgttaatgctaaacagaaagttggcgatcagtacaaaaacagtaaagaacaaattgatgaaatcatgaacactcttcaggttggtattaaccgccagcatggggaatgtgcatggctagacactgcttacaacgaaaacaaaaactatctctttgaactgcgtgatacgttagttgagttggaagaagttaccaaagcacaagatgctgaattggtagcaatgcaagcgaaccctgacgttgattcttttgcaatccaggagcaaaagatgatttgtgaagctctttctaaacaggaagataagattcgtcgtcttatcatgatgtgtgaactgagcggtcctcgcctgatgagtatgaagaaagtaaacctcaacactgtttctaagtttgaggatttgaaatcagttgttattccagcatggaaatcacaattggctgaacagttgatttccgaacgtcaacgtaaagacaatgagttgggtaatctgattgacaatgaaactaaccgtttactcgaagtaaactctaaaatggtagcaactaacatgttggatgctgctaaagcaaataatcgtggtatcgtggatattaaaacattgcgtaatgtacacaaaacaatgatcgatagcatcgaagcagtactgattgaagagaagaaaggtaaagaagagcgtgagcgtgctaagattgaaatcgcaaaactctctcatgaactcgaagatactcttcgtgaaattgctgaaaaagctaacaagtaatagttgacacaagagtgcgttttcaatataatgttcttattgaaacgcactcttttttaatatacagataaggaacgaaatatgaaacgccgtcatgttagtgttgatatcgaagccctcggtactcctgaaaactctggttatgatattattattccaaattatgcagcagtagttgttccaagtaaacctgaacatgatatcagacaatttgtatatgttaagttaccataccaagcacaagtcaacgctgggctgaaatcagatgcaggtgcaatggatttctggatgaatacatgtcagaaggaatatcctaatgcatatgctgaagttgccagtactatggcacttgttgcaccagaattgtacggtcctaatggtaaatccaaacaaatctttacttctaatggtattgtcgatttctggaaagatatccgttttgattgttatggtaacgaggttgaacattcaatttggggaaatggctgcaacttcgactgtagtattttacaagccaatcacttaaaactattgaatgttggtgatttgtggaaatatgatgctcctgaaaacgcacgaaccctgaagcgtttattgaatgaagaagctcgcaccgaaatggatgagattgtgtcagtgcagttagctaaattcgtgaagtatgcagaaaaatgtggtattaatggtttggaattacatcaccctctgtatgatgcagcacgtgaagctatccaaatctcctattgtctcaataaacttaaactggactaatacatgaattttattattctgttgattccttcacttatcgttgtatttgttatgaaatacatgtatgataagcatatcagtactaaagaactgttgattcatattggttgttgtatagttggtgctgctcttgtgcttggtatctcatatgcaatcaactacagccaattgtacgatgtagagattctaaatgggcaggtaacatccaaatataatcacaaggagttttgtacacaatcaagctcatgtaagcattacacgtggcacgagaaatgcagaactcgttatgatagtaaggggaaatcccatcgtgaatgtgagtcctataaggtatttgattattcatacgaagttgactggtatgtaaaaagtactgtagggaagtttgagattgagcgagtaaaccgccagggtacaatgacccctccacgctggcaacaggttaacattggggattatgccgccgcagaaagttcttatattaactatctgttcgctgataaaaactcattgtttagtcctggtgaattacatgaaatgtatgatgagaaatatcttagtactttgccagaatacccaagtgtggtagactattataaaacacaccatgtaatcaacactactaattataatgtagatggttatgatgagtatctgcgtgaagaactaaaaactatgggtgcacgtaaacaagtcaacatccaagttttggtttatgattataaaaacgtagattttgttgaggcaacactcgcttcgtggcgtggtggtaagaagaatgatgttattatgttctttggaattgataatgatgggaagattgttaaatttgatagcacttcctttgcacaaggcatgaagaacgaagaactacatgctaagatgcgaatggatgcattaaatgaaaaattaactcttgacttgttgagaaaagaagtgcataatattgacacaaagtttgaaagactctctaataaagagttcgagtacttgtctgtaaaaatggaaccacgtaaagatgttctcatcggtgcttctattttattactgattgtatctattttcattggcctttatatgagggataacaagttatgaatggtaaaattattgcattgattggtgttgttgttgtattcggtcttatggcaattggttcagttagtatgtatgtagatgcacatgaccgtgctgttgaatttgaaggtaatattaaaaagtactatgatgcatcagaaagtcaactaagtaaatacactcttgtcattcaagaaaaagtacaagtttctgataagtataaggatgcattgaaagaaaccatcgaaacatactttaaaggtcgtgaaggtgttgaccagaagtttgtgatgtcacagattcaacaacaggttcctaatctcgatcctaagatttatcaagaacttatggtaactatcgagtcaggacgtacacagttcaacaatcttcagaaaatgaaaattgaccagtgtactgattatgctaagttccgtaaaggtttctggaactccaaaattcttgatactaacacattcccaagtgaaaatattgaacatttatgtacagtagtttctgatacacgcactaagaaagcaatggatactggtatccaagaagtaattaaactataatctaaatctgggagtacattgtactcccattttctataggatttattatgtttttaaaaaatacttatgaattaattaaaatgcttcaaaatatgaattccggtggtctattcccgtatcactctgaggataaaactcatcgtttagttttgaaattggatgaaactgggcgtattgcatcactaagaacggctgttccaaatatagatcaagtaattatgccaacaactccgaattcaggaactgctgttaatacaccacaaacatataactcaaactaccaacacccacagatgtatacgattagtactccatctattacaagagttgcttgtattgttaatataaaagtatcaaaagactatcgtgatttaatatcagttgaatggtcagaactaacatcagcatttgcaaacaatgggcttgttgtaacaaatgctggtatagcagtcaatgcaaaagaaggacaacagataatgagtgcgttgtatcttagcaatggttatgttatcattaatgggaagttgtattgtaacaccgaaccagaagcactcactgaagatttgattagtgaaaaagaatatagtcttcttgaaattatgaatttaaaaaaggtatatgaaaactgtgattagatttgatcaagacgatttgccatttatccaagaactagaagaactagttacggtaacgatgcaagaaattagttcatgggatataacagtttttaggaacgtatatgataaaatcacaaactttaaaactgttaatattgaggtaaaacacaataacttttacttaacaaaagaattcattctaaaaagaccaggaacgatccaaccgaaacgtaatttgtcttttgctcaagttctcggtgctaagacaagggatgatgatgatttgaatgaatcaatatattcgtatattaaagagcgttctcctgatgttaagaagagatattacctttgtgttacatttgatgaacaaggaaaactaaatgcgtattctataaattcatcagcacacgtcccattacattcaacgtcaattggtgataaacaattactaatcgattcatcaacatggcataatagggaaaattttgccactgaaacttttcagtactcggtatctgaaccaaagtctccatttgattttgtgtttgttaataacatccttttacgttttggggtaggagtctaaatatgctaatttatttgagtgttcttgttatttcattactggtatcattagcagtactgaaagttgttgctatcggtcgtagtaaaattgatagtactgaaaccagttctgtgttggacctaattatggatcatccaaagatctgtactgggattgttgtgtttgttcttcttataggaacattcattgtacgtacacatttatacaatatgtatgactgtagtgttcgttcaatttctcagggtgttgaaaccgactatagctggtactatgagaaatgtcgcttcaaaaaccagcatggtatttgggttgattttgataaactgcgtggtacaccatctggtgaagaagagtaattatgtttgaatttcctgaagagtcatttaactatattgaccctactgatgacggatacagacacattaatatctatagtaaagctaaaactaagttaggtagggatctatctaacttttcgtcacatagttttaccttagaaccatacggttggttcccatcggtagaaactttttatttttggtttttaacaggccagaaacatgatgatcttagaaaagtgtcgggtgctgctgcaaaagcagcggcgaacaagtatatgcacgaccgtattgaaatgacacccgaatgcatttctcgtatccaggatgcaatatgtgctaagatatttcaaaacccagaacttgctgaacgattgaggaaaagtaagttacccttctatcattactatgtttatggtgggaaggtggttgatgtatctgatgaacatgactggtttgttaaaacattcgaagatataagaattgttttgaaggagaaccacaatgagtaaatgttgggtatgttgtaagcaattcgatgaagattatattatttctttggatgtattaccacaacaatacatgatatcttcagggaaatataaactagatacagttccaacacctaagtatatggggatttgtccattgtgtaatgggaatggtgtatcgaatgaagttgttgcattcacaaatacacaaactactgattgtgtcgccgaatatataagaaagaatctggcttttttcactaggagattatatgaacgagagaatctttaattcatatgatatggaagatttactaataccatctgataacagtactgttaaaatgcaaatgtattggttagtaaaagatggaaaggtattccagcacaaagttacaaaagtatggcaatgtaataaaaacaaatctatagttgatgcactcgcaactgcatatcctggggtagaggttgtatttttaccatttgcctacattaaggaaataaaatgaaaaaaacatggacaatattcgtaatacctactataatgttgttattgtcacttacggtcccgcaagggcatgttgtggcactgaatgtagtagaaattattcttcttgtaattcactgcattgtatgttactattatgtaaaatcggatgataaaaaaatatgaagtactatcgaattcgagttggtgtaagctctggttttagtaattgggtatattatgatttacctgatagctataccgtagaagatgtaattgatttatattatgaagaagagtcatgggtatccagtactgaaacacacagtgttgtgtgtgaagaactgagtgctgaagattacaagcactgtacccaagcaatgaagtattacagtaaagatgtgaagatgttatctgaaaacgtttttcctgtaaaagaatgggcaattttgcttgcaaatcctaacaaacctgttagaataggttatccaaacaatcatatggtttatcgaatgaatgataaacgtgagctaagttatcagtatgattacagtgcttctaagtttggagttctaaaacaatttatgaaggcttatccagtatgagcaaagacagcaaagaatttatagtgcgttgtagttgtggcgataatacggaacattgtgttcacatttcacaatttgacttgacacaagaacatggagatgataaacttggtcaatgtctggtgagtatgcgtttgaatcctttcttaaaatggtacaaacgtgtatgggttgcattgaagtatattttcggcgtaaacgactttcaatacaaagaagcaatgattgatgttgacattctgaaagaagttgtgttacaattagaagatacccgctccgatgaggtaaagaaagaagaaagagataaacgtagtgatgtgaaggttttatgagtactgaactttatgaaaaaaagtactgtacaaattgttcaaccgagtatacaatacagggtatgttgatttgtacaatatgccaatcaaaacaggctgccacttttatcgttgatgatagatttggtgatttaaaacagtttaaagcaaaccgtaatcttcgtaactttagcaatctatataaggaataacacatgaatatcgaacaaactatccgtaaccactctttcttcgctgctgaaactggtcgtgtaatcgagagcgtcaaaattgaagaactgatgattaacgttaaatataaagaacagaatgatgagattagcagcaccatttgtgctctacgtgctccattccgttctgaagcggcgaagaaacctgcttatgtactggcgattgcattgggttgtgtagtgaaattggtcgttgatgaaaatcaactaaatatcaaagttgctccaaccaacgatgaagaaaacatcgacctgaactttgaaggtaatctggctgaagacgtattcttccaacaatcactggtttatgatttccgtaccgtaactcatgaccatatcaactttgtcaatgagatggttgacattgtagctgaatacgaagcttccctataattagattaacaaaagcctccgtaatgggggctttttccaacataaggatatgaataatgattgaccaaattaaaatcctaactgaacaaatcactgattttctagcagataaagatggattcagtactgaagttaaaatgcatggtgttagtctcgatgtaactgcaccaaatggtgaaacaaccaattatgatatgtatgaaatcctactttatacattggctgttcgtaaacttggtagtgatattgaactaaacattaacaaaaccgagaacggtgaccaagtgtttgcaatcaacactggtgcacaaatggacgtggtagctgaaatcaacaagatcaaccaatcttttgtgggtttcaagcatgatacaatccaatctgtgttcctgggtaaacaaaccggaaacagccactgtccttattgtgtaatgacaacctataagaatggtaactggatgcgtcaggatctagtacttgctgaaatgctttatgcaatcacacacggcctagaacttgaacttgatgatagcgtgtactgtttcaagaaaatccgtaaactttctggtgatatacaagctcaattaaaagaattaaatgataaataattataccagtaatggttaacattatcatgttactttcctcccttacataataatgatgcgttattattttattgtattattcccctttttcgtacaaaatctttttcgtactgccccgaccttcggggcatttttcttgtctaaattttgaggttctatgaataatactattggtagtacaatatctaaaccactctcttattaccttgaaaaattcagaagtacaaatggtaaaaaatttaatggcatataccaattctcacataaagaatatatcacagttgattgttattcaaataaacttatgtacgtagatgatactgaatactgtatgaaattgtcattggatgtagaattagataagttaacatttattgaatatacatccaaaagaacatcatttcttgggaaatgtaatcga

SEQ ID NO: 10 - DNA, 167442 bp, Unknown
  Myoviridae; Tevenvirinae; T4virus
ttaggccgcaagggccttcatagttttagcgatttgggaaacttcatcatcactcaaagagttacgataaccgatgaagtcggaaacaatacggaatttcttggtaaactcagcaaccattttatcactattttttgaagcattacgtgataattcatcaaagagattagttactgtccagatgtcatgaccgatggtatcttttccaccattaaaatatacaccgcgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaaggcgttcgttgtgatgaatattcaaagtgttattaaattcactatcatctaacgcatgtgctaatccacggacaatattaacacgatttttaatattatcaataacgatattaatttttgttgtattaataccaaacagacgataacttgatgcaacggctgaagtttcatggctttgcttaatgcgtttcagtcgagggtcaagatttacttcatacacaactcctgcattgcataacttactatcaggttcaaacatgctttgcatcttcttatatgacagatttttagtcgtaaatttgactgaattactaatcatataatctcgagcagaataccccatcttcatcaattcacgatatgtatgacggggagatgtggattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatttgtggaccatcaccatccatgtaagctacataaccacgaatttcacctttatgatacgaagtaatactaaatgtatcagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcttccttgctcaaacagttctggccaattactaaaaaacccgagcagagaaggataaatgcttcctagaccatcatggtcagcatcggtcataatagcaatattatgataattcaagttttcagctttttcaccaagaactaatccagtgattgcgcaaatatcaaacagttctttgtttttaagcatgtcagcatatgacataccccaactgttgagaactttaccgcgcaatggataaccaccatgaagttctttatcacgaacatcaataagatatccgatagcagaatcaccctcagtcaagaaaagagtagtgtcagcatctttaccgcaaagattcgctttaatgtgtttatgaaccttagctttagaagcctttttagctgctttagtttctgctgccttttctgccgccaatttacgagccaaagcagcttcaataattggcatcagaattgcttcattattcaaaatagcacgtgaaatctttttagcgtcaagttgaatatgactacgaatttcgccaaatggagaagtcaaacgctctttagtttgagaatcaaatcgcatgtttttcatatcacgaacaaacataacgatagtcaaacattctttgacacgcgctttagttacatcaattttgaacttacgtttgatttgtggaataaggtcttcacaaatatcatccataacacagtcaatgtgatggccaccattcttagtgtgaatgttattcacgtaagttaattggcgaaaaccatcaggtgaacgaccaaccgcaatagaacaattttcttgttcttgaacgatagcatgttcatcatactgtcgtgcatatttcttaaaattgccctgaacctttttaccattaaaggtaaattgaatatcaggataaacaacagcaagtgtctggagacgatctagtgtaatatcaagataaacctgagacagctcattagtttcaaatgacataaaatcaggaatgaaagtaacacgagttcctttccattttccaggaatatcttcccatgatttattttccatgccatttgaacaacgaactacaatattattttgaccatcaccagtttcaccgacaaacatcacagaaaaaatgtttgtcaaactagaaccaacaccattcataccgccagtgacacgttctttatcatcaccaaagttaccacctgcttttggaatagtccatgcagcaactggaccaggaatttcttcaccggtaggtgttttaaccatcgcttgtggaataccgcgaccgttatcttcaactgttacctgattatttttaatggtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccagtaggtccaatagcacgaaatccagtatgttggaaatcattttcagaacaaccgaaccagttatatccagtgatttcaatattagtaaaaccgcttgaagacaaaactttggttgcattatcagcatcagtacatcctactaaagacactgctaatactaatgctgcgatagaacgattaatatatttcataattttcacttaaatttaatggcttgaagaagactaataactctcaagcggcttctttcatctttaactgtaaaagaaagagggtcaccagatttcatagtgatagtgcattcaaaagcaaaaccttcgggaacttcttcgaagaagtcaaattcttcatcataaattagaacattactctgcatactgtgaagaatttttccgtcatttccagatgctgtactaatcattgtaacgttattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtgccatcttcagtgatttcacgaaatacaccgtaaattggttgtttatccccaaccttttcatacacataaaccgaagtcaagtgagtaaacttagcagtgtgttccttttgaactactaccaaatctggatctaataatacatcttcaaattcatcattagtgcaattctgaacaattttacgtttcatcataatttcctcattaattgaacattggagcgatgcgtttcagaagagtatcagcgcacctttaacgaattatccattttattcttcaagttgttttctgtatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacataacgcgagtacgccgaggaagtggttgtccaccttcgataaattcaaactcataaggagcaatgaacttaatagcttgaccgagtttccacttaaagtctacacctacatgcgaagtatcaatcgtttcaattcctttagcgggaacagctttcaaaaacgcagattcaagaaatttcgcgcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccactgcactacgaggtactacgctaaaatcacctgcatgaacaacgttcagaagttcaacaccatcttcaatccattggtctgttacccaaccacagaccgaaataaatggagtcttgatagctaccgcatgagttagaaggtcagtaggatcgcattcttgaaagaggatgaactctgcttcaaaaactatagttttaattacttcatcattatctaaacggcgtactcgaatcacgtaagctttattcttatcataccagttactttttgaaaagcttttaaccacaaactcgccttcaccaaaaacactagtcaatgctttataacccaaatttagttcagtagttttaatttcagtttcaaccagtttgtaggttttgccgatttcaatagcggtagtcatagtaggttccttaatttccagtggtttaacagggcatacataagtgcttacaacatcaaaatcaatcagtttagctaccggatttggtatgtattcaggattataattaaatttcataattatctcatttcaataaaatctacgagttcagcatgcgatttgcggaacattacttggtgcccaccaatgataacttcatcttcaggaacttcgtatacagcgagataaaatcctttagaagataattcttcccgctcttctcgtgtgaaccatctcatcatatcatattcactagcgaaagcaaaatgataaagacctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcattcttcctctgacggagcatcttcaagacccatagcatagcgcaaagcatacttcatcatcaggatgtctttcgcacagtcatgaatagaatcatgtgcaacgaatccatctaaagttccctttggaagaggacaagtggtcatatcacgaacaagtagaagtgcttcaattctggtacgaatatcacgctgattccagaatttacacggttctaacttaaatgtatcaagctcattctcggaaacgccgttaagacgttgaatatcgcgaatgagatcgactaaaattggaaaatcaaacgacattccacggcaccagccttgagatttccaaggatcgatattatgtgcattgatgtaatcattaaattttgcaataccatcgatagtgcttacatcttcatctgatggtgcaatattttttcgagcttcaggagattgattcttccaccattcgatagtgcttttagtaaaaagacgatgtcctttttggctttttaaatcaaacttgattttaatgccgcgtgaaactaattcatcaaatgtttcaactacttctggattagggtcaaaggcaataacagccaaatcaataacagctgccttttcaccgcttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccctgattttcttcaatgacagctttaacatttgtcataagagatttaaactggtaccaactcaattcaatcattaataatcgccttataaagatagctaatttcgcctaaaatataatcattgattgtaacagttttcacttcaccacaaaagaattctaacgcaattaaatctcgttcaatttcttctaattgaagcctcaacttactagattctatttttacagtttcacgatttttgctataagcaatttcataaatttcgcttactttatcttgaagaagataaaactgatctttagttatttccacgaatagcttcctcaaatttaatcagtaatttacaaacactttcatctagtgtaattaccgtatctgtattactgtgatatgattgtttttcaattcgtttaattgctaatatagtatcacttataagataaagcttatgaaggagctcagctcctgttaccataacattaagattaagattatcttgcttattagtatgcttccttataccatctattagacgatttaaatattttgaattgatgttaatcatatatcctcacacataaaatacatcataacgaccacgggtaacaccaacataaagaagttgttgagccaattcagcatctgcataatgaatacaaggcgtataaatgaaagcacggtctacagacataccttgagctttatggaatgttgatgcaggaagtgctttcactttactaaactgtgatttagcatcccaaaaatcactccatggagcttttccgcctttgttccaatttttataagtttctgccgttttacctaaaaataggttaaacttatacagttcttcatcagatgaaattattttaatcttttcacgataatattcatcatcgccataagtttctactgttaaatcccaatgacgaattaagtattctccaggaacaccacgagctttaacaaacgtcgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacaattgaaaaataatttaccataaaatcgcgtaaagcggtatcaccagtaaatccacgtactccatgcccgtcaacaattttatcataaatccacttaccgttacgaacgtcagtagctacatcaataataggagcattactgcgtttaacttcagtaagttcacactgataaaaatctttgtgtgtaaagaatggactgatataagcagtattttctcctggatcaacaggtctaatttgcttattatcccctattccaattatagtacaccaaggtggaatagttgaaagcagaattttaaatagctttctatcatacattgacacttcatcgcagattaataccctgcatttagctaaatctggtacttccttctgttcaaaaagaacattttcttcatatgttaccgggttaattttaagaatgctgtgaatagtactcgcttctttccccgacagttttgaaagaatctttttagctgcatgtgtaggagctgccaaaatgataccagtttcacccgtagatattaaagcttcaatgatgaacttagtaagagtagtcttaccagtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatttttaaatctgttttatactgtgttttcaaagtatcgaaaactttatctgcaatatcctttctaaaaaatactgcaggatgatgctcatcaagtggaaccgggacagtaaatccttccatatctcgataaactattgcatatacataaaccataattaacctttaatcagttggaataatgatgcgctaagtggtaagccgcgtttcaattttaatttaccaatgaaaccaatcttttcaaaacgttgcagaccttggataactttatcatatgtatcgaaaagcgattcagcgtcagttaatttagttttagttttccagtcagagcctttaagaagaacgttgagtttagtaagttcatggccttctgcttgatgtgagccattaatgcgtgctttcaaagcaacaattctaagtttagattcgttagataaaggttgatttttcatcatgttcgccatatgcttaacacgattttcacgttttgctcggatttttaaaatagtatcataaacctttttaatttgggcccatttcttctcgtcgagattaagtttctctactttacgggcagaaggattagcaatacgtcttgcaacagcgtcacgtttctcaataagttcttctaatgttaaatcagaacgagccgtgttatattttttcttaactgggataacattacctttaatgtagccgatatcgttattaaaacgttctaaggataatttctcaccttcaacagagttattgaaagattcgcctgagtaagcgcagaccttttgatcaagaatgtttttaaggtaattaaagtctaagttaaaatccttagagcgtctcttcgcagaagctctggtgtggtcaagacgacgattgattttgttaattttattatttgataacataatattttcctctgtcttacggacgttaggtcatttagctgataagcttataatatcatgccctcaggtagtgtacactcttttttcataaaatgctttaattttttatgtgttataatggttctgagttccatccggttattccaattcagtcagtaactgacaatagacagattccagattgtataacgtccatcttgaataatagaatctacacgcagtgtagtccctatagggagcataaattcacattcgtcagatataagtctagcattagaccgtcttgtcgcttcagggaaagctccattgaactcacaagatggcgcagccagaatcatgttaagcatatgttcacggaagttgaaagcaaatggcgcatctttgatgcagaacatattaaatgttccgtaaaaattatacgaagcaaagttacgtgctacaccgaacactgggctgaagctcattactctgtcaaatttaataatactaccaatgcctttatcatcgagtgcggccatagttttcttagagattccacgatacattgtctcaggaacagaagacgtccaatttctacgaacgattgaacttaactcctgttgaatacagtctggcttgttttccatacactgccacagtacactttgttcaatgtcgctgaattgactatcaatttcgtactgcaatacatcttgatattcggggttttgagcacgacgaaccatttcttcaatttcacactcgttatacggcataaacatttaggtttctcctgtggttgataaaggtatagtatcatcatcggaagagtttgtacactaaaaattcaacattttcaaatgaatgattttgtataatcgagataaagggtcatattctaagtcttcaatttccacaatctcaaatctagagatacctgagaccatgtactcttgttcagattcaatcatatctaggacgtcaacacgcttttcttccataacatgcttaggattctttccggcaagtacaatgttaaccatgttttggtagtaatcaaaaatgaacggagcattcctgagactaagaatagtgtacgtctgatattcccaactcccagagaattgacgagctgtactgaaatcagttgtgaacgatgttactcgtccaggagaccaatggcatccaacagaaagaagtgaaagacgttctacttcttctggagttacaccacggtagagttctactggtactgtagaagtcatatgcttacgaacaagatggtctaattcatagtggaaatccgggtcttccttagaatcggtgcaagcccagagaatgttttgttcttggcgggtgaatttgctatcaatcagatttgttaggtattcgcgttcttgaagttcagattgacatgtcatgatagacctccatttaaagataagcctatcataacacgagaggagggaatgtaaactactttttaagctttcctactaaaggaccatcaggaccaggttgttctaacatgaataacgatgctttaaaaagcaatgtcaaccctttcaccattcgataccatgtctcaaagtctttttccttgatttctagtaagaatttctctttcaatttctctttcatttccaaggactccatggcggagggtcgtcataataagaggcaaggtctttcagggcttcaacaggtaaactaaagccgtgtcgttgtataatactatctagttcatcaacaagttcactacgatgcactttaggagcctcaacttcaggctcgtcaaacatactcataaggtccatattactcacctaaataaaaactaggctgctcggagaatgtttctagcgctacaccttttgtcttaaaaaatttccaaatagctcgttgcaaatggattaaatctgctaatgatgtaataaagtattttttggcaaaatacttatggtctcgcttttcaaacaagtctaaacgcttttcaggattcacataaacggcattttccgtagattcataacctaagtcctttataccttcttcaagactaaacggagaatttttagaacgagtaatagctccaactcgctctacacggattttgtaacctttaggaatctgcaatttgcagaattcttctacgatatattgcggattatttagacttttgttaatgagaatagctatttctagtggagtcttatcttctactggtatatgtttaaacgacttggcttcaagcaaatacattttaaataacatagcatccattataatttcctcgatggttcacccatataaagttttacaatacgttcgccttcatcttcgacgagcttttcttcatgtttctggaattctttagccatattctcttcaagaacatccagccaatcttctggttcgactccatcattcaagcttttaaaccattttactattctgttcattcacagctccctgagcttgaaccacaatcagaataacttgacccggaatcaccaggccaagacgatacgtatgaatgattataacttgaagagcttgaagcagacttaggacgaacaacttcttccatcattccatcaccgatatattcccaacttttttcgtgtgtatcaggaatcggcatcataccttcgcctggtttaacagcaaacaacttcttcagtatcgtaagcattaattgttcctcgaacaaaacgaacaccaccgtcatcccaacggatttcggcattaaatttgacgtcttcaccatccatcatgaatgagtgtacgactacatcatcgtaatatccaagaccgtatttcaacgaaacttcttgagcaatcaaagcacctaatgtgttattaggtttaatccaacgatttaacatattgttctcctcttgagtaagtaagaatatcttaacacagtttttagtggttgtaaactgtagaaacaaaaaaaaaggaatcccgaaggattccttaaattatttaaccacttactggtgtaggggtaaacattgcagcgttcttagttttccagtcagctgcatcagaaactacagtagaataagctgccttttctgatggaaagatttggtaatgagaatctgcaatccgatgttcgtttgaataaatctcaaacggcacagaaacttccatacctttaacttctttaccttcaccagcaggatgcgtaaaggttttgatgtttacataaccacccataattaactcctttgttgtttaattacaggtgtatttataacttaatcagtaaccattatcctggcgttcaaagttgtgttggtttttcaagtagtaaagtttaaagatttcttcagcggaaagacccagaccttggaacatattcagaacaaagtggagaatatcaatcatctcgaatttaatttcaagctggtcttcaggagacagttcatcgatacgacgattacgatattcagcatgttgtgctttccatggcttccatacagcagatgcgtctttttcaccattactcataccaccaagagaagtcagaagttcacggaattcatcatcaatataatctttctgattacgcagccaatcaacaacttcacctgcagtagccaaatcatcaggatgacggttatattcaggtttatctttagctaaacgaacctgtaaagatttctgcatatcaagcataacttgcagcgggtctttttcatcaccgagaatatcccaatattcattttgagctttatcagcgccttcaatcagttgtgaacattcgttaaagtaagccattatttttcctttcaattcatgggttaatagattaattatacaataaatatataaagcaataaggaggacatatggtacaaaaattaatggcacttgttaatgccatcaaaggtaataagaaacgtatagcttttactatttctgctatggtaggaattttactctggaactttattctatcacctgttgcaattgcacatggtattaatattccagtagttactcttgatacatttgtagatttagcatttgctttagttgggttaatttaaatcttagcatatttagataaccgcattttagccattaacccctgggcaatattatttttcatatattccataatttgttcaggggttgcaccttcctttctaatcatatcattgacgtcttttgatttccagggagatttatcccaaaacataaccctttctcctgcatcaactaatttagtcattcgtttgatagtgtcagggtgacgaggttcattatctaagacccacacacgcctatctttaaatggaacaacttctaggtctaattgaccacccgtaatagctataccattttcaataaaaagtgaatctataggtccttctagaacatatacatcgccatctttaactcgttcgactccatatatttttgttgcctcaggataagctttaatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcggttgtaaaccaaagatatttccatttatcctttggaatacaacgagcttttacatattttataattggatggtcttccgccagtttatctaatctaacacatgacggaagagatttaattattttcttctcaggttgtttaggaagttctttaggtttttctactggacgacttttacctttttcttttcttatttcaaagatatactcacgatataaatcgggttcaaactcctttaaatatattccgattggtgcatgatagttacagttataacaatgaatatttccttcattattatcaccataataccatccacgggctttattttggtcggtttttgaatctccacacactgggcatctaaaccgtaatttaaaagttgaactattatttacttgtgtgaatttaggtaaatgagctaatgcacgatacgcaaactcattatcaatccaaggtattgatgacatttttactcttctttttctttagattcctcttttttctttttaggaatctgttcaggacctttatttactacagcgcctgatgttgttccagtagagatattttcaggattaccacctgaatctccagctaccatatcttctttaataaattctttatatgttttcatattaacctctattcataaaagcattaaaaatttggtcatcaatagaaacatctactttagactgtttttctgatggtaattcatatccacatattacaattttgtgatcaatatcaaaatacacagaagcaatatgattaatgctgctttcagtaaagtctaaatcaacatcaatatctttttgaccaaagcccaaaggataaataatgcgagtaattcgattatctttaacaaagattccaccgacatactctgtactgcgtttaaagtctacacgccgacgaaatgaaaaatattcaggctctttatgagctcggctcatagggcacaacgaataactagaataagagatgtcaaatcctacgccttcaatatgaactaaattgtcatgattaaaccaattataatcatatgccaagtccattagattgtcatatgtgaaaggcaccggattaacatcattggtcacaagcatataattagcaactgctataatttcattatttttaacgaatacaaaccgtgattgatgtgaatgacctggacctgcgttttcacgattaatgatataacactgggcacctttatatttgtacgtgtctttacacttgtgcatttgataaagcattattcacctaccacttcagcgatgatatttttattattaaagtttttatcgcaatacagaacataattatactgcattacaccaccagacttaagctgtttttgcacttcagctttcatttcaggacgatcacgctcaacgatattcataatatccgcttcaatttgagtttcaacttcagtctgatctgcagtcatagaccattcgcacaaatctttgtcataacccgccatagcaggctgagcagcgcaagaagataaagcaaaaattgcagcaaagataaattttttcatgataatctcctcagtagtttatgtttatatagtatctcaatttccaataaaagtaaacagttattttaaaacttttgcgtaatcacatgttacaaactgtttctctaacttggcgattttacgaaagtatcttttgcattgacgaatctgtcgctttgtagggcgcacagcaaacttaataaattccactcgaccaaatggagggctttcttctgccggaatatctaatactaattcccacgtatctgcaataagtgctttgaattgagtatttttcctgacattatacggagtaggtttaaataaaacgatatgcatattatcctcggcaatccacttcacataccttcttgtcatcaatgaaagctttaactagtgctttattaacttcagcatattgagtagtagcccattgaacgtcatctttcatcattgtgatctctttagtaaacatgctttcattcttaaaccaccccataaaaactacctttaccaattccataacaatctcctcatttaaccaacaagactactataccatagtcttgtcagcttgtaaactaaaattttaattcatttgccaaagcatctaactgagctcgagtcgattcgtttctttgatagcgattctgctcagcttgtatctgttgtgaacctgctacctcactcacttcagttggagtagaatcttgttcaatttctacccatttctgatttcctttttgaacacccatcaaaaacttattccatttattcttatcaccatatcgtgatttgatttgcttaataagttgttgttcagcagctgctaactcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgcaattcctctgcaatagctttaacagttgtgtaactattttctgaataaactcggatgcgacaagatttacaaatacctagatagtcgacaataatgattgttggaacaaaattcttcttgagcttcaattcgtttaaaagtgatcgaaatgtattagcatctgctccaccagtaggatactgtttaacgattaaacgaccgagagtagatttctcacgccatttttccatttttcctttatactcagcgtaagaaatatgtccatcatcaatgtcatcaagagaaacatcaagcatattagcatcaatacgcttagcacagacttcttctgccatttccatggaaatgtaaagaacattatgtccgagctgcaaataatctgctgccaatgaacacagacctaatgacttaccaacgttaacaccagccattaaaacgttcagtgttccagtttcagctccgcctttagtaattttatttagaattttgagtttaaatggaaccttacgagctttattcatataagatagccaacgtgcttcgtagtcatccatccaatcatgaccaacgtagctatcaaatgaaattgataatgcttggcgcatgatgtcaggaatagcacctacatctggcattttcttatttcgtttttccggaggaagctcagcattagtttgaatttcaattattttagatgtggcgttaaacatcgccctttgctgaacatatttttctgtttcttttactaaccagctatggtcttccggagaatcggccagttttgaaataagtgtttttacaccagaatattctgtttcagtaaatgaactattttctaacgcaacatttaacgcattaatagatggaacgctatggtactcgttaacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgtagttgcattgtaatacatttttctacatgaggagctaactcagcttttctttcttggtcaagaacagcaaagtccattacgacttttccatcaacccaatctaattttgtcacatacacaatgtgtgtagaaccgtcttctagtttaatgacaatctcctggataacattttccatggcagatttaattatcttaagagattcattaaaaagacgttcttttctttcttcttccccctccgaagagggggattcatcgataatttctagatctaaatctaaatcatctttattcattaaattcttccatatcacttaactgatctaggtcagtttctaaatcagccgctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcacgccaagatttttcttcgcgaatcatctcaccggtttcttcatcaagaaattcacgggcataccagccatttttaggttttactacaaatcctaattctagagccatatctaacaatccagaataaggatcgataccaccgtcaaatttaacatcaataaagaatttacttttttctttaacggtacgagatttttctacatttagaacaaattgatacccctgaagatcagaaccatctttaatctgacgtttaccgataatgaatacagtatcagccgaatacattacgcctgtaccacctgtcatcacggttttactaaacatttcaattgtttcaattgtatggttaaccgcaacacacggaatatttttaatgctaaaataaggagtaacgatacggaataatgacttcagtgatttagcacgagtcatatctgccacagatttttcattcaaggcatcttccgtttctttcttagaagccatattaccaattgagtcgatgaatactataaccttttcaccacgctcaatagcttcaagctgattcaccatatcaattttcagctgttcaactgattgaattggcgtatgaattacacgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaatcgcaccagaaatagcaatattcagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctatcggatgaatagcattaaacttatgaaatgcttctgatttttctttacgcgaaacgcacatgcgaagaacctttaatggctcgtcttcttcacccaacgattttcgtttttcaatattagaagttttccaacgagcttgctctggaaactctctattgatttgctcaagcgctctattatgtttagaattactacgaattgaactgcacccgccaggagcttgtgcttttccagatacaaccagatatttgaacaaggccaaatgcggataaccttgattaattaaattgagaaatgcatacatatcttcgcacaaatcaatttttccatacccaatttgttctgtcgtaagttttccaaggtcataccatgtattcgtgaatccatatgaattttcacgataattaccccaagatgaagtaattttaaaaattggtagacgagcatgaccgtgataatacccgcaatccatagcatcttcaacatattgaatcaattcatagaactgttcacgagttaattgattaattttatctacgcgccgtttatcgtctctctttcgtattgaactcatacggatagtagtatcatcatcaatcatccagattcgttgacctgcatacatatcagtaattgctttacgagtaccggcaattccattaacatcatcaggaatagttacaattttagctctagacccataagcatcataataagctttttcttcgtgttcacgcactacaatatggggttcataatcagtcggaaacatattaagggcagaaactgcccctacacgctgataacttggaattacgaattgaatcatttaagtgccttacatttgtcaaaatggtatcttgtcatatttggcccacgtccttttagtccgcaatgcggacatattttttctatcaaattatgaggttttcctttacgatttttagacatcgtttctttaattattttagctttttctacgccaaaaatttcttcataagttttaccagaattttccttggctcgatttataattccatatgcctgctcatttttaccatacattggattaccttcgcctttcattcttttagaatgatcaggacgcttgattccacgaaaggcatttccgcacttatatctttcttctggagatagttttttaccgtacattccatttaatttgcctggaaaacttcctccccatgcttcattctttaaattatatgaatccgaacaattagcagcatctaaacaagttaaaataatttcttcaacctgtctaaacactggtccttcatataatatttctttattaaaggattttattccatatttctttttagcatgttgccaaactacacccgaaccatcataattcgggttgtgaccatcatgacttcctatataccactttttagttttaggatgtttatacttataaacatgtggcacatttacttccattttccagtataatcctttttagcaatatgagtctcaccggtgttccaccaatggtcaactaaataaaactgattttcgtacacatgaagacttccaacgttccatataatagaacctgctttatattgccgcgatgggtcgcctgcattcaaatcagatactaatttatctagtacgtatttttgccaagcataatcattacgatagcctgcccagcaatcattgcttctcatgctaacaaccgcattgactttcttatcacgaatcaggtactgtactgtattagtacacatgaaatctgacataccatctttattgtagtcaaattgcatggatggacgagtataaatcatgataccacgtcgagaatcaggattttgaccaagttcagctaaacacatatcatactgagcatagttatcttctgaccaaatagcccaaccataattcgagttaatttcgcctttagaagatgctacctgctgccaaatctttggtgtttcacctggaatatctttaacaaacaagctcatagatttataccattcaagttcgcgctgaatgtattcatcattaagagcgccaaaaataaacggttcatctgctataaatgatgcgccaataatttcaatagttttaacgccagttttatcaactacgaaatctttttcttttaatgcaagccccaaatgaagacggatttcttcaactgtcatagagtcattaatcatttaaacctcaattgatgcattcatatttaaattgtaacagtaataaaccccaccctatgataagagttggaatcatagcaggaactgttacgctatagtatatacttattataaccatcaagattaaaagcaatgctgctataattttgcttttcattccttctctctgatgataattacttgatttggctgtgcagactttttagtttcacccgcaattgaccaaataaatgtaataaaccaaccaataattgaccagttaaacagtaaagatgtgaaaaagattcctactgtcgattttgacccacgcatcaaggcgataaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttacctgtacgccactggtaattattagcccaatttgcccaaagttcagcgcagtagttttcaattttttcttcgcgtgtaattacatctgaattacgatatgcttgagcagattcatctggacgaatagcttcgtcaaaattcgcctgcatttgttctactgtttgctttggagcttctttataacacttgacattaggattataaaatttgcttgaacagtttacaatttttcctgcatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagattcaatcacaggttgagtatcattttcaacactaacaaatggaactgctgctaatgcaactaaacaaactgctaagcatcccataacaattttcatttcattctccaaatccgtatcagtagttgatagttgtatagtaccatagaagaacagggatgtaaacagttttgtgaaaaaatttttagggaatccaaagggtccagaatcatctctttttcataagtatagatttatattacttgtatgaaaaagggacctggaggtccctagatttattctatcagccaaacaggaagtctaacgaagctttttcttcatagtccatgccagccgattcacacatacccgcaagcggtttaacaaacgatttttggaacaaagttgagtggtcaatccaagatagcacatcagaacgaatttcttttggaagttctgtacccgatggccaagcaatgcacttgtcaccaaatggatttccttcacgtaatggaagaaccattactttatttccatccaaaattggagctacacccagaccactaacagctcgacgataagttagcacaccgcgaatatggaacgggcatttaaatcctggccaacctttatcatcatatttcgctatatcgttcgcagtttttacttcagcaataactttatagtcaagttgacgatattctttctcaaagttcttgtagtattcttggacagactcttcaccttcttgaagaatacgacgaatactttcttcgagagcttcttgtactgcttttggtgttgaactctgctgagtttccatacccatgatttttagatgcggttcagcaaatcgtttatcttccatatcataaacgttcagagcataacgctttttcgctttccaaaatccaccaataccctttgaaccaagtggagggcaagaaatagcttcacggtccatatgcatcagatgctcgcggttattcatataatcacataactcacgatatgcaacatcaatcataggttccatctttttcttaccgaactgattcataaattcaaccaaatcgttctgctctttgaatcggtcaagaccaactttttcaataactttatctacacaaacatataccgaatcagtatcacctgctgcgatgaaatcttcgccattagttccacatactttattcagatactcattaattttacgagcaatccactgaataccaacttggccgaaaattgtgatagcagtagcatttcgcaaatcatagtaacggaaatgaatattaccaagagcaccataaagactgttaataagaattttacggttcagctgatttgtattagcaagtgtagcagctttttcacattcctcaatcagactattgagaacagattcagtataattcgacagttcatttaagaaatcatcactgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttgatgcttatcatacatccatccattcggagaacaagaatattcatcactcggtttaggagctgttcctgcaatatattcatgaattggatgaactttaaactgaccacgaatagtctcaggactaatgttaacctgacgaataatgctcggatacagagacgtcaagtcaaaactcataatatatcgacgagcaattggtttaggttcaaatacgaatgcacccggaaaactctgtttaacgtgcgaaccctgttgaggaataaccttatgttcacctttcaatgagttaaaaataatagcatcccaagttttaataggactcattacaccagaaaaaggcattttagcataataagacatacttaaaactagatcgataaacccgcgaattttatcaattgcttgaactgattctacgtcaatgatgttataactaatgtatcgttgatgattagtctcacgaagtttattaataggaccatcatacggtaatttaccttttttggtttcatgttgagcaactgattccaaagagaatgacggcaaattagtaaaagcgaatttcttgtacaaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccagtaaaaatagcaggtcgtttctgttcccagagattgatatattccatgagcatatcacgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcatcaattgaatcataatgagtgatagcatcaatttcatattcagctttcattggatcaggaaatttatcaccagtaacctcaatgtcacagttagctacacgaacaaattttcggtcataaacaatttctgaaccatacgtatcactgatataagcgagtttaaaatcgttcataccaagagcttcgagaccgatgtcttccattcgcttcatccaatctcgagcatctttcattgatggaaatttttgaggagcgcaatttttaccatagatgtctttgtactttgactcttccttacaatgcctaaacatagtcggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaattaaggggccgaagccccttgcttaaattagtactatttgtcgggtgaaaattgtcaatccatctgcattaattgacttaacgactgcagtaaagtgtttttgttctgggtgaactaatttttgaaattctacctgaaattttagttgaaggttttctggtaaatcgaaaagtgtttctgttgcagaaagattatatttttctttaagagacgccatgtattcttgtggagttatagcagtcatattaattaccaatcgtatatttaggaacgagtttccattcatgtttttgtttaaaagaaataactcggaaattattagttaaatctttcataaaagttctttgaccaggaacgatttcaatcagtccccaatcttctaacagccatgcaatcgaatcacgacgaacttcatcttcttctgtcatttcaacttggcgaccatccatacgaagcatttctttaaaatgaacgatatagtatagtccttttttctggagaatgtggcaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaatcctttaagttcttttaatactaaaggtagttttccatttttagtaagaattgatttatagttaattgcatcatttgtattaacttgataccgcttagcaagtaacttaataatcaatacttcggtggaatcttcaaccagttttgcccatttaccatatcttttaccacgaggaactgcagccattagataattaaaatgagcttcatcacttaaacctgatccaattaaattcatagcatatacagctggcatgcactctggaaattgtgataatgcattttcaaccatgaattttgaataatctttttgaacaatagagcatttagttttattattaatagctccaattatttcaaaaaattcattttcagctttttctttaaaagaatcagcagcggattggacagctgtccaatcttttgaataccaagcaacttgatgctcgtttaattgaatatcatcttcaaataagctcatatcacttccactgcatttcgcacgctaattgaatgaaaagataagctaaatgcaattcagtattagctgcaataccatgatactgattattttcgcctacaatttcgtacatacgaataatactctgcggagttacacgtgaatagatttcttcggcaagtttaccaacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaacgtaataactcggcagcgtgactgaagtggtttaataataccatcaatattattagcagtaataataatactacagtttgaactataagcttccataaaggaacgaagatgtcgctgagattctgctaaacctgaacggtcaaattcatcaataacgattactttttgacgaccatcaaatgaagcggcgctggcaaaattagtcaaaggaccacgaacgaaatcaattttacaatctgaaccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctttattaaaaatcgtgggtagaatcagcttcaagagctaccacataattcgcgtgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcagagcagaatcttctactttattaaaaccgttaattacgattttaccttcttttaccgtgatagcaattgtatcaatctgcagaccacgagatacacgcaacagctgttgaaggtcttcagctttaatttcggtaacaacagatgctaccgggaatggaattggtttattaggagcaactactgtactcggatcggctgctggccaaaaaattgttgaacgggcatcagcaattttaatatttccatcttctgactgggaaatttctgcatcgtcattaactagggacagaataccgagaaaaccgttcaaatcgtaaattgctacatcaaaatcaatagtgtcagaaatatttgcttccgcataagttgtaccattaactgcgcgagtcataataaattgaccagatttaagcataatgccagagttaatagtagcgaaatttttaagcagagcagtagtatctttagacagtttcatgtaatttccttcaattcaaatgagatttaattttataactaatttaataaagcaattaacgattaaaatcagccgcaattgtttccgcaacaatttgagcagcaacaattagacgttcatctgcattaccgcaataatcatcttcaaggcgttcaccacatgaagtcataataaatttagcaccggcgtttagagattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcattcctgttggacattattttcgtatattctgctttaaatgcattcctaagcatagattcagtaactatatgctcttcattagaaaaattatttctcagaatatatcgttttatttcaggaatagttaatagatgctgtccagttgaatattccatgtttttcctccacagagattatactctaataaattaaagcataatctcttataaattaaaccattacagtaaaccgaccaactttcttcatttgaagatgctgaccatatgcttgcgggtcatggtctctatgtgaaataacaaaaacgttagtattttttaaactatctaaaatagttgaaatagcttttacaccttcaacgtcggtcgctgaatcaaaaacttcgtcaagaattaacgtgtttattttaacacctgaaactttttcagcaatatcacgccaagtaaataaaagagcaatatcaattcgtgctttttcaccttgactgaatgaagcataactaaaatcttcgcgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacctttttagctttatctactgctgcgatcagagattgctttttattgcgaatatcatttgccaacgactgttgggttttaatattatctcggtattcatcaacaagaacttttaaattatcacgatgtgttgaaagctgttcaaacgaatgcgtacattcagaaactttatctttaattttagaaacaactttatcaccggaactcaattgtgacaaacaggttggacataatccaccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgcagacgagtaagattgtcacccgttaattttttctggcgttcaacgttatcattatatattttaatttgttggataatactatcttttttaacgtcaagcacttggttttgtgaatttaattcacgtattagtgctttattaagcttatccatttcagctaatgttcctacctcaagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcaaaaacgttcggtttttgtcctcttttgatatagtactttttctcatcatattccatccacagttcaactaaaagttctttcttatttgtgctgtttattaattggcctttctttacatcacgaaatggcttgccaaaaagcccaaatgtgatggcttctaacatagtagacttaccaccgccatttcgtccagtaataagagttttttgaaccttatctaattgaatgtcaataggatttccacctactgacattatattttgatacctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatgtttgctatgaattcatcattaatgtcaaatgtcgaaaacttcacagtatgcatccttaatacaagatacggccatatctcgtaatgatttaggtgtgtcattatctaaaatgttgaagttaaaggacacagcccagtcagtgcagaccgtaacctttttaatacaattatcttcaacctctagcggttcaaaccaatattcaataatttctttatgcccaatatcatcttttacttcgcattcaaaatgctgactcatcataacatttttaaattcatcaaaagtcattgtgttgcctctacatatagctgatttgcatattgaataagtgcttcacggtcagaatcggtgatgtctggaattgcattaatgtattcttccatcaatgtctgaagcgattgaacttcaacttcttcactgtcatctgactcgacagagttatcaatctttgacacaactcgtaatgaatgcacaactttctctagttcagattcgaacttcgtcagatttttgtctacttcagttactataacacgtactgatagatttgtaaaatctttatagtcaatttttcctttaaatggataatgaattctacgatgccaggtagtattatttggaataaattccattcgttctgtttctgtatcaaacatccagaacccacgagggtcattctcgtcacctgctgttagtgtccatggtgtcccaatatatctgacgttagcagcctcagaaatagtatggaagtgaccagaccacacttctttataagtcttaaggaaatcaggttcaagaccatgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggatgcattacatttttatagtggagatcgtgatttcctacaatagtatgtaatgtgattccagcaccatcaagcatttgaactatttcacgggcaaactccatagttttatgcgtgattgcttttcgcacatcaaaaatatcaccatattgaatccatacagtaattccatttttcttagaatattctatcgcttgcttaattccatcaatttgaataccgcgaatccactcatcatcggctttaacgcctaaatgccaatcacctaaatttaaaattttcatatatcaagaaccgtcattgaaatgcaaaataaaattattgaaataaacccatctggcgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcatatgctttttctcgctcacggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaaaccggatttactcatgcgttcaagcatttcgctatttacataacggtcaagaatttgcgttggcaaattaggagcaattttaatttggtctacttgatgaagacgataatactcgtatggaattcccttttctttaataggaatgaacgctggagaacgttccagaccttccataatagtacttagtcctgcaggtttaagatgtttttcatgaaaatcaaacatctggtaaaaacctttccatgtagtcgtacgaccaatccaacggttgatattcatgttaatttcagaaacatctttccagtaggttgatcgaaccttcgcaatatccataggaggctgaaagttgtatacggtcggtgcttcttcaatatcatcaaacagagaaactgtttcaggataccattctttcatcaaaactttattaaagtcaccattatcagaatggctaaaaataacatcagctcgacgaacagtttcttctaatcccaaatttcggcgtaaagaaagagaagaatggtcatgctgataaactacaacacgaaccgaaggtttaatgttatcaataatttttttatagttattaattgtgtcttcttcgactgaagtagcaggaactgaattgataattagaatatcacaatcatttaccagcttaagcgttttatcgtattcttttgccaataaaaccggaattgaaaatgatttataatcatgtgcacagttacgagtaaatgatttatctttagcataaaccaaagttacttcatgaccatttttaataaaccaatcacgctgctcaagagaaaatttagttacaccacaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcacagttgccaccattttttgacttgataagaatcaacccacactttcatattagggtctgctcttacaataggaggattaacttctttaattgaactatcatggtattctttttcagaaattttcacacaaagatgaccattcagagattcagtaaatcctgcattaattttaagacgcttgaattttacgtgtgtaagcatcaatcatatcctcaatctgcgatctagtagtcttccaaagaatactaatgagttcatcgttgtatggctgttttagaatatcccgacttttcttgatagcatattcgtattgagcaaaattattattttcagctgcaatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgatacctgtaatttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacgaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacagtatgcttggaacactttttccatcatctttttaaattcatgaatatctatgtaatgactagttaaatcagcatgatataaaaagtctaaaaacttttcatgtgtactaacatattcactttcatttaattcagaaacatggctttcccaatatccaacaccagtcttatttgggaaaaatgaaattttcatgtatttgtcaacatagaaaatgccataattttcaatagtaatagaaatattaataaatttcatacattcatcaacttagccgcttcaagagctgcatctagtgaatcaaattgatcaacatattcaatcaattcgccgtaattagcatataaccaccattggctaaattcatactcaaggatgaatccgtttccttcaatttgagttaaaccaatgccatttgtatttacttcatacccagcaagacgtaaatcgttaataagagcttcgttcataattataccttagtaattttcaggtctgcaaattttttcttgcgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcaaagaaactactttatcatatgcgtaagaattaatgacgtttttaatttgaatagtcatacattatcctcaattacgttaaaattttattatccaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactgaccacttagttgtatcgccttttggagtaacatttaaagtatataacccctgcttaaaaagcattcgtttgatattcatattttcctcagctataacgataacactcgtttgatttacgtttagcaactcgttgagaagtattataatcaaaatcatcgtcaatgtaaactgattttttcaactttcttacttcaccgcgtaattgacgatttaactcatctttaacttctgaatcaatacctttcattctacgccatttatctgagcgaaaaatgttttcaaccatatctttatgacttacaccatcaggagctttacgctttccgaaatagtcataatcacgaactttcaagtctttacgacgatacgttttacccatggagtttaatttccttagcaactgaactaaatgcagcacgatcgcaaatcatgtgtttatgtaacttaagtataagataataaacatcataaccatttacgtaagtaacacgaacagcattaccattaatgagataatactgcccctttttaatttctttatcaaccataaccatatcaattcctcaaaggcaattcatatgttaataataccacagtttgagctcgttgtaaacaactttgtgaaaattattttagggaatgataagaagggaacgatagcttagaatggtaatatacagaatgtgagaaagaaggacccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagcggacgatcatactcaatcttaccgttatttgtaagaactttatagaaagtaaaaggagcattgagctcctttagaagttttgtaactgattgacatccaggacaacgacctacttcttcggggatgccatagatttcaatcttattctttaagttcgagttttgttccacgagaaataattccttgataagcccagtatggcgggttaacagaatcctcaccagagttttcttcaggaaaataaacctggataacaaatccagatgcatcaaaggtaaaataaaccgtaggcagttcacctaacaattcggcacgagcattaatttcttcgagatctcgttcacgtccagcccaaaaactaggatttagactacattcgtaaaaataatagtcattaccgaacatatcaaaacccttccaactctctaccacataccgctcaaaactaatcataattaagcctttttatcaagaacagaattcagcttgttagtaattttatccagacgctcattgaactcgctagaagataaacccttttctggagaaatcaaactaatcacgaaaaatatagcaataaaaggaataaggaaaatagctccaactgccataaacagaaagaatgttacagttgtaagaaaatcagctaaacctttacgaaatttatacatattttacccttaattgattaaccaagcattgataagcactaaactatactgcgaataaaattctggaccaaaatgaaaaatcatatcatttatagtatccataatgtaattcaatttaatcatgtgtccacaccccatcggtatttgaccaaagccgctgattatctgatcctctccacagctttttggtcggaagatttttctcatacttcccatcaataataacatcaacatatttaagcatttctagttgtttaatatcttcaaacttatatcctgtccacaaccaaatgcttttatttggataaagattttttactgtttgaacaatgcaatgaataacatctcgattatcaggatagagagggtctcctccagttatagttaatccttctatataatcattattcaaacattcaattaattgttctagtgtttcaccagtgaatggaataccatttctagcattccatgttgatttattataacacccttcacatttatgcaaacaacctgtaacgaaaagaacggtcctgcagccaggaccattaacaaaatcgcaaggataaaatctatcataattcattggtgtttaaccctatgcatgatttctttatttttaccgagattaaatccgcgttcgttcggatttcccaaataaccacacgttcttcttatggtattcatctttttaggatcagtttctccacaaatagaacaaacaaatccgttttcagtaggagtcatttcatgggtacttccgcatgtaaaacatttatctaccggcatgttaacaccaaaataatctaaatgttgtgcagcataatcccatacggcctcaagacctttcaagttatttttcatatcaggaagttcaacataagaaatgtgaccacctgtcgcaatgaaatgatatggcgcttcacgagaaatcttttcaaacggagtaatattttcttctactgaaacatggaaactattagtgtaccagcctttatcagtaacatcctttacacttccatatttttctgtatcaagtttacagaagcgataacaaaggttttcagcaggagtcgaatataaactaaaagcaaatccggttctttcagtccactgtttaagatgagcattcattttagttaaaatttctcgtccaatatcacgaccgacaagaatattcaattcgtgaataccaatgtatcctaaagacactgaacttctgccgtttttaaataactcaattatatcgtcatcaggtttaagacgaaccccgaatgcaccttcttgataaagaataggagcaacagtagctttaactccttttaaggaactaattctacacatcaaagcttcaaaacataaatccattcgctcattgaacaattcgataaatttctgttcattgaactgtgttccaatataagaatctaatgcgatacgaggaagattcagtgttacaacaccaagattattacgtccatcaagaatttcattaccggttgaatctttccacacactcaagaaactgcggcaacccattggagaaacaggaatagatgagccggtgatagctttattgttcttagctgaaataatatcaggatacattcttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgggcataattcagtgcatcagcgatttgccatttttctgcatcctcaatatgttttgcataggtgcgtttaacataaggagaaagtactttatctacattcgcaaaagtcgttccgccgtattggtgagaagcaacttgcgcagtaatttgtgccataattgcagtagcaacgccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaactgtgttttggtgtcagattcattatattcaaatcctctttgaagcatctcggccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttatgcttcatttgaccttctgcggcattgcatagattacaaagcaatccacgtacctttcctgcttttggtccatttaattcatggtcatgatcaagatgattagcttgaacatcaggatttagttctcgttggcaaattaagcatttaccgttttgtgcattataaaatttttgtttttcttctttgtataatttgccagtcaataacataataaaacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgccttgtcagaaaaagaattttgagttttttcaagtattataaaacatttgatgcaatcgcttatattgccgaatcatttggtcagaaaaagaattttgtgtttcaagccattcaatatattctgccgcagcttgcatcaggttaccttcataatcatcaatatcttttttcaatgccactttagctaatgcatatgaaatacgttcaccttgaaaagcggctttaggcttctgaacatcttggctagttctctctacaacttcttcaatttcgccattttcaacggattcagtattccacaagcaccaatacgtaattggcttatcatagatgttaataatctttccgtcggaaagttcaatttcaataattccagtatcaggctctatatcatcttcacattcttttgtaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccagggtttaaccccgaagcttattaagttcttcataatcaatccaggattctagtcctgatggcaaatcagattcaatttcccaaagaagctcttcaattttctgaagacgatttagttcttcagcaggaatagtaaccattgacggagttcttgatacgctaatatcgtaaatcatatttaccccagtttgaccatacaatcaccatatttccatttagaaatagacttttcaccgttagaataataaacttcaagtttagcacgattatttttaatttgaataacctttgctgtcatcaaagttccatacccataataaactgcaacttcatcacctacatataccgcgcttctgcggtaatcatgaatatagtcagttccttcgagcatcatttaaaatattctcgcagttggtcaaatccaccaatatgacttccatcaggagcaaatacctgaggcattgtcaagccgatttgagtatcacgacctagtttagtcagaagctcagcgattttctcatcatcaaaaacacctttttccggcataatgttgataaattcaaacggctgtttcttcacagtcaaaagacgttttgcattatcgcaatacacgcatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggtgtgttctgcaatttgggcttcaacttcaatcaaacgggcattgagatattcacgttcttcactcagattatcaaccttttctactttaggctcttttacaactgtcttatatgtattagggttcttcagtttaattagaatgcgtgaactgtacagcattgaaccattatcttcggtttcgtcatacatttccactacgtccataatttttaacatcatgcggagtttataagacaacgaacgaatagttttgttgtgcttattaatttctttagctgtcatggtgccaagattacgtgagtaataataaggaacctggatattaattaatactgatgaaccacctggcttgtgtgttacttcatcagcaataacccagtccttaacatgaactgtatttgtacggtcatcgcccgcggtaaatagtttgcgagcatgcttaaaaagcatattcacttggtcattgaattgacaagcaaatttatcagcaaatttagtttcaggaatggtagaaaaccaatcagccaaatgagtctttttaacatcattaacaatagtaaattcaaccaaatcggttatagatgtctcagatttaatgaaactcggcttcataaagtttttaatgttctcatgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgcccgatctgataattacggtgtttagtaataagactgtcaaaataatcaatataatgtttacgagttttcatattcttctcacttggttaatggtttatactccgagccatccttggctttaaattacttaattaactgtaaagcttgttcaagacgatccaggcgattaacagattcttcccaaatccttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaactgtatcctactacatctttagttcgtttaatttctttcccaaatttaccaagaatatcttgattaactaaatatgaaagaagacgagaacctttaaaagtttccttaatatcatctttatattcgcgactagaaattttatgaacttcatgaataaatttgcttgaagaaacaatacttgcatcaatattattgagccattgattgataatggaaataacactattctgactaaacacaggtttaactttatcatcaataacgctattgaatgatttgatatattcgttacgagtcatattaatctcctcagtagaaagtaagaacattataccacatccttgtggcaaagtaaactagtttagtgcatttagtgcgttgttcagtttagaacgttgcttcgtaagatttttgactttttcttgagctttttctagcatcttttcagcttctaacacttcattagttgctttaacgagttcatcatctactgccttgatagacttctcaatcgcatccgcgtgccatttttcaacaggtttaagactcggattttcaacaggaagaaaattcactttattgaatttccatgtatctttattacctgaactatacatccaaaatttaggatcgtttgatgagtaattggataaatttaagatatcttgcacttcctgctttttctcttgcgggacttcgtcctttctcaaaaaatcgtatttaaatgaaacgatcatatcaagttcatacgttgttgtatgttcccaatttcgctcaaaatgaggtaaaatcttagactgaaccgcggcaactacatccatatacttaaatgcttctgtcaactgtgatttaaggcattcacaaattgaaagagaattttttgtattaggtttaaagctaattcgtgcagttctgttattttcttttaatggtcttacttccatctgaagagtataaccatcaaatttcagattctttaagttaatatcagaaccttttaatcgactagccgtcgacaaaatttgctttaattgtttacggaatagagcaataaatctccactcaatacgataatgatttggattaaaaaatccagatgataaatcaaccttactctgaccaacgccttgaacaaatagaggatttttataatcaatagttttacagaaatcggtgagctgctcacgagccgtcatttgtgtaatataccccgctttactaaaatgacgtaaccattcactgctattcatatatttaaagtgaatatcacgattaactttatcagggtctaaattattttggcacaaaaatgtcataacatcacgagtatagctggcattacgaaccatatcttcaatttgagaacgagttttcatggtgttccttaagatttaagtaaatcgacaattttaattaacttttcacgctcagatttagctttactactcagtccagatagtctgaaaatttcatcatcatattgttgaatagaaatattcagctcttcaatctgtttattaaaataatcaatttgttcagagtgtttttcgttactacgaactggtacaggtttcgtaggcaatttagttgaactggattcatccgggcgataaattaaaatacaacttgaaccaatagggcattttgcaccagatgaatattctaatgttccagcttcttttaaaacttcaaaagctaaacagagatgatgccccatattaacataatctgtagagcgagctctgatgtaataatcatcgccacgaatactaaatttaaagcatttaaggtcttctgtattattggtcttaaaaatcatttgtttatctagacctttagctaatcgagcgcctaatgctaataatcgtctttgattttcccacaaatccgcaatcatttgatcgaatgataattttggcattagtcgaccataaaggtcatatcctttattataattacgaaggatttcactcgcattaatacgagacaatgctccaattttattaagggctttcataatgcgattagataaactcattccagatccgtttgttcgctgcaaatgtttttctaatccaaatccaatatcaactttaaacttatctaaaatttctgcatgaacatctctgtcaataacattcaaatccaaagttgagttaaatctatgaaaaaatttatctggctctgcactgcgaaatacagtccattcattcatcatttttttattaactaaagatttaattactgcattgacattattaattactactgacatattttcctcactcaatttcaattttactaaatatacagaataagatggaacagactatataagcaccacacacagattgaactaataccattccaaagaaccaaacaatattatcaaacaatgtctgttttacgtcgaaaggacgtaaacttacagtaatattatcacctttttctattgaagaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattttggcgttcagctctttgctttttgtaagtttcaatacgctctgaaatgagagtgtatcgttcatttactgattctttcataaaatcaggaatttcacgagaagctttaatctcgtcaaatttatcaataacagcttgctcttcagcaattaagttatcatacattaaaatatctttcttgataaactcaatatcttcttgagttacacgagataatttagatgctttatcctttttgtactgttcgttagtatcacgagaccagtgtaatgtacgatttttattcgtatttttgtaaatttctacaataccgatctcatcgataataacgatccaattccaacgggatttgtaaatttgtcctccatcaacagtgatttcacctccgattgagatgtcattaaagaacttgctttgcgcttcagatttaaatttaccatcgttgtaatttactaagttgaaaatatctttagcgttcattttctgttcctccgtagttgatagttgtatagtaccacggaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccattcaccagtttaattctagtcatctttttaatggcagtccatataatctatttctgaactgcctttttgtcatagaagtcctcttatgaattatttcagaagagtaacctcagcaatttcttcccaaccgtttttgtcggtcataataaagtcagcaagataaagagcagtacgcagtgaaacattgcgtaaacgattaacattaactttcatccatgataatgctttataagtttcttcatcagaaagaccgcgcttttgcatcatgtcagttgaaagaataacatcttcaaccctgaccataatttcttcattagtgtgaacacccaaatccaaataaaccgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagacgcagtgctccagcagactttacgggtctctccggtgtccagagcggcttttagaagattaagaatgtccatatcagagaaaacatccacatcatcaatcaaaaggacagaattctcttcacgattattccaaagctgctcataaagaccaataccagagattttaccattaatgcttttatattcaatgtatccaatatcatttgctttatttaaagctttatctaaagaatacgttttaccaatacctgctgcgccagagataattaatgaacgaatatttccgttaataataccattcgtcatcattcccataacattaaatcttttattaatgcgggttttcatatcttcatatgattctttaacttcttcaacttttacaccatcatatgaaatatctgatttgtaaacccaaacaccgcgacgtttaccgtcaatttcaacaaaaactttaccatctccttgtgcatctaccggagcattatctgggaaccattcgcctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgagcgagataaactgcattatcttcagttgcatcttctaagaaactttcaaaacactctgaaatttcttctgtgtcaatcaacttttttacttcaattggtgtaattttcattttgtttttccgtttaagtgtttgttttgatagttgtatagtaccataaagctttatgcttgtaaacaattttgtgaaaaatttttgaaataaaaagggagcccgaaggctccctatcatttataataacttcggtggttttcaagataaaccctctcaaggaagtcatcccaaaaacccatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttggagtccaccacggcaagcatgactcagagctttccagtcaataccttcattggcttcggccttacgagcacgttcacagtattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccactgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactagttcaggtggagtgtgaagcatatctaacgctacagtttcaccatctgctgctaatttaaagaaatatttaagactgtatagttcatggtcaatatcatctttagtgtttttagatgatgtgttgttagtgtttttactcatgtgctctttgacatttccgataagaatatcgcgagcaggaggaacaaagatttctttaaaatctacatcagattctggggtagaagttccataaagatgactaccaaaatagcttttcattactgttttcatcattcagccttatattcaataacaggacatactttagctttacgagcttttaaaaattcaacgataaccgatttcttgggttgaataggaggtaaacctttatacgccctatcaatattttctacgtgtaaagcataatcctttttccatttataatctttatatttttcacgcaaatgtgcaggaataacaaatgaaccgataataagtaaaacaaccaaaagcgcaagtataaatgctgatggaagaagagtccataaactaccaaaaataagccatttctgtaggctttctgcacaaataattgttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattataatcatcctttcattgaaggtgtaacagttgttaaatacttaatcatagcctcagcttctgattttgataatgaaatttctccattgttttgacgaatagaaataaaatccggatgacggtcaccaccagcttttaaaacacacatataagtatcagtttcatcttcaatatttgaaatgattgaagcagttccacatgaatgcggtttttgataaatcaatacagcttttcttccgccatttgactgttcataaacttttaatacatcaaacaaatcacttcttttatcaatagctaaaatgttattttcatcttcaacgttaaatccttcggatacttcataaagtgttacccataaatcgccaatatcaataacagcgttcacttttccatgactttcaagagcatgacaaattttcttgatttcgtcataactcattttaataatatcatctccttgaataagaaagatgtcatttttaaattcaacacgaattaaaccacttccacttgaaataaacatatttcctcactttgaaatcatagttggaatgacagaatcaagataattctttagcgcaatagcttcgtctttggtaaatgtgacaatatgtgctcgagaatcatcattttggcgaacaagtacgacatcgccatcttcataagaagtcttgacatccaaagtcgtagtatagtttgcagctactggattaataatgctagcaccgcgatctttagcccattgaagtttaaccttttcgggtgtttcgactgtttcagattccaagaattctttcaccttggcaacgaatgttgcccaattgttgatagaaagacacataaattcagtttcaatattaccgccgtaaaggccacgataaaaacgaacttggaggtcgcctgtaatattagttacaccggtaactcctgagggagcataagataaaatcgcagccagttccataggaagaatagtaatactatcgtcttcctgcgtcagaacgtatacattatcacgtttttcgataaccaggtcaccgaacaaatcagttgtttcaattacagctttcatattatttaccaattaaagtttcaatataagaatcaagatttactttagcttcttccataagaattttgtatttaatcttgttagcatgtccggagaaagctgattcatcaataattgttgatgtatgaacagctctactatacgtctcaattaattctcttaatttaaaagcctgctcacttgtcattacatactcctttgaaccatatcaataatgttattcaccagattataagtaaacattgggtaattatattgaatcatcacatacacaacaaacaaaactttcattctcttctccttggcagttgacaagattactataccataaccttgccaacttgtaaaccattaaatggcgttttcaataaaattctgaagctttgtgtgagcatcaaccatgattttcatttcttctttggcgaaagctgtacctctttcccgagaagaacattcatagtcagaaactgcattagcatattcttcaattagtttcattaaaaacatctgcttttcagttttcattattccacctaatcatttcaagatattgaactaacttagctttggatttatccaaatcctttttagctgcttctataccatcgtatgaatatccttcacaatgctcaactgctaattggtatgaatctatttcaatatcacgtgctaatttaatgattttttcaaactgttcacgtgttagcatacttaagctctcgtattatgatcaataatttcatcaagaaacatatctaacgcttctatagcattatccactttagtttcaaagtctttaatgcctttattcgaaatacccgatgaataccaagcaaagtcaatcagctcttcatctgctttacgaattgaagccactaattccttgattttatctgcttgctctatactaatcattattccaccacatatgacagagagaatattgcacacgccatgtgagttgcaacttcatcacacatattataacgtttcttaagaagttctacaagttcttcactagtaacttcatccatgtcgacgaaaaaatcaccattaatgatgacgtagatatttccttcttgattaagtgcttcaattttcatgatgttctcctctttatctaatagttgtatagtatcacggctcaaacgaaaagtaaaccggtaaaatgaaaaaagtctcccgaaggagactaatgctattcgagggaaagaagatatttactttggtaaaacattccagtaatatcatctatcgtgctttggatggctggaggcatttctttataaatgctgttagattggtctagtatgcgatcaatcattttaattgtgtcggtaggaagtttactggcatctggaattgaaggcgtgtattttctaccagaataccccaaatattgctcaccaaatttatcaatcaaatctggcaactcagagaaaataaaatcgtatgctttgtgtctagcataacttttagtttcaaaatgtgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgttctatacattcaaaatcagaagagcacgggtcatttttataggtcgttctcataaaactatagaactgttcagatgattctacgcttttattttcaaaaagcatataaacatgtctaataccagattccataaatttatcaaaatgaggatcgacattcgcttcaattggtggagataaagcaaatgacaatcctagcatggcaaaaagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagcacagtaagattgcgaagttgcttttcagttaattgtagcatatatacccctttagttagataaacctatttataacttttgcactaaccgagctttttagttaattcattccaatgttttctacacagagaaacataaatttcatcaccaatacagatttgattaccttctttaactggtgttccatcttccattaatcgagctgtcataatcgcttttttgccgcaatgacaaactgcttttagttcaataagtttatctgcaatcgctaaaagttctttagaaccttcaaacaattttccagcgaaatcagtccttaatccataagccataacaggaacattatatgtatcaacaattcgacttaattgatgcacctgttcagtttttaaaaactgagcttcatctacaaatacgcaatgaatatctttttgtgcttcggcccatttatagaactcgaaaatatccatatcatctgtaataatattcgcttcctgtttaattccaatgcgagaaacaacttcacagacagaatcgcgagtatcaatagcaggcttaagaactaatacactcattccacgttctttataattatgtgcagcagtcaaaagagaagcagattttccagcattcattgctgcataagtaaaaattaaactcgccatatcaccttcttaaagcgtattcacataagctattaattcattttctttcttatcaaaccgatcagcaaattcttcctgctgttcaggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattaacagcgagttcaattaaattatcaagctcacgtaacacttcgtattgtaactcaaaactattcattttggtttaccttctttaacgaaatcaggataaggataaaatcctgaataaaatccttcacctttatgattgatgcatcctttattagaacaatagcaccaataatcgaaatcacaagccatttcatcattacataaagcaaaaacaaccggccacttacacttttcacaatgggcatttttaagaatactagtttggctcataaccatgtcaccttcaagcaatattcttctacatgctgtttacgacctttcttatcaataaaggtatattcaacgaatgttccaatgtagtctttatctacatcatgtggactattaattggacatttagtacggcaaatgcgttcccattgacgaataattactgctttgtttttaggatcaaacggatgcgggtaatgtactttcataatccaccactattaaatcaatatcaggagtaaacatgtcaattaatttagaaaccttatcccaatcgccgccagcgataccacaacctatgcgtggaatgtaaattactggtttgaacaaaagggtttctgcctgtagatttaattctatcatgcagtttactaaagcaccataatcaagattaggacctggttcgtattgcgtgtacaagttataacatatgccaaaaccattaggtttatgtttaaaaacaatagacatatcgcctaatttatcacgagaaccgtactcagtagtggttttatctatttctaaaattttgggataggctcttgctaattgacccgctacacctgaacccatagtatgaaaacaattgcacccgtgcgcaataatattaccttgaagaaatagggcgacaatatcgcccttgatatattttacaatcatctagtactcaatcctcgattataagaatctaccaaacggtcaaccattgaatgacaagcggctttatctttctcctccgcaactgaacattctaaagtattccactttttagcatatcgttttaacaatgtatcgtttttgtatctgcttgatttatctctttctccgtctttatatgcatatattaatttctgcgcaaattcagcttggcatgctttatttttcccgcaataatccgctgcagtacggtttacatactctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaacctgctttaacattccatcccgaattataagaggatattgcttttcttatatcacccttatgtatatttaaccaataagaaagttcaatgtacgcccaggaagctgaattggatcgtttattcaacattctttttatttcagcatcggtcatattataaccaagttccttaactctcgctcgcatagtaggcaaataattttggaacattccataagcgtgatgctttggtttagattttaaattaactccgccagagctttcttgccataaaatggcagccattatatgacctaatccgctcttgtggatatttttgtgtgttttatattttccatccttagaaaactgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctgcattggagtgacgggtctttgaacttctcattaggtttacaaactgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttgtggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaaatgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtaagtttttaagctgttcaagacgctgctcatagtaagcaatttcatcttcttcgagacagtcctgtgaatcttctttaagataacgtgcatagtcctgaaaagctttacggactacttcctggaagtcatcaagactttgaattttcttaggagcgacagatacacgacgaggtgcagtataattactcataaccaaaccctgcacttaattgagccattagtatttttcctctggttggaacactgcacgacaagcccacatactggcttctttgagtttcgttttagcaatagttaactgatcgaggctttcagcataattcttcgcgagttcatagtcttcacagctatcaaatgcttcccaaaattcatcgtataaagcatcaaagataagtcctaaacgaacttcagcgtctttgatagcattcactttaccgattttctcttcagtatgcggcttataacctttaatgtcttcaatcatatttgacttcctcaccagtacataaatcatattcaactaaacgaataggttcatgaatgccatatccttgaacagaaatttctgtcgtaggataaattccatcaatatcacccatattccaggcttcattaaattgctgttcgcctgaattactaaaccactcggcgaaagcatttagcacatcttcagaaccttcaataattatctttgccattacaaactctcggtaaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgctgaccaccttcaattttaactgtaggctgttgctcaatttcaatttcacgggcatgcaaaccgtagaaaatttctgggtctacaaaagagtcctctttaaaggttttagagacaataattcgtgcttgaataccatcttcaaaataaatagtacctttgtgtgtgccttcaagaatttgatatgctttcatataaacctcaattagaaaataaatttatccaagattgttctttaattaaaaatggctcagaatcatatgccattaaactttgggtgattagtcctttaaaaggtccatcaataaattccatggtaaaatatggaattttattcattagccgtgcattaggagcagtgcacaaaactctgcatcctttgaatacgcctttttgtaatttgtattgcttgggataaaattcgctcaaaatgttattatttgccaaaatttcaaaatgattcaccaatttatttttaatagtttttggcgaaaaataaagatattcgaaaagctgtgtgtctgtcatcattgcattccaatcacaaaaaattgaggacgaactgtttcacctgtttcagcattatagcttcgacaacagtgttgtaccgttttaatatggatattgtaaatcttatccatatcaggagctttaataggttcgtcaattatgtacaagatacgagaaagcgataacccacggaatttatgaccttcattaccgataaaactacggacagaatcagtaaataaacggaatcgaatatcatcgctagaataacgagaaaattctttttcaatgttgccagcagaaattttagcgtaagctgaagtattagaaagaacaataactgttccgccatcatacagccaattagcagcaaagttagtcacagcaattgatttaccggattgacgtccaccatctatacgaagtgtgcagtactgtttgagcacatcttccattggtggaagataatcattcttacaaatttcttctactctagcatcagaatggtgtgtaaaagcattcatcagggatagataaggaccagttaaaaatgttctcattttattctctctaagtttgggccattccgtggcgcatgaattgtccatttctgtatttacccattaccgcacttgggctcgaccttatcacaggttagcgggaatccctcacagaatcatgaggtccaggttgttcccatattatttgaacgatttaacgtactgaatagaacccttactattcacaaaggcaattttaccatttttattatacatggtagcagtacgctgataaccataggtttgtttaccagattgataaccaactaatgcaaaattatcttcacccattttattctgtttagcgcgaatgcgttcatgaccatgtgccataagaaccttagcatcaccagttgcaatggatcgacgagttttttcatcttcaactgcattaacaaagtcgtcaaatgaatcaaatttagcatgagatttattatacaattttccatctactgcataattatatccctgtacatccatctcaacttctgtaccatcatccaatacagcagtaattttttgaccttttttaaatttcaaaagatcagtaaaagattcagcaataatttgagaattaatagctgcttcagtgataaattcttgatatgttttcatgggtttcctttaaatgtaaatatttttaccgtaatacttataccaatgtggtttcattaaaattttttcatcaagtcgttgttgactcaatttaatagctgatttgcatggattataatcatttttccattctattggaatatcgctgatgtcaggaacttcagtatcttttatactgaacccgcgttttaagcattccgttataatgtctaattgacgctttcgcaaaaattctaacttatcgtaaaagaacgtaacatgaccagaacctaaaataaactcggaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaataactttatagatttttatacgcgtcccaagtgccagttctaaacgtagcaatgactcgttttgcgcggttaggtgtttgattataccatctacttttagctaagttaactgctgcttcatcccagcgtttttgctgaagcatacgtaaagaattagtaaatcctgccacaccggtttctcccatttggaaaaccatattaatcaatgcacagcgacgaacagcatcaagagaatcataaactggttttaatttagcatttctcaaaattccacgaacagcagcatcaacatcctgattaaagagtttttcagcctcatcttttgtaattacaccattgcaattacgcccaatagctttatctaattcagatttagcaacattaagtgatggacttttagtaagcaaatgaccaatgccaatagtgtaatagccttctgtgtctttatagattttaagtctaagaccttcatctatacgtaacatttcaaatatattcataatacctcctaagtgtttatagaaggtatttataaaattaaaagaggttgttcattattcggtaaagtgaaggacccatcacatattgccactgagtacgaggaataagagcaaaagcatccatctctggaatcataacgccatctttattttcaaaataagactcgcaatggcaatttctgaacatctcatgctctactggaatcgtataataaaataactgtaagtctttattactagaatatttaaatatacctaggtcttctagaaggtctggattataattgctaaaaccggtctcttctaagcattctctttttgcagcttccagtgcattcaaatcagaactttctacacgcccctttggaatatcccagcgatgtgccatcattccaggcttacgagaaccagtaacccgacccataaataaatctttatcttctgtcataaagataataccagctgatagtgttttcattttaatttcctgcattcagtgataaagttatttaaattttgagtatatttcttttcatcaaaaatcttttgttgtctgcgtagccgccatggcatttcaatgaacgtgtaccatatcccagataatattgctgcagtaaaaatattaacaagtatggttaaaagaatccaatctcctattctgtccattggattttttataaaaaagtaaaatacgaatgatgtcacaggaagactaataatataccacagaatcataattttatctgtgaaccaatcagcgttcgttaacttagcgctaccattatgaatacacacgaatttatcatctgttataatagatggcttagctgcttgatatcccattctaaactccctaatcaacaaatttttcatatcttcggaacaaccattccagtcaactctatcaactgaaatgccatcatccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacattgtaccaaagaatgaaaataatgaaatcgctatagtataatgaagttcactccaaacttctattatatctattataccgctgacgttactacggatgtttaaaataagacagtcaattaacaatccaaaaagactacccgcaagagatgcagccaacgctacagcaaaaattaaaaatgactcaggaagagaatatttgactttatttagttttggcttttgcatcgtgattccttaacaaatttcataatttcatcaaattcatgcgcagcaagtttaagctgatgttcctttttaatctttttacactgagctttccaatcacgtacacgtttacgatagtgtcttccttgataccaatatcctatccaatttataggtactaataaaagcggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttggttcatacttcacaggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcataggtttcaaacatcggatgatcaggaccgataactttaatatcattcactgtacgaccgaaatcttctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgagcatgtgggttatctttgaaactataagcacgagctagtttttggccttcagttttgattactaaaagctctttaaggatagcttcatatttggagataattcctttaacaatatttttctcttgtgcgactttaggatctgctttaggagcaggtttacccgaagcctttgcaaaagcagcgccagtagcaactaaacttttccaggccatactaactgcatttcccgtaaatccttccgctttcatgtcgcgtgcgaactggaatcgtgattcatcagaagcatctttgtaagaatatttacccgctgcaatggctgcttttgcgacagcttgaatttcggtgctagatgcttcatttaacaccgcttcatttaaaaattgagtatatgatttcatcttatttcctgttttaattcggggttttaatatacttatttatactaaaaagccccaacctttcggtcggggctaagccttgcggcaaccttgtcggggttccacctgctaaggcaagtgtttgtacgaaacgccgggattcgaacccggttattaagcagttgacgctactcaatatttttaaaaggccatatccgaacgttccgtcaaaaacgctactcggcttacggcaaagatatttcctcgaatcgataattctgtgcgccgtttcagctgtgatagtaaagagccagaacacagtaaaactgtgggaggaaactatactccagggaacatcagtccgacgacttaccggtagcgacccggcttcttgtttggtcgagacagaaggattctaaccttcaacctacggattagaagtccgttgctctatacaattgagctatgccccgtaatttaaaatttcatttttcgacctttaaaccatccttctggaattgggtcagttttcttaatacgcttagaaactttttcatctaatgaatgaatccacatcataccgaattgggaattcttttcaccttgttggtgtttatttctggcgtgagattctttcattttattaatagtttcaggagtatgggtcttacccaagaaagatttagtatttaaaaatttctctctatacttaggattatcccaaagctgtttaaacctttctgaacccattttacgatatttttctttaaggtctgggtcgttctcaaatctggttttaaaagcagcagccccttttaaggaagcttctttctttttatccaaatattctttagtgtttaaatggtcccaaccaccttcaccacctaatttcaaattataaacatcagggcgctttaaaaactcttcagtcacaatattcttttctgactcaaacatagaggttttatcgtcaaagagctctaatatttctttagagaaattttctataccatacttgtcttgggatctttttaataatttaccagaacccatatatccatcatctaaattttcggtagaatgagcgcctatatagattttattattaattttatttgttattttataagtgtaatggaacataaatatctcctatttctaagagtatttatgatcccaaaatatggccctgggtggaattgaaccaccatctggcgattatgagtcgcttgcttgaaccttccagctacagggccttgatatgctgattgacggaatcgaaccgccgacatcctcattacaagtgaggtgctctacctactgagctaaatcagcgaaattacggaggcgataggatttgaacctatgagtcgccggagcgactgccggttttcaagaccggtgcattcaaccactctgccacgcctccagtctccgtggcaggatttgaacctacgacattctgctcccaaagcagacgctctaccaaactgagctacacggagtaaattaaatttgagcggataatgagaatcgaactcacatcatcagattggaagtctgaggtaataccattatacgatatccgcaaactttggtacgagaagtgggactcgaacccacaaggaaatcattccgcagcattttaagtgctgtgcctttaccaatttgaccattctcgcgctgggaataaaggactcgaacctttgcatcctggaatcaaaatccagtgccttaccaacttggctaattcccaattattaacaaaggctctcaagcaagaacccttgatgatagagggtattaatcagtgcgatatgagttaataataacaaataattcttaaagcatatttaccatttatgataatacatgtttacgatgcattcaagacccaaaggattcttgaaaatatcatattcaagaggacctttttctgtttcaataaagaaatcaaaatttactgtattaaatttacggtcttcctttactaatttaacttgagaagatgaacggtcaatgtaaaccttttcaacttcaaaacatgttaaaatgccataatcatcaatcaaggctttagctgcttcttgatcatatttatatccattttcaatggatgatactttagcataaagaatcattatcaaccttcatcaacaacagtatgcgtattggcatttacgatttgccaccaatcaaagcgattagaaccatacatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaacacattttctgctgtagtcaataatccacatataaatccaacaaacattgaaaaactaaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgactgcagcagcaagttctttaatacgagagaaaagacgctcagcttcagctaaagccattccaagctttacttccataccgtgagaagattcagtgatagtagtttttgtagcaaactctttgaaagttttcattttattttcctaattaattttgatgaggtaatagtatcactacctcatcagcgtgtaaacaactttatgaagttattttaaatcatctgtccaatcgagtttaagaggctctttatattcacgatctaatacgaccggaatttgtacatcaccgctaaatgataagggtccaacattataagacagtgttatatgcggtgtgtaatcgtcaaaatcatgtgtagcacctagcgcccgcgcatacatgtgtcgacagcgcagatattcagaatctagtacaagtacaagagtagatccatcttgtgttttccatacttctaaatgtccagaagaagctacttcaaaacttccgcttgatggaacatacggaacatttactcttgaataacatatagtcgaatgaattttttctctaggaactggattaggaacacgtaaagagcgctgaagttcttccagcgcatcaagtgttaattctgaaaacttagctgctacataaagacccgttgaaaagtctttaaattccattattcttcatcttttgcttcatctgcagattcagcagtaagattcttgacagcttcaacgatttcttcaaccttaatagtatctccagtgatacctactgcacgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattaccgtagcacccatcgccctagccgcatccatttcatgatcttgacgagtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacctttaattgggcttttaccattaagatagcaaaatgcttgttccataattgtgattacttctaatttagtcagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagataggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccacgacttaagttcttcatcaactataaatctcacaatgagtggatcatactcaaatgtaacacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagagcttgcgacatatattcctcataatgctttataactgttggtggtataatgggtctaagtcccttccattcaattccatttagaacaaacaatagaaaagaatggaagataatagaattagatatttgaccagactttgtttgcagagaaacgttttccttttgaaacgaactgctgaagtggcatcaacacaacgttcgcccagtctttcggggcgatttcaacaaggctacccataatattaccgggtatatatgccttaatcatttggtctgcacccctaaatcctttcacttgactccaatcaatttttaatttcgttttattagtaatagtaggtgtatttgaatattgctttaaaagctcttctaggaattgctggcgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttcctgtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttagaattctaaattttattccacgcttttcagctaaagcttgcgctgctttccatttgtcggtattaacggaatatgtataaatttcattcataaatcttttcttcgctgcggttgttagatgtgctggtttaactggtggttgtgtttcttttttaggctttatttcaataaaaaattcttgtccagaagaatctttcatccaaatatccatgaagtatctacgttttttcccttcggcattacaaaaataaggaattactgctgtttcactaccccatgcaataatttctggatttttatctaaccattcaaaaaagaatttttcccaatttgatctatacgtaatttttttagggtcacctctatattttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttaccggaaatttggaatcatacggtattgaagttaaaacaccagctaggtctctgtcggcaatggctgctactgtggcgaagtcttctgatccagctgaccctcctattccaaatgactcaagaattttattcaaagaaccagtttcttcatataaaggtgaatatccttatgtgcatacaatggaaactgaaagtggacatattcaggaatttgatgatacccctgggcaagaacgatacagattagttcatccaactggaacttatgaagaagtatcaccgtcaggaagaagaacaagaaaaactgttgataatttgtatgatataacaaatgctgatggtaattttttggtagccggcgataaaaagactaacgtcggtggatcagaaatttattacaacatggataatcgtcttcaccaaatagatggaagcaatacgatatttgtacgtggcgatgaaactaagacggttgaaggtaatggaactatcctagttaaaggtaatgttactattgtagttgaaggtaatgctgacattacagttaaaggagatgctaccactttagttgaaggaaatcagactaatacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtatttggttttggaaatgacgcgttgaaatatcgtttaggcgatgaatttaaaactgctgcttcatgggaagaacttccaactgattctgatactcagttgtatttgtggaaagctccccaaaacctccagaagacattcacttacgaagtaacattaatatatgactatcaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataaatgtgttactgctggtcatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttagcttataatacattgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaatactgaattctattttggtgaaggtgaaatttctgttaatgcttctgaaggagctttgaccgctaattatatcggaggtcttaaacctactcagaactctacgattgttattgagtacatcagtactaatggtgctgacgcgaacggagcagtcggattttcatacgcagatacattaacaaatataactgtcatcaatattaatgaaaatccaaacgatgacccagattttgttggggcagatggcggcggtgatccagaagatattgagcgtatccgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgtgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgcatagtatcaacagaccgagattctaaaggaattggtaaagttattattggtccatttgcttctggcgatgttacagaaaatgaaaacattcagccatatacaggcaacgattttaacaaattagcaaattatgatggacgcgacaaatactatgttatcggtgaaataaattatccagctgatgtgatttattggaatatcgctaaaattaatttaacatctaaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacgaactcgggggaaaatctcccgagtaatcaatacagatggattaacttaggatatactgcaaataacagcttcttttttgatgatgctgacccattgacatcatacattatcagagtagctacagctgcgcaagattttgagcagtctgattggatttataccgaagagtttgaaacttttgctacaaatgcttatacatttcaaaacatgattgaaatgcaattagccaataaattcattcaggaaaaatttactcttaataattctgattatgttaattttaacaatgacactataatggctgcattgatgaatgaatcatttcaattcagcccatcgtatgttgatgtttcatcaataagtaattttattattggtgaaaatgagtatcatgaaatacaaggttctattcagcaagtatgtaaggatattaaccgagtttatttgatggaatcagaaggaattctatatctttttgagcgctatcaacctgtagttaaagtatccaatgataaaggacaaacctggaaagccgtaaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagcaatgcacctatagattctgatccattatctccaacatattcggaaaggctatttgaacctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttattatgattttaactatcgtgtgagagatacagtagaaattatttggaagccgactggagtatttttaaaagcatttttacaaaaccaagagcatgagactccttggtcgccagaagaagagcatggattagctgaccctgatttaagaccattaattggcacaatgatgcctgattcttatttgttgcaggattcgaattttgaggcattttgtgaagcatatattcaatatctttctgacggatacggaactcagtataataatttacgaaatttaattcgtaatcagtatccacgagaagagcatgcgtgggaatatttgtggtcagagatatataaaagaaacatttatttaaatgctgacaaacgtgatgctgttgcaagattttttgaatcacgtagttatgatttttattctactaaaggaattgaagcatcatacaaatttctttttaaagttctttataatgaagaagttgaaattgaaattgaatctggggctggtactgaatatgacataatcgttcaatctgattctttgactgaagatttagtaggacaaacgatttatacagccacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaataatatagactatattaatagaagtcgatcatattatgtaatgaaaattaaatccaatttaccttcttctcgttggaaatctgacgttattcgttttgttcatccagtaggatttggatttatagcaattacacttttaacaatgtttattaatgttggtttaactcttaaacacacagagactataattaataaatacaaaaactataaatgggattctggattgcctactgaatatgctgatagagtagctaaattaactccagctggtgaaattgaacatgattcagtaacaggcgaagcaatttatgaacctggtccaaaggctggtgtaaaatatcctcttcctgatgactataatgctgaaaataataattcaatatttcaaggtcaattgccgtctgaacgacgtaaattaatgagtcctttatttgatgcatctggaacaacatttgcgcaatttagagatttagttaataaacgtctaaaagacaatataggaaatccaagagaccctgaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccaccttatcctaccgattctgtattaggtgtaactgacatgtggactcatatgatgggaacagtaaaagttcttccatctatgcttgatgcagttattcctcgtcgagattggggagatactagatatccggatccatacacatttagaattaatgatattgtagtgtgcaactcagctccttacaacgctactgaatcaggcgcgggatggttagtgtatcgctgtttagatgttcctgatactggaatgtgctcaatagcatctttaactaataaggatgaatgccttaaattaggtggaaaatggactccttctgctaggtcaatgactcctcctgaaggccgaggagatgctgaaggaacaattgaacccggcgatggatatgtatgggaatatctttttgagattccgcctgatgtatctataaatagatgcacgaatgagtatattgtagttccttggcctgaggaattaaaagaagacccgactagatgggggtatgaagataatctcacttggcagcaagatgattttgggttaatttatcgtgttaaagctaatacaattcgttttaaagcatatttagattcagtttattttcctgaagctgcattgccgggaaataaaggatttagacaaatatcgataattacaaatcctcttgaagctaaagttcatccaaatgatccaaacgttaaagctgaaaaggattattatgatcctgaagatttaatgaggcattcgggtgaaatgatttatatggaaaataggccacctattattatggcaatggatcagacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataacgcgtttggcgatcaacgtaaaatggcagtagcaaatggcactggagctgatggtcaaattatccatgctactggatattatcaaaagcactctatcgcggagtacgcaactccagtgaaagttggcactagacatgatattgatacttctaccgtaggtgttaaagttatcattgaaagaggcgaacttggcgactgcgttgaatttattaactcgaatggatcaatatcagttactaatcctttaacgattcaagctattgattcaattaaaggcgtttcaggtaatttagtagtaactagtccatatagtaaagttactttacgttgtatttcatctgataattctacgtcggtttggaattattctattgaaagtatgtttgggcaaaaggaatcaccagctgaaggtacatggaatatttctacatctggatcagttgacattccactatttcatcgcactgaatacaatatggctaaattgctagttacgtgccaatcagtagatggaagaaaaattaaaacagcagaaataaatattcttgtggatactgttaattcagaggtcatttcttctgaatatgctgtcatgcgagttgggaatgaaaccgaagaagacgaaatcgctaatattgcatttagtattaaagaaaattacgtaacggcgactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattatgaactcggtgatggtaatgttccatattcagccggtgcttggaaaacttataatgcttcatctgggcaaacattaaaagctgaatggggaaaatcatacgctattaatacttcgtctggaagagtaacactgcaacttcctaaaggaactgttaatgattataataaagtaattagagctagggatgtatttgcaacatggaatgttaatccagttactttagtagccgcttctggtgatactatcaaaggatcatcgtcatcggttgaaattaacgttcaatttagtgatttagagctagtttattgcgctccgggccgttgggaatatgtcaaaaataaacaaattgacaaaattattagttcagacattagcaatgtagctcgtaaagaatttttagtcgaagttcaaggacaaacagactttttagatattttccgtggaactagttataatgttaataacatcagagtaaaacaccgcggtaatgaattgtattacggcgatgtttttagcgaaaatagcgactttggttctcctggagaaaatgaaggcgaattagttcctcttgatggatttaatattcgattaagacagccttgtaatattggtgacactgttcaaattgaaacatttatggatggtgtatcacaatggagaagttcatatacaagacgccaaataaaagtattagattcaaaattaacgtcaaaaacttctttagaaggaagtatttacgttactgatttatcaacaatgaaatcaattccattctctgcatttggattaattcctggagaacctattaatcctaattctcttgaagttcgttttaatggaattttacaacaacaagctggaacagctggatatcctctgtttttgtgtgaaggcgctagttcagatacgcaagaaggatgtatatctcttggtggtgaatggaaagaatcaaacacagattattctatagaatatgaagatggaaaacctaccagtcttttatttgatagaaaatttgaatcaggcgatataatcgttataacgtggttcaataatgatttaggaactcttttagaaaaagatgacatcattgaattgactgatgaccgttatgttagcaaaggatcatctaccgaagttactggtgatgtagccttaacagattttgataaaatcggttggccaaatgttgaaaaagttgattcttatactagaacgtataattcaatatcatctattttcgatagcatttatcctgtaggttcaatttatgaaaatgctataaatccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggaacaacatcagtaacgcttgaaaacgcaaatcttcctgcgactaaaactgatgaaaaagttttaattgaagatgaaaacggatcagttattattggaggttgtcaatatgacccagacgaaactggtcctatatatacaaaatatcgtgaagactacgcaacaacaaactcttcacatactcctcctactaatattagtaatattcaaccgtctattactgtataccgttggataaggattgcataatgagtttacttaataataaagcgggagttatttcccgcttagcagattttcttggttttagaactaagaaaaatgatatttcgattatgaataatcagccagtaggcgctgtaacaatttcacaaatatcaaaaggtttttatgattcaaatgtagaatctgctatcaatgacgttagaaatatggcagagcaaccggttggagctgtattagttaatataagcggcgtatctcctactggcgtgcaacaaaccgactattggtcatttgaaggaactgttactgatacttcagtcaaatcaggtgacccagttattgttaacatgtttggtattccagttaaagctactaatggaatgacttcaattgaatttactagtgccgttagaatagctctacaggaaatggttgtaaaatttattgcaattgattcatttgaagaccatcctaccataggaaataaaatacaagttaagtatttagataaccaagaacatatcttagaacaatactctgataaaggaattactttcaaacaggaaataatttctccttctaaacctgggtatggaacttggcaattattaggtgcgcaaactgttacgctagatagtcacacacaacctacagtattttattattttgagagagtagcatgagtaacaatacatatcagcacgtatcaaatgaatcaaaatatgttaaattcgatccagtaggatcgaattttcctggcactgttacgacagtacagtctgcattatcaaaaataagtaatatcggcgtaaatggtattcctgatgcaactatggaagttaaaggaatagcaatgattgcgtcagagcaagaggttttagatggaactaataattctaaaatcgttacaccagctacattagcaacaagattattgtatccaaatgctactgaaactaaatatggtttaacgcgttattcaacaaatgaagaaacattaaaaggctcagataataattcatcaataacaccacaaaaactgaaataccacactgacgatgtgttcaaaaatagatattcgtctgagtcatcaaacggggttattaaaatatcatctacacctgcagctttggctggagttgatgatactactgcgatgactccgctaaaaacccaaaaacttgcaataaaattaatttcgcaaatagctccttcagaagacactgcaacagaatcggtgagaggagtagttcaattatctactgttgcacaaattcgtcaaggaactctccgcgaaggatatgcaatttccccgtatacctttatgaattctgttgcaacacatgaatataagggtgttatacgcctaggaacgcagactgaaattaataataatttgggtggtgttgcagtaacaggtgaaacactaaatggtcgaggagctaccggttctatgcgtggagtagttaaattaacgacgcaagccggtattgcccctgaaggtgatagctctggagcattagcatggaacgcagatgtaattaatactcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagccggcacaggcggtcatattttaaatcaacgtggacaagatggctatggaaaggatagactgggcgtaggatgtgacggaatgcatgttggtggtgttcaggcacaacaaatgtcataccataaacatgctggtggttggggtgaatataacagaagtgaaggcccatttggcgcgtccgtttatcaaggatatcttggaactagaaaatatgccgactgggataatgcttcatacttcactaatgatggatttgaattaggtggaccgagagatgcccttggtacacttaatcgtgaaggattaattggttatgaaactagaccatggaatatatcattaaactatattattaaaattcattactaaggattacaaatgattgaattaaaagatttaccttttgttgatagcgttcctggcgaaggtcaggaacgtatttcatggattaaaaatggtgaagaaatattaggagctagtactaagtatggaaatgatggatcaatgaatagaccaattgtttccgtgtttaaaaacgtcgaagttcttgatgaaaatgtgggaattcttaaaactgccattgaaacatcacagaaagatattaaaacaattcaaggagttttagatgtatcaggagatatagaagcactatcgcagatcagtgttaataaaaatgacatatcgaatttaaagacacttaccagtgaacacactgatatattaactggaactaataatacagttgacaaaattattgctgatataggtccatttaatgatgaagaaaactctgtttatagaacaattagaaatgatttattgtggattaaacaggaattaggacaatattctggccaagacattaacggtcttcctgttgttggtaatgctagcacaggaatgaaacacagaataataacaaatagtacattattatcttcacaaggcattcgtttaagtgaattagaaaataaatttactgaatctgacgtaggatcattaactgttgaagttggtaaattacgtgatgaacttggtaataaaccagtagattttgggccaaatatttataatagattaaacaccatagatgataaacaaactttaataatttctgatatagcagaaattaaatcttctattggatacccagaaaatgtttctataataacagaaattaataataacaaaagtagcattgaagctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacacatgaagtaaatacagctaaagacaatatatcctctttacagagcagcgttcaagctctacaagaagcaggttatattcctgaagctccaaaagatggccaagcttacgttcgcaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattatcaatgttgagttaacacccgatcaaatctacgattgcatccagcgtgccctagaattatacggtgaataccattttgatggacttaacaaaggttttcatgtattttatgtaggagatgacgaagaaaaatataagaccggagtcttcgatttaagaggttcaaacgtattcgcagtaactcgaattttgcgtacaaatgttggatcaataacgtcaatggatggaaacgctacatatccatggtttactgactttcttttaggaatggctggtattaatggtggcatggggacttcttgtaacagattttatggaccaaatgcctttggagctgatttaggatattttacccagcttaccagttacatgggaatgatgcaagatatgctttctcctattccagacttttggttcaattcggcaaatgaacaactcaaagtcatgggaaacttccaaaaatatgatttgattatcgtagaaagctggactaaatcatacattgatacaaacaaaatggttggaaatacagtaggatatggaacagttggtccgcaagatagttggtcattatctgaacgatataataatccagaccataatttagtaggtcgtgttgtgggtcaagattcagatgttaaacagggtgcttataataatcgttgggtgaaagactatgctacagctttagctaaagaattgaatggtcaaattttagcacgtcatcaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccacactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttggtattcggcgaagacttaaaaaataaatttactaaagcttggaaatttgctgcatatttaaattcatttgaaggatatgaaggagctaaatcgttctttggtaactttggtatgcaagtacaagacgaagtgactttatctattaacccaaatttatttaagcatcaagttaacggaaaagaaccgaaagaaggcgatttgatatattttcctatggataacagcttatttgaaattaactgggttgaaccatatgatccattttatcaattaggccaaaacgctattcgtaaaattactgcaggtaaattcatttattctggagaagaaattaatccagttctacagaaaaatgaaggaattaacattccagaatttagtgaattagaattaaatcctgttcgcaatcttaacggtattcatgacattaatattgatcagtatgctgaagtagatcaaattaattctgaagctaaagaatatgttgaaccttatgttgttgtcaataatagaggcaaatctttcgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcaataaattcacaagaagacgtggccaaggttgaaactattctacctcgtataaatttgcatttagttgattttagctataacgctccatttaaaacaaacattttaaatcaaaatttactacaaaaaggcgcaacttctgtagtatcacagtataatccatctcctattaaaatgatttatgaattgagtatatttactcgctatgaggatgatatgtttcaaatagttgaacagattcttccatattttcaacctcattttaatacaactatgtacgagcagtttggaaatgatattccatttaaaagggatattaaaattgtactgatgtctgctgctatagacgaagctatagatggggacaatttatctcgtcgtagaattgaatggtcattaacatttgaagtaaatggatggatgtatcctccagtagatgatgcagaaggattaattcgtactacttatacagattttcatgctaataccagagatttgcctgatggcgaaggcgtttttgaatctgttgataatgaagttgttcctcgagatattgacccagaagactgggatggaacagtaaaacaaactttcactaacaatgtaaatagaccaacaccgccagaacctcctggcccaagaacatagaggttattatggaaggtcttgatataaacaaacttttagatatttctgacctccccggaattgacggggaggaaattaaagtatatgaacctctgcaattagtagaagttaaaagcaatccacaaaaccgtactccagatttagaagatgattatggagtagttcgtcgaaatatgcattttcaacaacaaatgctaatggacgcggccaagatttttcttgagacagcaaagaatgctgattctcctcgtcacatggaagtatttgcaactcttatggggcaaatgactacgacgaacagagaaatactgaagcttcataaagatatgaaagatattacatctgagcaggttggcaccaaaggcgctgttcctacaggtcaaatgaatattcagaatgcgacagtattcatgggttcaccaacagaattaatggacgaaattggtgatgcttacgaggctcaagaagctcgtgagaaggtgataaatggaacaaccgattaatgcattaaatgatttccaccctttaaatgaagctggaaaaattttaataaaacacccaagcttagcagaaagaaaagatgaagatggaattcattggataaaatcacagtgggatggaaaatggtatcctgaaaaattcagtgattaccttcgtctgcataaaatagtaaaaattccaaacaactctgataagcctgaattatttcaaacttataaagataagaataataaaagatctcggtatatgggtcttcctaacttgaaacgagctaatattaaaacacaatggactcgtgaaatggtcgaggaatggaaaaaatgccgagatgatattgtttattttgcagaaacatactgtgccattactcatattgactatggtgtcataaaggttcaattacgtgactatcagcgtgatatgctcaaaataatgtcatctaaacgtatgactgtttgtaatctatcacgtcagcttggtaaaacaactgtagtagctattttccttgcacactttgtatgttttaacaaggataaagctgtaggtattcttgcgcacaaaggctcaatgtctgcggaagttttagatcgtactaagcaagcaattgaactgcttcctgactttttacaaccaggaattgttgaatggaataagggttcaattgaacttgataatggttcctcaatcggagcctatgcttcctctcctgacgcagttcgtggtaactcgttcgcaatgatttacattgacgaatgtgcatttattccaaacttccatgattcctggcttgctattcagccagtaatttcatctggtcgtcgttctaaaattattattactacgactcctaatggattaaatcatttttatgatatttggactgcagccgttgaaggtaaatctggatttgaaccatatactgctatttggaattcagttaaagaacgtctttataacgatgaagatatttttgacgatggatggcaatggagcatacaaaccatcaatggttctactttagcgcaattccgtcaagaacacacagctgcatttgaagggacttctggaacactaatttcaggaatgaaattagctgttatggattttattgaagtaacaccagatgatcatggttttcatcgatttaaaagccctgaaccagatagaaaatatattgcaactctagactgctcagaaggtcgcgggcaagattaccacgctttacatattattgatgttaccgatgatgtgtgggaacaggttggtgttttgcactcaaacactatttctcatttaattctacctgacatcgttatgcgttatttagtagaatacaatgaatgcccagtttatattgaattaaatagtactggtgtgtcagttgcgaaatcactttatatggatttagaatacgaaggtgttatttgcgattcatatactgatttaggaatgaagcaaactaaacgaacgaaagcagtcggatgctctacattaaaagaccttattgaaaaagataagcttattattcatcaccgtgcaactattcaagagtttagaacgtttagtgaaaaaggcgtgtcttgggcggctgaagaaggttatcatgacgatttagtaatgtctttagtgatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattccggtattttattagctgaaatcgagagcgctgaaactgctatgacagcagtcgattttcaggcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatattgatgactttttcgcaaaaggtggttcagaatatattttcgcaactgcgcaaaactggccagaaggcttctctggaattttaactctgtctggtggattatcatcaaatgctgaagtaacagcaggagatttgatggaagcttgggacttctttgctgaccgcgaatctgttgacgttcagttgtttattgcgggttcttgtgccggtgaatctttagaaacagcatctactgtccaaaaacacgtcgtttcaattggagatgctcgccaagattgcttagtattgtgctcaccaccgcgtgaaactgttgttggaattcctgtaactcgtgcagtagataatttagttaactggagaactgcagcaggttcatacactgataataactttaatatcagttcaacctacgcagcaattgatggtaactacaaatatcagtatgacaaatataatgatgtgaatcgttgggttccattagcagctgacattgctggtttatgcgcgagaactgataacgtttctcagacttggatgtctccagctggttataatcgtggtcagattcttaacgttattaaacttgctattgaaactcgccaagctcagcgcgaccgtttatatcaagaagctatcaacccagtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccagtacttacagggaattaaagctctcggtggaatttatgaatatcgtgtagtttgcgatacaacaaataacactccgtcagtaattgatagaaatgagtttgttgcaacattctacatccaaccggcgcgcagtataaattatattactttgaatttcgtcgcaactgctactggtgcagatttcgatgagttaactggtcttgcaggttaattgatatggggcttcggcccctattctcgaggaatcaagtgattatttctaaatttattaaagtgaaaattgtaccatcaaattttaaacattatcaatcaaagggttataaattaacacctcttggagcggttaaacatggatttaggtattatgaaattgatgttaaagttgaagacattaaaggtagtaccgcgtatgtaaaatgccgttgcgataaatgtggaattgaatataaccaacgcattggaagaaacactgatatttgtcgtgattgccgtcataaagataaaatgcgcaataattcatatggttccgcgaataaaggaaaaacagtagaatgtatgcatggcgtaaatcatccaagatggaacccaaataaatctgaaatgcgtgaatatatttcatcggtatataaagaaactcgtaagcataagaaaatttggtcaaaatggccaaatgctgataaaataggagtgtgtggtacaaaaggcgcttaccaacttgatcataaggtatctatcaaatacggttttgataatttaattcctgctaaaataattggcggtattaataatttagaaataatcacttgggaatctaaccgagaaaaatcaaaaagaaatagtgtagatctttgggatttactagaatgattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagttggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgctgcaggtcagacttctggagcagtaactcagattggcccagctgttatgggtatggtacgtcgtgctattcctaacctgattgctttcgatatttgtggtgttcagccaatgaacaacccgactggccaggtattcgcactgcgtgcagtatatggtaaagacccaatcgctgctgatgctaaagaagcattccacccaatgtatggtccagatgcaatgttctctggtcagggtgctgctaagaaattcccagctctggctgctagcacacaaaccaaagtaggtgatatctatactcacttcttccaggaaactggtactgtatatctgcaagcttctgctcaagtaacaattagttctactgcagatgatgcagctaaattagatgctgaaattaagaaacaaatggaagctggcgcattggtagaaatcgctgaaggtatggctacttctatcgctgaacttcaggaaggtttcaacggttctactgataacccatggaatgaaatgggcttccgtatcgataaacaagttatcgaagctaaatctcgtcagctgaaagctgcttactctatcgaattagcacaagacctccgcgctgttcacggtatggatgctgatgctgaactgtctggtattctggctaccgaaatcatgctggaaatcaaccgtgaagttgttgattggattaactactcagctcaggttggtaaatctggtatgaccctgactccgggttctaaagctggtgtatttgacttccaggatccgattgatattcgtggtgctcgctgggcgggtgaatcctttaaagctctgttgttccagattgacaaagaagcagttgaaattgctcgtcagaccggtcgtggtgaaggtaacttcattatcgcttcccgtaacgtagttaacgttctagcttcagttgatactggcatttcttatgctgcacagggtctggctaccggctttaacactgatactaccaagtcagtatttgctggtgttctgggtggtaaataccgtgtatatatcgaccagtatgctaaacaggattatttcactgtaggttataaaggtccgaacgaaatggatgctggtatttactatgctccatatgtagctctgactccgctgcgtggttccgatccgaagaacttccaaccagtaatgggattcaaaactcgttacggtatcggtatcaacccatttgcagaatccgctgctcaggctccggcttctcgcatccagagcggtatgccttctattctgaatagccttggtaaaaacgcttactttagacgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttatgctggcgaagctgggtatgtagaccgagaacaaatcacagaattaacagaagagtctaaattaactctcaataaaggcgatttattcaaatataataatatcgtttataaagtattagaagatacaccatttgctgatattgaagaaagcgatttagaattagctcttcagattgcaatcgttcttttaaaggttcgtctattttctgatgctgcagtaacaagcaaatttgaaaactctgatagcgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtgtcaaaacgctataaagttacaggaattactgatactggattcatcgatttgagttatgcatctgcacctgaagctggtcgttcattataccgaatggtatgtgaaatggtttcgcatatccaaaaagaatcaacttatacagcaacgttctgtgttgcttcagctcgtgctgctgcgattcttgctgcatcaggttggttaaaacataaaccagaagatgacaaatatctttcacaaaatgcctacgggttcttagctaatggtttaccgctttattgcgatactaacagcccattagattatgtaatcgttggcgtagtagaaaatatcggtgaaaaagaaattgttggatcaattttctatgctccgtatacagaaggtcttgacttagatgaccctgaacatgtaggtgcatttaaagttgtagttgatccagaaagtttgcagccatctatcggtttattagttagatatgctttatctgcaaatccttacaccgtagcaaaagatgaaaaagaagcaagaataattgatggtggagacatggataaaatggcgggtcgttcagatttgtctgttttattaggtgttaaactaccaaaaattatcattgatgaataaaacaaagggacctttcggtccctttttatttaacttaccaattcaatccaagccggacgaagtacatcttgtaccattttaactaattcctttttaatcaaagaaggattatctgcttgagttagagtaataccttcacgagaagtttcttccaaaatatcttgaacagttagtcccatcacctttccaaaatccttcggaccaatttcaccaattttagaaataacgttatttactcggttcagtgtaacgtagcaagctaaaattcccaccaatttgttatcagcttctgacagttcaactttagctttaataggcttatcagactttttcttttcactaaatttggaattcttgcatttgatggctacacgatttccattatgaagccaagaaggataacaaggtttcaatacatatccttcagcggtaaatacttcgcctttggcttcagctttccaaacacatttgttagcgtcaactaatcctgcatggtctactgtaaaattataatcttggacgacagaatctaaatcatttggcaatttaataagctcttcaaatttaccgcgacctaaaagtggagccattttaaatttaaatgtattacagaatgattccatcatataatcatcgacataagtcacatcatcactttcggtagtaacaataatgtcaaatacataaaaatctttatcgccataatcgacattcttctgaatgccaggtccagcaaattcgccaaagacttgataagatacaactgctgaagtttccataatatcttgtactgctttaatggaatcagcgtaattctttagaataatttcatacccaaagaaatcttcagcaggaagaatcggtccagtacgtttagcgcaagttactttatcacgctcaataatcaatgagaaatttgtgccgtgaatcttttcacgagctacccattcgccgccagtcaatcccaagctataaagtttttcaataaatttagagttgtaatgattttcaagactgctatactttttaaacataattaatcctcaaaatgtaatttctaaccaatcaccatcacgctgatcactattgactttaaaattaaatccttcttttctcagccaatcaccaatttcttcagtaatcaatttatcacgagcagtacaataataactaaaatatgttttaccttgttcagctgctttattagcaagttctgaaaaatctttaataaaacactctagcttaaactgtttgcttttaagtgctttttcgcgtaattgattagcaaaagattcattttcataaagatcatactgttccatttttcacctttttattaatatgtctttttctatagacaactttttctcgagtctcaaatttattcttagcagtcatagctcgagcccataatacagccacttctttcgcctgtaagttcaattcacgagcaatttcaatgaatgactttccagactcatgaagagtaaacaccacaacctcagttctcataatcaatctcatgttatcgagttgatgccattatatacatcattttctgagtatgttttgtgtgctttcaaaatgaagaaaggggccgaagccccttatgattatgattatggataggtatagatgataccagtttctaaagcagttttatgaatgatgtatccattgcgtgattcttgaacatcaacttctggatagtctttcatcatcttctgaagagtgtaacgatgcaggtagtatttactgtctggatcttcagttttccaatctttaccttcttcggtcattttttggatttcatccataacccaccaaccgcaccagatataagctgaagtacgatgtggaagaggatgaacataaggtagttcaccttctggttctggagcaactttatcagttacctgaacttgaccttctgctgtaatagttttgctatcgtaatcagttgcagtaacgacagcagtaacttcaatagtttgacttccaacagatgaggtatcgacagtatatacgttagttgacccttctacaggagaagaatctttcttccatgagtaagtaatttgtgcttcttctggagcacccgtaacattagccgtaaatgtagccgaagcatcttgctgaacgttaatagaaggaggagtcaatgtaacctgtggattcattgttttcttattaacagtcaatgatacttcattagaagtaacttccttttcattgtaattttctgcagttacttgcgctacacacttaactgttttagctccaactgtggtaggagtatagttaaatgtagtagtagtttctccatcgaccagagaaccgtcaacataccactgatacgtagcagacgctcctggtggctgtgaatccaaggcagcagtaaattgaactggggttccaattactccggcagcaggattagcaggagttacggctaacgtagttgtctgtgtcttcttattaactgttaatgatacttcattagaagtaactgtttttgcgtcataatctgttgctgttacttgcgctacgcatttaattctttttactccacttgtagttggagtatagctaaatgtagcagaagtcgcttcaccaatttgagaatcatctacataccactgatacgtagcagatgccccatcaggttgagaagctaaggcagcagtaaattcaacggctgttccaatcactccagctggaggactatcaggagttactgccaaggtagtcgtctgcgtctttttattaacagtcaatgatacttcattagaagtaacgcttagtgcatcataatctgccgcagttacttgagctacacacttgatttttttaactccacttgtgtcaggagtgtaattgaatgtagcgtcagttgcttcgtctacaggagaaccgtcaacgtgccattgatacgtagcgtttgcacctgatggctgtgaagctaaggcagcggtaaattcaattggagttccaatcactccagcatcaggattagcaggagttacggctaacgtagttgtttgtgtcttattttgaactgtgatagttgtactaatttctgctgtttcaggttcagattctgcaacttgattggttgcaactactttaatagtcttttgaccggcaggtccttttagtacataactaaaagttgctgacgtttcttcctgtggagcgtcgtctacagtccaagcatatgtaataggtccatctccagtttgaccactgggtgtagcagtaaactgctgagtctgatctataactccagtaggtgttttaggagttatatcaactgtaaaagtcataagttatccttattttaatgttacgaaagaagagttgcgtgtttcacgaattaaaactgatccgtcacggttaatgtaataaattaagctaaataaagtttggtgtgctgacgcatgttcaaaactagttgggtgagatttccaatcaggagtttcagcaatccattgataaatccaccaaggaacagtacagaatcctggattttttccaatcaactgaagattcgggctaaagttttccggaagagtaaatacagacggcttttcagattcaataatctcagctacagcctgttcaaatttttcttcaacaaatggagtatcttcaatcaaaacatcggtattttcaggaattttatctgtttctactacttcaattttaatgtcagatttaaccggagaatcaatcaaaagtgctgcttctggattgacttcttcatcgtcatattttaacccctctgcagcatcagcagcatcaattaagtctttaatagataacccatcagtctccggcataggttcactagcgagcttctggagggcttcttcaatatcaacaacgatattatcaaaagatttattctttttgacctttataccaaactgttcagcatattcagctaatttagctttagcttctttgttatcatcaagagccttcagctctgcaatataatctttatctatcataatatttcctcagtataaatatagatatatttattacatggtatttagacatgactgacattaaagtacatttttatgattttagtcacgtgagaattgattgtgaagaaagtacatttcatgaactccgtgatttctttagctttgaagctgatgggtatcgttttaatccgaagtacaaatatggccactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccacactggtatcaaaaagatgcagtgttcgaaggactagttaatcgtcgtagaattcttaatcttccaacatccgctggtaaatcgttaattcaagctttgcttgcgcgatattatttggaaaattatgaaggtaaaattcttatcattgttccaacaactgctctgacaactcagatggctgatgactttgttgactatcgtttattcagtcatgcaatgataaagaaaatcggtggtggagcatcaaaagatgataaatataaaaatgatgcaccggtcgttgttggtacatggcaaactgtagtaaaacaaccgaaagaatggttctcacagtttggaatgatgatgaatgatgaatgtcatcttgctacaggaaaaagtatttcatctatcatatcaggtttaaataactgcatgttcaaattcggtttgtctggttcattacgtgatggcaaagccaatatcatgcagtatgttggaatgttcggtgaaatatttaagccagtaacgacctctaaattaatggaagatggacaagtaactgagttaaaaattaatagtatttttcttcgctatcccgatgagttcactactaaattaaagggaaaaacttaccaagaagaaataaaaattattactgggcttagtaaaagaaataaatggatcgctaaattagctattaagcttgcacaaaaagatgaaaacgcttttgtcatgtttaaacacgtatcgcacggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaagacaatagcaacagtctgggacctcatagatgattgtggtgttaagccaaaatctgctaatacgaaaaagaaatatgttcatttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgccaaacgatagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgtgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaaggacatcttcaccacacgggtggtcggccaggatacgaatatcctgacgcttaagattatgctttttcattaagaattgaatttccgtttcaaattcttcttcataattaaaagcatcatcaatgctatatctcattattttccagcctcaaatgctcgcatgtcttgaatatgcttaatagcaaatccgcgtgatttgatagcatcaagagctccgctacagaaatccaataaaatcccccaatactgtaacgaggtatcaacctttaaaacatccttatcagctgatagaactgttttcatttctgatttctcgtaacgatccatactaaattcatcaccatctcctcgtcccgagtagtagtctaatctagctttaagagcaacttttttctgtgcttcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagctgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgggtttttccacactctggacacttaattggaacagccaaataaacagtaggctttaaaagcatatcttttatagctacaatatctgactctgtgatgatagaatataaatcttccaattctttttcatttaagtcttcaactggaatgctttcaccgttagcatgaatcgtttctatacatgatactatcatgtgggctatatttttatcatcaaaaattttagggtaatggaatttaattttaatgtcacccagtgtataccagaggtcttctggtgcatctatttgtgtatgtaatagatttatatgggttggtatttcagttccacaggtgcacttccaggagttttcgtgattaacttctccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagagtaaatgcgcgacagttgattattttagaaccaactctcacgtcaaatttgtattcatacatatttagctcctttatttatcatatttataaatagaataaaaggagcatctatggcaaacattattcgttgtaaattacctgatggtgttcatcgttttaaaccatttacggtagaagattatcgagattttttgttagttcgaaacgatatagaacatcggtcaccacaagaacaaaaagaagtaattgctgatttaattgctgattattttggagactatccaaagacttggcaaccatttatatttttgcaggtatttgtagggtcaataggtaaaactaaagtaccagtcacatttgtatgtccaaaatgtaaaaaagaaaagacagttccatttgaaatatatcaaaaagaattaaaggaacctatttttgatgtagctaatgttaaaattaaattaaattttccttctgagttttatgaaaataaagcaaagatgattactgaaaatattcattctgttcaagtcgatgaaatgtggtatgattggaaggaaattagtgaatcaagtcaaatagaacttgttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctacaattttatgattctaaaaacattcatacaaaaatggatggaaatgaaataattcagatttctgtagctaatgcaaacgatattaataatgttaaaacccgaatttatggatgcaagcatttttccgtgtcagtagattcaaaaggcgataacatcattgctattgaattaggaactattcattctatagaaaatcttaaatttggtagaccatttttccctgatgccggtgaatctataaaggaaatgcttggcgtaatttatcaagatcgtacattattaactccagcgataaatgctattaatgcttatgttcctgatattccatggactagcacatttgaaaactatttgtcatatgtaagagaagttgctctagcggtaggaagcgataagttcgtatttgtatggcaagacatcatgggagttaacatgatggactatgatatgatgataaatcaagaaccatatccaatgattgtcggtgagccaactttaataggtcaattcgtccaagaattgaaatatccattagcatatgatttcgtttggttgactaaatcgaatcctcacaaacgcgatccaatgaaaaatgctactatctatgctcattcatttttagattcttcattaccaatgattactacaggaaagggtgaaaactctattgtagtgtcaaggtcaggtgcttattctgaaatgacttatagaaatggatacgaagaagctattcgtcttcagactatggcgcagtatgatggttacgctaaatgttctactgtcggtaattttaacttgactcctggcgttaaaattatttttaatgatagtaaaaaccaatttaaaacagaattttacgttgatgaagttattcacgaattatcaaataataattccgtaactcatctttatatgttcactaatgcaacgaaactggaaacaatcgacccagttaaggttaaaaatgaatttaaaactgatactaccactgaagaaagtagttcttccgataagtaataaagaagtttctattcctaagatgggtcttaaacattataacattttaaaagatgttaaaggtcctgatgaaaatttaaagcttcttattgattctatttgtccaaatttatcaccggcagaagttgatttcgtttctattcatttattggaatttaatggaaagattaaatctcgtaaagaaatagatggttatacttatgatattaatgacgtttatgtatgccaaagattggaatttcaataccaaggaaatacattttattttagacctcctggaaaatttgaacaatttttaactgtaagcgatatgttatccaaatgcttgcttaaggtcaatgatgaagttaaagaaattaattttcttgagatgccagcatttgtattaaaatgggcaaatgatatttctacaactttagcaattcctggccctaatggttcaataactggaattggcaatattattggattatttgaatgaaaaagccacaagaaatgcaaacgatgcgtagaaaagttatttcagataataaaccagttcaggaagcggctaaatccgcttccaatactttatctggacttaacgatatatctacgaaattggatgatgctcaagctgcttctgaattaattgctcaaactgtcgaagaaaaatcgaatgaaataattggagcaattgacaatgtagaaagcgcagtaagtgatactactgccggttctgagttaattgctgaaactgttgaaattggaaacaatattaataaagaaatcggtgaatcgctcggaagcaaattagataaattaacaagtttactggaacaaaaaattcagacagctggaattcagcaaactggaacgagtttagcagtagtcgaaaatgctattcctgttaaagtcgtcgaggatgatacagctgaatctgtgggtcctttattaccggctcctgaagcagttaataatgatcctgatgctgattttttccctactcctcagccaattgaaccaaaacaagagtctccagaagagaagcaaaaaagagacgcatttaacttaaaaatatctaatgctttagataaattaacaaagacagttgatttcggatttaagaaatctatttcaattactgataaaatatcaagcatgctatttaagtatactgtcagtgctgctattgaagctgctaaaatggttgcattaataatggctgttgttattggaatagacctattgatggttcattttaaatattggtcagataaattttcaaaagcctgggatttgtttagcactgattttaaaactttttcaagcgaaaccggaacttggggtcctttattacagagcatctttgaatctattgatgaaattaaaaagttctgggaagctggagactggggtggattgacagtagctattgtggaaggacttggaagtgttctttataatttaggagaacttattcaacttggaatggctaaattatcagcagcaattcttcgagttattcctggtatgaaggataccgctgatgaagtagaaggaagagcattagaaaatttccaaaattctactggagcatctctcaataaagaagaccaagaaaaagtagcaaattatcaagataaacgaatgaatgacgatcttggtccaatagcaaaaggattagataaaattgctaattggaaaacccgtgcatctaactggattcgtggtgttgataataaagaagcattgacaactgatgaagaacgcgcagcagaagaagaaaaattaaagcaactttcaccagaagaaagaaaaaacgctttaatgaaggctaatgaagcccgtgccgcgatgattcgttttgaaaaatatgctgattcagctgatatgagtaaagactcaacagttaaatcaattgaagccgctcatgaagaccttaaaaaacggatgaatgacccggatttaaataattcacctgcagttaaaaaggagcttgcttctagatttgctaaaattgatgctacttatcaagagcttaagaaaaatcaacctgaggccaaacctgaaacttctgctaaatcgccagaagcaaaacaagtccaggtaatagaaaagaacaaagcacagcaagctcctgttcaacaagcatctccttcaatcaataatactaataatgttattaagaaaaatactgtcgttcataatatgacacctgtcacaagcacaactgctcctggtgtatttggtgcgacgggagttaattaaggaataatatggcaattgttaaagaaataactgctgatttaattaaaaagtccggtgagaaaatttcagccggacagagtactaaatcagaagtaggaactaaaacatacacagcccagtttccaactgggcgtgctagtgggaatgacactacaggggacttccaggtaacagatctatataagaatggattattatttactgcatacaatatgtcatctagggattctggaagtctcagaacgatgagatctaactactcttcttcatcttctagtattttacgtacagccagaaacactattagtagtacagtatcaaaactatcaaatggattaatatcagataataattcaggaacaataagtaaagttcctgttgcaaatattcttttaccgagatctaaatccgatgttgatacatcatcacatagatttaacgatgttcaagatagtcttattacaaaaggtggaggtactgctactggcgtgttaagcaatatggcttcaactgcagtatttggagcactggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatttagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgcccttgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcagagtaaaatattaggagcaatataacaatggggaccgaaaggtccccatatttttatttacggaatgaaatgaaagcagaaactgaagcaactaaactgtcttcaatataaacttcaatttttaccggagcttctgactcaaatttacctgttactacaccttggaaaatactttcagtctgttctggttttgaaaaattttcagaaggaaaaattccgaactttttatctgttccaaaaattttaataaattcatcgtaaactgcttcattaaaagcattatcagcaggaataacgccttcaacgacgagctcttggcctaaaaagcgtaaagaagatttcattttgtgttcctcatgttatgtcagtaagactactataacacaacacgagggacttgtaaactacattttgaactttttagacattccgttgatgttaaccaaagaagctaagatttgagaaacttcattttcctcttcttttgattcttctacaaggaattgattaaatccagccattggacgaacttcaccagtttccattagatggtctccatcatatactgattcttctaattgttcagaaggaggaacgattgtacattcgattagatacttgttataagcagtttctttcataaagtacgtacttactttattaatcttcagtaaaattccacgtggtagaataacttcagcttctgatggaaatcctgataaatgacctggaacgataactttgattcgctcagctcctttaattaccatacccacgctagtttcagcatcttcattagcatatgtagaatgactacccatatgcatcaaatcttctgcatcaacggaaccttctccttcgccagaaaatactgcgccagaatcatctagagccatatagtttttaccatgctcaccgaagatatttggtttaagcgatgtggatacgaagttcttgaaatagaacattttgttttcaatgttatgacgcaaagttttaaaggtaacttcttgtccacgataaagcgtagttcctggaggaagaactgaacctttagcgaatgcagaatccaacgtctcgatgtgcttaatagctcgttccatatattcttcacgggtagaatctggtttacccaaaaggaacgagttcatttcaacatatgaatctgcacaataatcttcaattacatcagattcagcctgagtcagtccttttggagctacttcggtgcttgcgtattcatatgcctgggcagcagattcattaatcaatttataaatgccattcatgacaaattgaataatagctgtcttttcatctggtgtggttttagaacctttaactaaatcattaataattttcttaataacatcaaagctattagaaatattaatgtcagcaagatcgcttaaaattttatcagttttataatcaaagaattctttattctttaaatattcttgagaaccttgatatgttatatcgctctgcaacttgatagatggatcacgtaaacgtgcatgggccaatgcaatatgatttcggaagctttctagttcataatcgttagatttaaaacgagaagcacttctcataccaccgatagctcctttgctgaagtttgaaccaatctgaataacgccagagttcattggtccttctgctttatataccggaactttagattcaaactcttgatatttcttggcagcgaagctatcaccctgtagcgaagcatcgacagtagaatattgagcttgtgctgctaatcgacgactaattttagttttctgaataacagcttgatccgtgcgcttatcattttctaaggcaatagaagcagcaacagcaacagctttaggaacagcattacctgttttaacatctacataaacatcaccaacctttgattcaacttttgtgaataactcagttgaaataggaggtacacctggaatgtcttctaaattggcatttttacggtaaaccataatatatgcatactttttatcatagtcccagatttcctttaaaagaacatatcgacctgctcctttagtacgtactaaacggtcagcaataacttgcatttgacgagcagcgccatttgttttactttttagtacgcggaataagcatgcgtcaattttatactgtttcattgtttgaagagcagtatcaaaaacagcattaatgacgccaattggatttccacccaagtttctaagcttaaccagcgataatttctcgttgacacctatcattacgatatgcatcattttatcgcctggcttaacatttttatttgtatcaccaccagaggtgtatgtacaaaatctaaatccaggaagcacgctttcttcgccggcttggatagcaaaaatttgtggtattttatgcttaggatttaagttaacaaccggcgccgaagcgccgtcaaataattctgtaataagttccatgatttatccttgaacgaacttgtaaggcatgtttgtaatatctatgcaagacgcaataattccaagagatgattctactttctgtttaacatttgatgaaacaaatgatgcaaagtcaactctatcttctatatcacctgtcattgtaaccaattcaccagtttccattaaatggtctccgtcatagattaccgattcggtgagttcttctgtggtcataacttcagcttgaataagcttgttgttagttttaactgttccatcattgtaagatgcatcggttattttattaactttgaccattaatccacgtggcaaaatgacttccatttcatttgaaggcgctaaacttccaccgggtaaaacaacattgactttatcagccccggtaataacccatccaattccaactaaattatcgctagaatttactagtccttcatcagttttatcaatagaaacacttagacgcttttcgtctggtaaaacacctatagatgaatcagtcatccaagtaccaaaaatatttggatataatgatgttgacacaaagtttctaaaataaaaaactcgattttttaccattgcttcgtatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatgtctacatatcctgaacctacgtattcacgaattccgcgtttttgtgctggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatttttctaaagctttattttttatttctgcattaataatggattctttatcttcaggaattatagaagcttctctgaatgccatcccagctgtaacactgctaagagcattctctagtgcaaatcctgaagtagaaattaccgttaattcattagaatcagaaattaaaggcgcgtccgctggtttatttaattctgccgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcagtactaatttccggaactcccggaatgtcttctagtgatacatttttgcgatgtataagaatatatgcatactttttatcgtaatcccagagttccttaagaaggacgtatctgccacctgaacgactacggataagtctatcagcaataacttgaatttgtcgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcagttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgtgattttacgccggctttgtcttttaagcctgaaccagcatttaccttaatttttccacactctgactcaagaataaatccacctgctttagtagggtctttacggtgaggataaattcctacaatttttaaatcaacatcaattacttctttaaatttatagagattttttgaacgagcattttcccataatccatcgatatttttgagaataataccttcaagaccttgatcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcacctctgacttcagcaaagcaccgagctccatcagcttttaattgggcaaaggctggaaatttgatattcttattaatgcctttttcatcataagaacttgccagcatttgaggttgttcaggaattaaacctggccaaactttgtttgcaatagatactgaagcaccacattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacacattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccactagtaggtctattatacaaatactctatgccaccaggtttaatatagttccatgtctgaaacggatgtgtctgatatggatgatatagatgattataaggattaaatccaggagttctccaggtagtgttccaaggaaaagaatcgtttttgatcatcttctcgattgcatcttttatagctttttcactatcaaagctttctttattttcctttggtgaaaaaagcttattctctacatcgttccatgtataaactcgctgagcagtttttgaaatattgtcacgctctcctcgagccatccaataaacaggaacatttaatatttcactcgcgtgatcgcagtggtgagcgagatcgtcaatataacaaattacgttatatttctcttttgcctttttgaacaactcttcttttgaagaatcatgaccacacatcattacttctgagaaggcaccaggaaaaagagcattcaaattaaattgacgattcagcagagcgtcaatagaatcacccagtgctgtaacagctacaaaattataatcttcttttaatttgttaattacacacagagcatctttatatggagacaagtaacgaataaaatccgaacgattgtatttttcaattaacttgacgccaagttcttcatcacaattaaaaagtttacctggagaaataaatttctcatcttggatcatttttaaaatatgttccaacggaaggttatatttctgggcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcgcgaaagcccctattttggatcgctgcttcaaaatatgcatttgtgtataattctttccacgctggggagtatcttgaaaatggaactccaagccagaagagggtcccacggtcctgagctctagcataagaccttccagcttgttgggcggcaagcccagataacccaaatatacgacgttgttgttcaacgtttttcaccttgcatccttggaggaatccttcaagacctccaaattgaataccatccataacgaaaggccaatgggcgaaattacttaatgcgcatgatggccacctaaaattgcttctaatctctaactcagacattttcaatgcttataatttcaacatcagcccaatgaccatagcaaggaagacgaaattcaactggccagttagggtccttttctaatataatagactcaacttgtggttcttcgtgttcatcagtatacggatttttatctgttactttatatgtgaccttaatgtactgaattccaaaaatcttattaattatattcatactaattcctttaatccgtagataggagataattcatcacccatacgaaggtcttcatttccatctacccaggaaacaatataagcctcttttacttgaacatctcccaatttaaatgcgggtaaaaccttagaaattaatccaggtataccaactccctttaattcaacagtttgacctaaaaagaatttcattagaacctcatctgaaacccatgtgatttaacattaccgccattaatatcagaactattaatttcgcgtgcaattgagggatcaatgtcaatttcacgattgagtttagcgatagctagagtatcacgcccatttactgtacggaattctaaaggacaaaccacatcaacgtagtttttaatcgattcgctagtaggttgcaaatgtgcaggaaggtctttaggtgcctttgagaaaacaacttcacagaaatttttgcgggtatcaaaataagtagtcataaacataatattttcctcaatagggggggggccgaagcccctgttttattttaaatatcaaattcgttaagaactacatcaaagattgcttcaagatgctcaggtttagctctgttactcaaaatatgacgaatccaagttttaaccagaagcttacgattagcgccattccagcaaggatgggtccctaaatcgcgttgacgaaaatcatcatccagagcgattttgaagtttgaaccttccattgtgattgaaaccgtgatgccattttcaaatcgcatataaacgtagttaggagtcatatactgttcaatttcgcatactgatccattttgatgtttccaaaggcaaatagtatcaatagaacttgcaataccattagaaacatatttacgttcaaagttgatgtagttcatttttattctccgagatgtttaattgcggtacaggtatataatatcatatcctgtaccaaagtaaacaattattttactactttccagtgcttcatgtcaagtttaccaacttttttcatcttctcaatcaaacgttcggcacgttggcgagctgtaacataataccattcgcctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagtcttaactgcagcgttcagattaatcgttttcattttattctcctttgtttgtgtaagataatactatcacaaaggaaccatactgtaaacaactttatgcaatctttggaaaataaaaaaggactcccgaaggagtccttaacttatgctttctgcttaccaaaacgagaagcatcatctcgaagaaccgcacgtgctcggcgcatgatcttctcaacagtttgattgatacgagagttcgacccacgcttgtaaccagcgcgtttagaatcaccaactttcttttcaactgctttctttgctttaacttgttttgccattataaattctcttttaaatgaaaatgcaggacttattggcattgcctgcgcaagccctcaagggggaacataggttttgtatatttaccgacaggataaccataaacctcgtcaacataccaccaagacttacacagataacacttttctgacgcatgatagtaacattcaagaggtacaccataaaactgccggggtcttaaaactataatgattcgcaaatcattaatcagacagttcgatggctcctcgattttagctcacactaaggcagtgaatctccaataaattacttcagtgttaccacaaagtgacgaactgcttttcgtgcagcagaagccagaggcttagcatacttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaagtaacgaatttttgtttaatttcttttggctgcttaagacccagagctacaaaaggatgcggaacatttcgaatttgaccaactggaagagaagtcaaatcaccaacttcgcagaaaccttcaggaacatcaggaccgacagagtgaactacacacagttcaggaacttcaccttgaacacgtttaccgataataagtcctgattctgtaacttcttcatcaccggcttgtgcgggttcagaaactaaaataacatattcaccgacagcacgaattggtaactgttgtacttcagacatcgtttttcctttttgttaacagatgaattaataataacaaataattcttaaagcatttatttaccaataaattggagtaaatgctcaactttcataccattaacagaaatcaatttgtcaatagaaaaacctcgccatgcaccaagttcaacatcaaatactggaatcatgtcagtagattctttccgagtcgattcagtcaatttaccagtttgcatggttggcataaagtcagcatcgcgagtacctttcatagtacgaatagtaccatcagacttttcaaaaactacgtttgaaacacccatggacaatttagttttcaaaatttcacgaattgctactttctgttcagttgtcagtttcatttatttacctattacagttttaatatgagttgttccacgttctttaagggtggaaagtaatttttggcatttttctaaatcagatttccaactatatggtctatcaatactagtccaatcagttttataatactgtttccatttagagaaaaaatatttcttatactctacagcaaacgagatgttctcgttagaataagaactaattgctgtaagctttaccaaacgaaatttcattattcaccacagaattcgttgatattttcccagtttaacttattcaagtttttcttaggaacattaaacacttcaatacctgcatttcgcagaatatcatcccagccaggtttatttttatcgtatgtttcgcaataaaccagttttttaattccagactgagctatcgcttttgcgcaatccggacaaggagaaagtgttacatacatagtagcaccttcaattgaagaaccatttcgtgcagcaaacaaaattgcatttagttcagcatgaatttcatttttagatgaccattccgagtgagcgccgcggtgttctttcgccaagacaaaacgatcagttgaaccaaatgatacacattcaggcttatgaccttgaatgatagtatgtttaggtttattcagcaaccaaccttgctcagcagcataatcacaacagttcacaccccctgcaggtgaaccattatacccagtagaaataatacgtccattcttttcaattactgctcctaccttccaggagcaacattttgattcctgcgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcgccaaccatctttttgtgaagctcaactggatacttcgtcacaataatagcatcatacacagaaggatgaatactattcactagagtgtcattcattaaagttattctaatgaactgtgctgtttcagagtcaagcgctttatgatcgccagtatcattttcaagacaattatcaattatatcagttaaattcatcatagtacgccatacaccctttgtgcttcaactaatccatcaaaatccagtttaagatgcgatatttgatcgccatcacctggattcacaattactaatactgaacgaggagtttcggtaataacacgaaccgacgtttcaggaaatcgttcagaaaccttatttactaattcctgtgcaaatagtttaactttttcttggaattctttaacagtaattggtttttcacttagcatgttgatcccagctccttactttcaacgtttttaactaatttgacagaaactaattcagcatcttgggtaatcattaccgggccttcttcatactcttcaagatattctagagctttctttttagcttcttcctttgtatcagtttgagcatagatataaaacatgcaaccagtaatacctactactttccacttaatttctttatcagttttaatttcaaatttactgacagaatcatctttttgaacttcttcgaaaaaagaatattctaacatataagcaattgaaaataacgggctaactttataggattcgcccattacatcaacagctttataccaacaatcatcaatttcgcgtttaatgctaataacattctttgcagggtcaatttttactttaaatgaattttccccaataaactgggcgattcgtttattagccccgcaagtttcattaaaaatatctttatacccagttttaaagcgataaaccttatcttcttcaaaccattcgctcatttcaatttcctcatttgttttggtagagctataatatcacaactctaccgtaaagtaaaccattaaatcgctttgaattccgcagtttgagattcaaagcgaatgtcgcctttgataactagctcagcatcaagaccgaatacaacaatgatatgcgcggaacctggatacaacgtaatggcaatagaatccacctggtctggaagcaaagtgttcaatacatgagtcacttgagcgtggattcgaagctcagctgcgttatcaagtttttcaaacatattattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccgactaaaccactatttacaataataatagcccaagtttcatgatgccacgccattaaaaatctcccgagtcaacttgccagcattcaacaccgatgcggcgccacatttcaactacttgagttcggtcatcaatagctaatttcacgtcaaactgtggtgcgatgtgtttccagaaaatttcttctttaactacatcatctttacgggtatcgccttgttcgcgttgacattgcataactaatggaacaccagcaatgtcctcaacccatttacgggtcatacgataatattttgttgggtcttcttcggttccactttcacggcccgaaacgactacgatgtaatatccttgcttatcgtacatcttagctagttcaacgaccattggattaataatatcggtatcacatttttcaaggtcataaggaccacgaccattcatttttgctaatgtgccatcaacatcaaaaataactgcttttggtttaccaggagtccctttatataccggaagtccgagatattcccgcatgcttttatacattgaacgtaaaacatcaattggtactgctttagttccacgttttgagttacgtttaaccaattcagtccaaggaacatcaaacactttatattcaatttgatgcccaagctctttggcaaactcttcccagaccttacgtcgttcaggattcagattagtatctgaaacaattacacccttcgttccgtcttggcagagaatcatatgtgccgcatcgtgttgcatataagtcacgatgctttctttcttcttggtgtatttgtactcatcacgttcttcgtgtgccataacagactggcgataatcatcacgattaatattataaaacccaggattcttagcaataaattcacgagcccaagtgcttttaccagaaccaggacaacctacagtcaaaataatctttttcatcatttaattcctaagaaaacttcaagaatacgaatattatgctcacgccgtcctttgtacaattcagctgttgattgattcgctgatttactctgaacattggatgaaataaattttatcatgtgatttttaagctgatacatatcaagcccacgagctttcgcttcttttcgcagggctttaccagcatcatctaaagctttagcatgttcaatatcttggctaatgcttgatacattttcacggcatgcatcaatgtaacggtctgaacattcaatataacgttctaacagagttttcatttatttttctcaaccaatgattgaatataatcatgcaggtctttagatgctttaccccacttattttgatattcatttttgagattagcgcgtgattgagctaataaaacatcattagttggaggtaaagattctaatcgttgaatctgtcgtccataaatcattgcagccatctcggattcataaattaatccttttagatgttcaaattgataccatgaaatcatttacatttatcctcttttagctcttgacgataataacatatcatagttttctggtcatgtacatatcgttttacatcattaagccaaatacgaaattcctgagaatcttcaaatggcataccgacccaagctttaccatcaataactttaacttgccaagatagtttagcttcatcatatgactttatctgtacaggccaattaggatgaactgtttctttctttacttctagaggctttgtcgaacaaccagctagaagaccgatagataatattactgctgatagtctaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcatgcctcaacatcttctgccatatccgatgcgctacgatttggattactaattccaagacgatgttttcccgttaaaggattaacgatgatatagcatttacaactattgatatgaacattaggttgagtctgattaatgaacacttcacaatcatacttagcgagttgattttctaaaaagactttcatctcttcaaccgcatcaggaagcatatcacgggcttgctcaagacgacgattttgatattctttaatggtcgttttccgcttgacttgcttagctaaatctttcttaagatcagtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgtgcttccattgcataagtctttctatctttaccacaatgcttattgtgacagtcaagaactaaaaacagagctcggtctaagtacttcagataagtcgtttcaaacgcctcaatttttctgtatgaatattcatcgtcagcgtacattgctttaagatcatctgatgcaccgtcaataatagtcttaaacaatttttctggattatctaatgaactttttgtactatgaagagacacataccagtcagacttaattttaaaatgagaaccatctttcatcacagcaacatagccttcgatgttttctgcatttttagcttcttctacccatttagggctatcgatttcgaatcgttcaactagatatggacgaagagcagcatctttataaatatcatcatatgaaatgtattcgcctgtttcattttcacgaatattcaataagatgattttcatctcttgataagcaagaacgattctattcgttggagcaacgaattcaaagttagcagtaaatccatcttcagctaattctttaagtctatcacgcaaccgatggtgattaatattcatcaaaataccattagccattaaagcctgttcggatttgattgaaccctttgatttgaacagaatttcatcaccatctaaataagttgataccaaagacccatcttcctttgtcagaatgtaatcaacatcatttaaatcgatattcatcgtgaatggattttcatttaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagatgcacttacatcatccgagtaaaaaaacttacgctgtgaatccttacatagttccattaaattgttaaaaagttcttgcattgtgtatcctcttttgtgttttgaatatagtaccacactccatgtggaagcatcattttttcttgtgttgaatattccaaggcgggttaaacagtttaatgaatagcggctcctctaggtcaatcgttgcgattgtcattgtacctaactcatttgtcatagaaagattaaaacattggcgggcgtaaaattcaactttgcttccttcctttagcgcagcatgaattaatgcagatttagtagaatcagacgttttgtctttacgattaatagcagttctataataatttattcttttacgtaaatttttagtttttccaatataaacaagctcatcatttatagcaatagcataaattacgttatacttgtttggaatagatagttgttttatacttccgttgtcgtctaattctaactcagtatatttaataaatgaatactctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatctccatctttaaataaatgaactgcccaatctttttcttggcggttaacttccatgaaaatatcaactgcttcttgttcacactcttgagcaattttaacccattcatcgccatcagtgccaagttgaagttgacgaataatatattgggtgcctttaagatgaagctgctcatcacgcgcaatgaacttcataatcttggcattaccttccatgatttccatgttcttatggaagttaaaagtgcatgcgaaagatacataaaaacgaatagcttctaaggcattaataacgtgcaaacagaggtaaagagatttcattaaagcacgtttagcttcggcttcttgtttaatagctcggtttaaacgaaagtcggcatcaggagattctttagatagttctacaaattctttaacattttcccattcacgagttttaatcagaacatcatcataataacgtccaatggattcagcacgtttcataatagcttcatctaatacaatctcatcaaataccttcgatggatcagtataaagatttcgcatgatatgtgtatatgaacgactgtgaatagtttcactaaaagtccatgtagcaacccacgtatcaaggcttgggtctgaaattaatgacataagtacagcagacggcgcacgaccctgaatgctatccaaaagtgattgatacttcaagttgttagtaaaaatattttgctgatactgaggaagcttattaaactgtgcagcatccatcattaagtttacttcttccgggcgccagaaaaatgataaggacttctctgtaagttcttcaaatactcgatgccgttgaatatcataacgcgcaataccaagacctgaaccaaaaaacataggttcttttaaaacatcaactgggtttgtattaaaaactgtagacattaatttttcctctttaaaattctgccgcgtttccaacctggcggtataatatcatctttacctataagcgtgcattcacttccattattaatccatttcttaccgcggattcctttataatctcttggttgtattttgtcaaactttgcatcaagttgatatgcccatcgaaatccataggcatattgaaatttaccctcagcacaatatttgatatttgacccgtttccattaactgacctggacgctgcggcaatagagtgaaaggtttctatgaaatccccatctaatgagaatttatgtatttcgatagatgggcatgcatacctattcacgtttgatacatgttgtttagtttcgtttttatgatgcttgcctaacattcctctaggatgaggattatttttccaatatttcttaaagaaatcagaattagctttagcaaataattttctgtgcaagctatacaatctgttattaattctattaccagctttatctgttgccattaacgttaacgcagaggcaagaccaaaatggccttcatttatcttgcatagtaatagatgcgctataaaatgttctctagctgttaattcaactaaattttctttatcatcagaacctcccatgcatttagggactatatgatgtgtctctttatactcggataaatgttcccgagcctgagctcgggaaattaggtcattatagattttttgataattcattacaatttacacgctgcacaatcgtcggctttaggagtttctatttcataatcatcagtaccagaaccatcacgggtattatgataatagaaatttttaatgccataataccatccgtataacatgtcatcaatcattattgacattggaacctttccttttggaaaaatctgcgggtcatagtatgtattcgctgaagctgattgacatacccatttcagcataatagctacctgcgtaagataaggtttattacctttcttagctaatttccacgtataatcatataggtctatgttatgctcaatattgggcacgacttgattaaaggagccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgccgaccagtcacaaacgtattttggagatgcgatttggtcaatctttttattgtaccagtcgataggtaattcgcctcgagaccaacgagtgtctgaataatattcgcaaggtcctttttcttttgcgagcttaatggatgctttaatgagtccatactgtaatctctcaaatagttcatgtgttaaatcattagcatcttcataagaagcaaagttacttgccagccaagctgcatagttggtaacacctacgccaagatttcgacgctttttagctttttctgcttcaggaaccggatatccttggtaatccaaaagattatcaagagcacgaacttggacttctgccaattcattaattttatcttgatcttgccaatcgaagttatctaacacaaatgcagataacgtacacaatccaatttcggcatcaggactattcacatcatttgttggaatagcaatttcacaacacaagttactctgacgaataggtgccttttcacgaataaatggagtatagttattcgtattatcaatgaactgcacataaatccttgctgttcctgagcgttcagtcatgagcaattcaaacagttcacgggctttaatacgctttttacgaatattaggatctttttctgctgcttcgtataattcacggaaacggtcttggtctttaaaataagaataataaagttcgccacccatttcatgcggactgaacaaagtaatgtaatcattctttccgaatcgttccatcattaggtcattcagttgaacgccataatccatatgacggatacggttttcttctacgcctttgttatttttcaaaacgagaagattttcaacttccaaatgccaaataggataataagcagtagcagcgccgccacgaattccaccctgtgaacatgatttaacagcagtctgaaaatgtttccaaaaaggaataacaccagtatggcgtacttcacccatgccaatcttagaaccttcggcacgaatcataccaacgttaataccaattccagcgcgtttagagatatattcaacaatcgaagcggaagccttattgatagacttcaatgaatctcctgcctcaataacaacgcatgaactgaactgtcgagtcggagtacggcaaccagccataataggagttggtaatgaaatctgtcgagtagataccgcttcataaaaacggataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgctcgtgcttaatttttgattctaaaaatgtaatttcttctgctgaatattttgacaataattcagggtcatatttaccttcatttacacagtaagaaatatggtcaataaatgaacgtggttcatactgcccataaacatgcttacgaagagcgaacattagacaacgtgcagctacatattgataatcaggctcttcaaccgaaatagaattcgcagcggccttaatgacaatagtctgaatatcatcagttgtcattccatcacggagataagatttaatattttcatataattcataaggatctactgatgttccctcagctgcccaagataaaactttaataattttttgtgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttatatttattcactacctggcatagacggcccgcgcggtgataattcgtcatattgtttttccgttaaaacagtaatatcatagtaacaatcagaagaagttttaactgtagaaattttattatcaaaatactcacgagtcattttatgagtataatattttttgccataaatgataataggctgatttggtcctggaacttctagctcacttggattaggaagtgtaaaaagaactgcaccagaagtatctttaaatcgtaaaatcatatatcctcgcaataataaaattataccgccatctttcctttaattggcgggtgagatacatagtcgttaagaacaaaattatgcggctttgcgaattgactcaaccaaaatacctgtgattctgtgtcccattcatcaaattcatctgggaattttaattgtaattcgcataaatccataggttcacgacgcaaaatttctttacattgttctacgtgattcatatagatatgagtattaccgccagaaaatatcaaatctcccggaataagattacatatcttagctacaatatgaactaacgcagcatatgatgcaatattaaatggaagaccgaggaaaacatctactgatcgttgataccactgaaggtcaaggtatccattacgaacattaaattgatagaacatatgacaaggtggtaatgccatctgcttgagttcagctggattccatgctgaaacaatttgacgcctatcatttggcagttttttaatacgatcaataacttctataatttggtctacaccaccgaaatcacgccattgtttaccgtatataggaccaagttcaccactatgatatcctaaatcttttgcttgattttcgtaattttcatcccagactgttttgccttgaattaatgaatcgtgctgaattaatcgtaaatcattgacatttgtgcttcctgataaaaaccaaagcagctcagcaatgcaagctttccaggcgagcttcttagttgttaccgcaggaaaacctttagttaaatcccagcgtaatttagtaccaaacaaagcaattgttcctgtgcctgttcggtcatcggtttcatagccattttcaaaaatgtctttaattaaatcttggtattgtttcatttagtaccttatataaattataatacattttatgaagctaaataatcaatacggtttagcatcaaattttctctcaatttcaggcgtgaagtataattctttgccacgtttggaaaagcgaccaataatatgataattattctcatcaaacatgatattaccaatatccatagctttcaaccaaatatcgatatttctatccagctttatgtcaaaattccaatacggagaactattaccgaaaatactgcaagcggattcagtgaaacaactgctataaatcttgtctttaggaactactaattgatagacacctttaataaactgaggaccctgccactttggctgtttcgtgtctttttctaatagaatagggtaataattaaaattcatatttccgccacgcgttatttcatttatatactgattctgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaacgcagcatataacagagcaggcccgccaattacacttactttggaattctgatcaagcatagtctcgaatggtgcattaggacttgaaacttgaatttcgccaccagaaatgtaagttatgtactgttcccaagtaatatagaaatgtgctaaatcgccgtctttagttacaggataatcacgcgcaaggtcacgcactacaatatgactacgaccaggaagtaatgtagataatgactggaacgttttagcacccataatcataattgtaccttcggtacgagctttaaaattctggaggtcctttttaactcgtccccatggtaaaccatcacctaaaccaaatgctaattcgtcaaagccttcgaccgttttagttggagaataagcgaataccaatttaatcattacgcaaaacccctttcaagaaaccattcagtggctttattagcatcaaagaataattcttcatatgtcttttctttgttttcaaaaactgtcacacaaacacgttgacattctccacagtattcttctgacatactcaaagcgtcagaaaacatttcattaaattcacttaaatcaggattatgcaatgcgttaaaaattgcataatcgaattcatcattcataaattcaaatacaaaaatcatattattttccttaaacagactttttcacaattttccaatcagctttaaactgctcgacgtcagaatggtaaatccagaatcctgcgctttctccatcctcataaagaggacatccatcgcattcatcttcccatcccatatcacgtaaaagatgttcagctttttcaacaagttcagaatctttaccgatgatattaaaataccatttacctctaacttctgaatctttgatgctttggcgttgtaatctcattttattctccttaattgatagggtaatagtatcacgctactacccttctgtaaactactttttgaaagtttttcgcaaaagttcaatgatttcatctacattgttttcgtcaacaatgcagtgaatttttgttacgccagaaaccgggtctttgacttcatctttttcagaagtcggttctttatactcacgaaaacaatgaaattcgtcttcgcaaatttctaaaagtctatctttgaggtaaaaatgttttccatttgcgcattcaatgtgttttactgctttatatccattagcgacggaaacttctttaacttcaaaccatccgccattctctcgaatggctttaactattgatgaattagaacgtgggctataattaataaatgtatcaataagtcttggaacaagttcatactttttaccggtatacattacggtttcctcattttaacggggctgtaatagccccttgataattattgttcaatcagtcccatgtaaaattctgcgtcttcagaatccatgccatcacaatattcattagccataaagagggtgaggtcttcaagaggacctttaataacgatttgaatactccaaaacttagaatcttgcacgcttgtgatactaagttcaggataacgattacgaataatctcttcaatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaaggggacctctagggtccccaattaattagtaatataatctattaaaggtcattcaaaaggtcatccaggtctgtgtcatcagcactagatgaactgccagagcttgagctcataaaatcatcttcagtttttgtattgaagtcatcaacattgaatgcatccaaatcatcagcaactttatcggctttcttagcagcagttacagcagcaccgcccatcacagcagttcccataacttgaccgaatttagtgctcagttcttcaaacgatttgaatttatctttagaagtcatttcagaaaggtcaaccatttgttcgaacagttctttctggaaagattcatcatcaatgtttggaatcgcagattgattcaggaatttagattcatcgtagttactaaatccggaaacttgtttaactttcagtacaaagttagcaccttcccacggacaagttacatcaaccggagtttcacccatttcaacatcaactgcaatcattgcattgattttatcccagattttcttaccgaaacgatatttaaatactttaccttcgttttctggagcagctgggtcttttacaacaagaatattagcccagtaagaagttttacgtttaacaagactgtactctttattgtcagtgttgtacagatcatttttactgatgtactgacatactggacaagaatcgtaatcaccgtgggtagatgaacagttttcaatataccatttaccgtttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaatgaaaacatttttagctttctgtgaatcaatatttaaaatttttctataagcttttaactttatagaataattgttccaaactaaattatcagtctgttcatcatgtttatcgattatatttaaaaacgaatcaagcaagataaacgtctcaaacgaaattatattcgattgaagtagtttaaaaatataactcgactgaacttttggattatactcaaagatttctttaaaagcagaaacttcaacttttttactaaaataatagatattcctaatatcttcttcaaacttaaatttaatttgctttaagcgtccgatatattcacgataaaatactaatgcatcagcgtcagagatatcaccaatccaagcatcttggttagctacaagattgctaataaaaattaaagttaattcttttaatttatacttttctgatagcttttggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgcaaaagattttcgtcgatagcttctgactgaattttttcaattatacccgaaggaataaatttagcaaattgagtttcaggaatagagttttcttctaagaatgctgttgtagcttcaagataactcattccaaactcttctaccattttttcaataataaatccattttcttgacgatcaagaagctttgctatttcatccttttctttcttgattgaaagttctttttctgaaagaccggtctcatcgaccggacgaatgtcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatactcagattctgagagaagtaccttagcttgctcacgatcattagcaatagcttcaacgattgaagttttcattgaaggagtccgttcaccttcaactctggtaaaccaaaagtcagaacgtactttaactgaagcaacgttatcctttttgtcacccttaagaattttagtcatacaatcaatttcagcagaaccgcttttaattttaacccatttcttgtgcatcggtgaccattgcttaacatttggatatttgtgaagttgagtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttataataataagcgaaatcacggcgccagtatccagatttcgcgttatcaatacacagcacaattttagtgtatccaagcgtttttgcttttttgacattaaacttaattgagttcaatatcaaatgacgaaccattgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactggtgccgtatatacaactgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatggtattcatttttaataatcgtttgtggcaaatgtatattgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgttccagttttacaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccgcaaaaagaattggcaattactccagaaacgttagctaatcgtactgctacagaaactcgcagaggtattgcaagaatagcaactactgctcaagtgaatcagaacaccacattctcttttgcagatgaccttatcatcactcctaaaaagctgaatgaaagaactgctacagaaactcgcagaggtgtcgctgaaattgctacgcagcaggaaactaatacaggtactgatgatactacaatcatcactcctaaaaagcttcaagctcgtcaaggttctgaaacattatcgggtattgtaacttttgtatctactgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagtcaagaaggatgggcaaatgcggttgtaacgccagaaacgttacataaaaagacatcaactgatggaagaattggtttaattgaaattgctacgcaaagtgaagttaatacaggaactgactatactcgtgcagtcactcctaaaactttaaatgaccgtagagcaactgaaagtttaagtggtatagctgaaattgctacacaggttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctactgaagcacaggaaggtgtcattaaagttgcaactcagtctgaaactgtggctggaacgtcagcaaatactgctgtatctccaaaaaatttaaaatggattgtgcagagtgaacctacttgggcagctactactgcaataagaggttttgttaaaacttcatctggttcaattacattcgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgagtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattagcggaaattatggtttcattgttcgcaatgacgggtcagtaacgaattttatgcttactgcatcgggtgatcaaactggcggatttaatggattgcgtcctttagctattaataatgcatctggccaagtaacgattggtgaaagcttaatcattgcaaaaggtgctactataagttcgggtggtttgactgttaactcgagaattcgttctcagggtactaaaacctctgatttatatacccgtgcgccaacatctgatacagtaggattctggtcaatcgatattaatgattcagccacttataaccagttcccgggttattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgaatgggttgaataagaggtattatggaaaaatttatggcagagtttggacaaggatatgtccaaacgccatttttatcggaaagcaattcagtaagatataaaataagcatagcgggttcttgcccgctttctaccgcaggaccgtatgttaaatttcaggataatcccattggaaatcaaacatttagtgcaggtcttcatttaagagtttttgacccttctacgggagcattagttgatagtaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagctacaggatttcctaaaagaacatacgaaagcgttgagcaatttatgtctgcggttggaggaactaataacgaaattgcgcgattgccaacttcagctgctataagtaaactttctgactataatttaattcctggtgatgttctttatcttaaagcacagttatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggctccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacaccggtccaattactattaattacggggtaaatagttatcttcaattaagtaataatgaaacccccatccgaattcgttctggtggcggcactggtaatactcttgtagttggtggctcttctggcggtattagttttagaccagcaggtagtgaaatcactactggacaaattacgattacgccagaaggtttgacaacatttaccaaagctgtaacggctccatctgtaactgttacatctactccttccgcagcatctgatgttactcgtaaagattatgttgacggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaatgaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggcagtgttatagaattaggtttaaaatatggaggaacaattgatggttctttaactgttaatggaaatataattggaaatttaacaggtaacgctgcaactgcaacgaaattaaaaacagcacgaaaaattaatggtatatcctttgatgggtcaaaggatatcacgctaactccatctgacataaatgtcaatagcacaacatttataaaaaataatggcgaattacctgttgatgctaatttagatgagtatgggcctgttgaagaatatcttggcgtttggtcgaaagcaacttcaaccaacgctcaaccagcaaataaatttccagaagaaaatgctgtaggtgtgctagaagtatttgtggccggtcaatttgctggtactcagagatatacaactagatacggaaatgtttatattcgttccttgactgctacatggaacggagtaaatggtccgtggagtgtgtggcgaaatattcaatccggtactcgtccactgtcaacaacaattgatcttaatgatctaggaggcgctgaacactttggtttgtggcgaaatagttcaaattctattgctacctttgacagaaatttcccagaagaggggtcgtcagctcaaggacttttagaagtatatgaaggtggaaactattctcgcacacagagatatacgaccagatttggtgttgtttatactcgctgtcttgctgctgcatgggatgcatctgcgcctaattggggaccgtggcaacaagtcggtaatgtcacaccagcgactttctatgatggtgaccttaatgattttaaaactcctgggttatataatattttaggcactgatgccgttattaactgtcctaccggtgaaggtttgccgactgttattgttggtttgctggaagttaaacagcgtgcttctggcggtgctattttccaaaaatttactactgccggaacgggtgcaactactcgcgatcgtatttttgagcgtgcatatactggtggtgtgtggggtgcatggaacgaagtatatacatcttattctctgccaatcactttgggtatgggtggtgttaaaactcgattagcggagctagattggcaaacatttgattttgttcctggtagtatgtttagcgttcctttgaacaaaataaagaacatgccagcaaatatggattgggggacgattgacggaaacctggttatgttttccgttggtcctagcgaacacactagcacagggcgtactgttcaggtttggcgcggtactgtatcccagacaaactaccgttattttgtcgttcgtgtgttcggtaattctggaaatagaacttgcacagtccgccgtgttgttcttgaagatggtcgccacacatggacagctcaacaagattttaatggtgctgttaacttcggtgctcctaccaattttaactctactgttaaccttaataacactaccacatttaaaacagaagttaaattccgctcatctaatgcattccgtatgtatggcggaaaatttggtacaattttccgtaatgatggagagagtctttatattctttccaccgacgaaaatgatcaagatggaaactttaatacaaatagacctttccgttatgaattaagaactggtgatgttactttgggtggtactagtggtgctaacgttttaaaattaaaacgcgattctctcaccgcattttttggtggtgatattaatataaaaggcttgatgacttttgatgccggacgtttaggatcacgagattattttaaatttaaccattggggtgatagtaataatgcgcgcgataacattattcagttagaagacagcaaaggcgttcatttttccactgaacgtactttagcgactggtgcaattaaaactaaattctttggtgaagttgaatccgaaggtagattgattattaaacgtccgggtgattctattgtattatcaacaactgctggtaatgctttgcatattcgcggtgacatagacgggactggtaactggtatattggcaagggtggtgctgataattcgctagcattttatagctatgctactcaggcggcagtacatatcacaaacaatggtgagatttcgctaaatccacaaaatatcgcaatggttaacgttaaccgcgatcgtgtacacattaacggttctggatggattgctagacaaccgggtgattggggcaaccaatggcgagtagaagctccattattcgtcgatcatggttatgtttcacaggattgttattatccaattattaaaggaaaaagtgtaatcaccaatcaaagggtttataactgccgtcgatcttggtattcgtcgtgtccctaacaattgggggcaagcaattattcgtgttggatctgcagaggcatcgccagcggctggacaccctaacgcggtatttgaatttcattacgacggtactttctattctcctggtaatggtaactttaacgatgtgtatattcgttccgatggtcgtcttaagattaataaaaaagagctagaaaacggagcacttgaaaaagtatgccgactgaaagtttatatttacgataaggttaagtctattaaagaccgtagtgttattaaacgcgaagttggtattattgctcaggaccttgaaaaggaattaccggaagctgtgtctaaagttgaagttgatggttctgatgttctgacaatttctaactccgctgtaaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgctcacgagaaattattcacacgcttggagcagaccataacttcaatggtcaatggttccgagatagatgttttgaggcaggtagtgcacctatagtgtttaatattacaggtgatttagtatcatattctaaagatgttcctttattcttcatgtacggagatacaccaaatgaatatgttcagttaaatattattggcgctcatatgtggggtagaggtggacaaggtggatggactcattccggtggagatggtaatggacaacaaggcgggcattgtattcaaaacgacattggtggacgattaagaattaacaatggtggagtaatctgtggtggcggaggcggtggtggcggcattgcttaccgtgttcactcaggggcagactggcaagatattggtggtggcggcggaagaccatttggcccaggtggtggcggtggttactcaggtggcgcagcttcatacgtcgccccaggaggtggttaccaatacggaaatgctcactctggccagggcggcgatgccggaggaaatggacaaaatgcctggtctgatggtggtaaagttctaaaggttggtgcaggaggagcagcaggttatgctgtcataggatctgctccaacttggcaaaatgttggagtaatatatggtccaagagtataattttgaataaatacccctaaaaggagggtctatggcagcacctagaatatcattttcgccctctgatattctatttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatgcagttcatttaaatggacgtcattattattccgactcaaaatttgcttttttaccaactaaaaagcctactcccgaaataaattacatgtacagttgtccatatttcaatttggataatatctatgctggaacaataaccatgtactggtatagaaatgatcatataagtaatgaccgccttgaatcaatatgttctcaggcggccagaatattaggaagggctaaataattatttgttcgtatacatttctagatatcgatatacaccctcaaaaccctcgttgaattcgtcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctacgaattccttgaacgactcgcgttcctgagctacattatgctcgattaccatttcaagattatgactcattcgaaataatcttcaatttcgtaatcatggacataaatcattatagtttttaatacatcatcaatactttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatctttatgaacagaagctttattaaaattatgttttgcgactaaattgttcatagtgctgaattacctctcttaaacatttgcatgtgaatgaaaactttttagctacaccacattcaaatatatgttctcttaaatcacgtgtgtcagtatatcccatcttaacaataaaatgccgtattagatttttatctttatcattgagagagttaaaataatcggattttgaattaatttccctggccaaattgaatcaccttcagttgacgttttagttcttttatcatttcttcgttcatcgcaatataaagatcgcgtaaagcaggttttagcattccatttattggagaactaaatggacacacataatcttttcctacaagctttttagttaattccatattacagaactgaaatgcaggttcattggcataaattccccaattagttgacatcattttattggcatattccagtgcctggatttgattcataattccatcaatttgaaactttttaatattcattagtaaaggtcctcagagtaaagttctttttcactaccaccacgttcaatacgtacttgtccagcgtaagttgcaataatcattgcttcttcacgtgtccaataattactatattggtcaataaacccttgatcatcatcacaaacttgctgagtaactaattggggtttaactacatctaaaactgctgccatatctttagaataatgacgagcacccggaataataagagttcgtccatcttttaatctaaaacggttggctgcgcaaacaatccgtcgttggtacttttggttttcatcccagtatgcggtctgccaacaaatttcaggaacttcatctaaaacattttgttctgtgtattcaccactgtaagaagctaatttagcagccaaactttctggagtctcacgtgacaaagctttatctaacagagctaaacgttctttaaaggttttcatttaaaccatcctttaatacgttgccacaaagttttctgttgagctttgttaacaccaattgagcgaataactggttgagattcctggaattctttataatcagcaaggtaaatttcgtaagctgaatccgtaaaggaacttatggctgccatgaaattattgcgaatacctactggagcatctttactttcacgaataatcatgtatttgccagtcttaatctttacaatagttccaagataagccccatggtaccagatgtcccatccctcttgagtaggttctgcgcaacgacgaagttcattaacaatttctaacttgttcattatttattcctcacagttcagatgctacggtgattacagcttcaatgttttctgctgagcgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactacgataagtttcaacctttttaagaacaaatccattttcatctaaaagttttaacatgaagtctttatcttcttccatatcagaagtaatctcacgagctttacgagttgctcgttttttcagcagttccggagcgttttcctgtgcgtataaagttgctgcatttgaaataatatcctgagcttcacctgtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaacatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaatttttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttaaaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacgttatcgtaaacttgcagctttcctttctcattaatgactgtaatattctgagaacgacgctcaatcagtccgaagtctttcataatttttgcatggcgttcttcttcattatcgctcaaagagtattcttttcggaatttaactttgaagccaaagccatgctcaccacaagcatcatcccatgtaatgaagcctttatcttcaagtgggtctaagattttactcacgtaagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaataacagtaggaataacaggcaaatagaaagcaggcggaatgtgttctttatcttgatgtaccggagcatattcagtatctttatatacgttatagaaatttttacttacacgagcaaaaatataacgacttgctgctgccttttggacagtacgagaaccgaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgggctaaagcttgtgaaaacacactgctagcatcgatacagatagttaaaacacatgctactatccaacaaataaatgaaataactcctaataattttgcgatattcatattttcctcactggcgtccgaagacgcctttagttttaagattattacgatagaactgcatcacgtgttcgttgtggaaattactcattaatatgcctgcaaaacgaatttaaaattatcagccaacatacggttcatttcttcaagtgtttgatactcagaatgatgattacgagtaaacgctaaagctaactgtccttttccaaatcccgtcgtcagaggtttcatcttagaagcaggcagataaaatactgtgtataccatattgttatttgcaatagtacgtgcaagctgagaccgacgttgacgaatatgacttagaactgcactgaatccttgcttagaacgctgattacctacataaaatcgtgcagacacacatggattactaaatggacgaccatctaatttacttactaaaaaataaaatccaggtttagataaaatatctttatgcggagttcccaaaaaccactcaccacccttgattgtaccaataacagtagcgcctgcattattcaaatcagtaacagtcatgtatttcatattaatttcctctaaattattttctactccaaggccgcatgaatacgcggccattaaattaatcgtcgcagtcgacgctcaattcccaaaactcttctacggtataagtttcagtatcattttcaatacagaaacgttcattactgttatttgctaaagtagcattaactgtcggtttctcgctagtgctcttaagaggtgaaatacgaattaactgatcaccgttatctaaacagaaaatttcaccaacttttacatctttaaagattttcataattcacctcaaggaatataaaatccgaatgcagttgttgaccatcccatccaatatgggaaatttgcaccaatgtaaaacataagaatataaaaccaaccgctcagcaaattcatcattttacaccattccaaattgtttcaactacggattttaaaccattttgatgaatatcaattccgactactgtcatcaaatagattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattgggaatatactcaaaactattagtattataactacattccatatagctttaacaatctttttcattttctgttcctccgtagtcgatagggtaatagtaccacggaagaacagtcttgtaaacaacttttttaaaaatattcgtaataaatgtgaataccaactactactgccgaaacttgtgcaacccaccatgcacacgcaataagtacagaattcaaaattttcataataacctcatcacaaaagtaaatgttaaacaaattactggaatactaattaaccaaacaaaacaccaacataatgaactcatagttcaatctcaacgatttccaagtgtttttgttttattgcctttttaacacaatcatggactaaatatgaccacgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacggtccttgtggtatgtaaactgttttgtgaaaatttttttaaatggaaagataccatccattgtagttgctttttcttacaaccttacgaaggtcttctctgtcaccgatgaacttcggagtgtactggataacacctggatgaatttctttagtgttgaatataattatacagtcagcgacttgatgatttagaatgggccctagatttattccagaaccatatggatactctccgctgcatcctgttgtcaccgaaatccaacgtgagtcagtttgatgtgtcttaacttctacacgaagcccgcagtatcttggatgcgccaatacatcccacgcgtatgtatatggatcatcgacatcttcttgacctttattaacatacccgcttagccaatctgctacaaaaaactctgcgtatacagcaatacgacatctttcaataacttctgctttatcctggttcgggttttgttttaaagagtatcttgcagtatcagcaattttgaccttcatttcgctagtcaagtcactgttcgatagggtaaatgtcggaatctgaaatagtctctgtaaacccggattcgttttctgcatttagactttcctttttaccactgagataagcgttatatactttaagagtgccgtaataaattcggtcattttcatctaaagactcgcggtcaagttcatcgagctcctttttatccatgactataacatcattacagtaaagaaacccaagtttttcgtgaccaaactcaaatttattacagtacacaatattagcgtgatgatttccgtgcagtttaatctcttttatgtcggaatcaccgatattcatacaataaatcataatttttccttaaaacaaaagggccgaagccctttattttacttgaattgtgcaattcttttctctagacattcagcataagatttcattgagataaactgcaaaagtaacagttcttgctcaactgcattaactgttagaaactttgcgctttctaaaaatttgctcagtgcattaattttgagcattaattgatcgtattcttcttttactcgtgcttgataacctaacataattttcctcagttaagggccgaagcccttatttaaattgttcagtaacgtcttcaactacttcgtattggcaggtacgcattttagcatcgttgtaatcaatcggaattgatactacatcacgcggatgtactttaacttttacaactcggctagttgaactgccaaagtgacgaatataagatttagaacacacatgcagaccacgagaacaagtttgtgtatcatcgtcattcacacgagtacgtggcattttaactactttacccggactgttatcaaaggtatttgagtgacagtcaaagtaattgctgcgaactactttccaagcatagaagtagccatcttctgtaatttcaatatcgtttgctaccaagaaatcaaagagtcgagataccgctttttggcttgggttttccagcagattttccaagaacggaaaataaaattcaaagttttcgcctttttccatcgagtcaagaatacgatcaaccaaaccagaccgcaattcaatattttgatagaacaagcttccaccttcaattcgaacatcgccggaaatatatttttcaacagcgcgacgaacattaattttttgtgctgcttcttccagcttatccgctacaagcagattaagaatttcctggaagtttgaatgagtattaggagttgcgttataagttacaccgtcaacagtaattgaaatgaattttttagatgcattccaaataatgtcagatttagcaactggagcaataactacatcgctattaactttaactgtaatatcaccgctaatagtaactttagagcgtttagcttcttcagcatttttcaaaacacgacgaattgtgtcaaccgatacaccttgccaatcagccaattcctgttgggtgtaattgccacttgaatacaatttaacaatttcagcttgttcgtttttggtcaggcatttaatattgtacataattttcctta

SEQ ID NO: 11 - DNA, 167496 bp, Unknown
  Myoviridae; Tevenvirinae; T4virus
ttaggccgcaagggccttcatagttttagcgatttgggaaacttcatcatcactcaaagagttacgataaccgatgaagtcggaaacaatacggaatttcttggtaaactcagcaaccattttatcactattttttgaagcattacgtgataattcatcaaagagattagttactgtccagatgtcatgaccgatggtatcttttccaccattaaaatatacaccgcgcaatgaactaactatattagcgagtcgtgtatattcttcagaaacttcatctgtactgaagtacttcatcataaaatctagttcaggatacttgataattttatcaatatatcgttgagctgaacttgaataacctacgtacttatcataatctacatcatcaaaagcatctacatataaatcacgcagagtttcaaaaatacattggcactgaccgagttcttttacctttttctgcaaaagcggacgaataacataaaactcattaatgccaataagattagccatacgaatcaaaatattcatagatggatgacaaagagatgtagtaccatccatagagaaaatatcagaacgatgcatatacgctacatacccagtaatttcatctgcttctgatgtgagcgtaaataattcctctttttcccagcgcccgtctttaatttcaaacttaaatgctgtagcagctttaggacgaggagctttacttttaactacctttggaatatagcttttaactaaagcttcaatttctgacaaataatgaatgttaacttcatcactttcaaacatcgccataatatcaggaagcaaatcaatctgcgattctacttctggattaataaacagaaggcgttcgttgtgatgaatattcaaagtgttattaaattcactatcatctaacgcatgtgctaatccacggacaatattaacacgatttttaatattatcaataacgatattaatttttgttgtattaataccaaacagacgataacttgatgcaacggctgaagtttcatggctttgcttaatgcgtttcagtcgagggtcaagatttacttcatacacaactcctgcattgcataacttactatcaggttcaaacatgctttgcatcttcttatatgacagatttttagtcgtaaatttgactgaattactaatcatataatctcgagcagaataccccatcttcatcaattcacgatatgtatgacggggagatgtggattctttaaatcgttttacatcttcattaaatgctttctcactgagttctttaactcgttcaataatatttttacgagtacgatcatccagtgaaagagcctcgcgagatggagcaatatcaagtgaacccattggaaacttaatgtaattcacttcattgcgaatgcttagccagttacggtctctaataacaccatcgataggataaacaataccgccatagatagcatataatccaccacgatcaggccagtatctttctggatttacaccgtaatagtcatcaaaatccggaaaataatcaatttcgcggtcaagaccattaatgatagccaaatctttgaatggtcgcatgatataagaaacttcataagcaaagtttctaaagtctttttcttcaactggaactacgatttcaataccagttttatcatctggacccatttcttttacgaatgtaggtttaatttgtggaccatcaccatccatgtaagctacataaccacgaatttcacctttatgatacgaagtaatactaaatgtatcagtataactaaacggagatttagaacctaaaccaaacccgccaataaagtcattagattcagccttagatgaactgaagtatgaattatataacccaggagaattatcatcaccctgaatatcaaaatcactcatacccggaccaaaatctcgacaaacaaatcgcggatctaatcgtcctggaacttgtatgataaatttttcaggatttccattaagtgcatgggcatcaatcatattagtaattaattcacggactactgcacgaatcttgtttgtatacaaatcagatgacagaattttaaatactttaggagatgctgtgatgctaaatgcttttgatttagaaccattgccaagaattgtttctttttcagtggtgataatcataatttcctcattaattcatattacgcttaataacttcagcaacttctagtaattcatctttagttgcagtgtcggattgaattttatctctaatatctttaaagcggtttttaaattcttcggcttctcccatatcgaaaaagcgttgaatgattctatattctcgatgaactgctttatcaaaaagttctaaatttactttatatgatttcatttcaatatcctcatttgcccaattaattataccacatccttgtggtaaagtaaactactggctcatccattctttacgaaggtcagcattatctcccatgagcatttcaaaaagctctttccagttctcaggaagtttaacaacatcatatactggattttgaatcatctcacgatattcagatttttccaaagagccaagtcctttaatataacggatgctatgtttaggtagagcatctttagcactctcatattcagcgactgtataaaaccattcttgttttttaccgacctgagcgatgattacaggagttttgacaaaacgaattcttccttgctcaaacagttctggccaattactaaaaaacccgagcagagaaggataaatgcttcctagaccatcatggtcagcatcggtcataatagcaatattatgataattcaagttttcagctttttcaccaagaactaatccagtgattgcgcaaatatcaaacagttctttgtttttaagcatgtcagcatatgacataccccaactgttgagaactttaccgcgcaatggataaccaccatgaagttctttatcacgaacatcaataagatatccgatagcagaatcaccctcagtcaagaaaagagtagtgtcagcatctttaccgcaaagattcgctttaatgtgtttatgaaccttagctttagaagcctttttagctgctttagtttctgctgccttttctgccgccaatttacgagccaaagcagcttcaataattggcatcagaattgcttcattattcaaaatagcacgtgaaatctttttagcgtcaagttgaatatgactacgaatttcgccaaatggagaagtcaaacgctctttagtttgagaatcaaatcgcatgtttttcatatcacgaacaaacataacgatagtcaaacattctttgacacgcgctttagttacatcaattttgaacttacgtttgatttgtggaataaggtcttcacaaatatcatccataacacagtcaatgtgatggccaccattcttagtgtgaatgttattcacgtaagttaattggcgaaaaccatcaggtgaacgaccaaccgcaatagaacaattttcttgttcttgaacgatagcatgttcatcatactgtcgtgcatatttcttaaaattgccctgaacctttttaccattaaaggtaaattgaatatcaggataaacaacagcaagtgtctggagacgatctagtgtaatatcaagataaacctgagacagctcattagtttcaaatgacataaaatcaggaatgaaagtaacacgagttcctttccattttccaggaatatcttcccatgatttattttccatgccatttgaacaacgaactacaatattattttgaccatcaccagtttcaccgacaaacatcacagaaaaaatgtttgtcaaactagaaccaacaccattcataccgccagtgacacgttctttatcatcaccaaagttaccacctgcttttggaatagtccatgcagcaactggaccaggaatttcttcaccggtaggtgttttaaccatcgcttgtggaataccgcgaccgttatcttcaactgttacctgattatttttaatggtaacattaattttatttgcgaatttaaacttagtacgaataccttcatctactgagttatcgataatttcatcaataagcttaacaagaccaggtacatactgaacactttcccatttaccaaacagaaagcgctcatgcatttcattagcagaagagccaatatacatgccgctacgctttttgatatgttcaatatcgctcagaattttaatttcattcttaatcatcacttatcctcgtttggtttcgggaatattatactccggtaatcataaagctaaaggcccgaaggccttttatttaaaacgaatagttgaatccttaaagaacagcccagaacatactgttccttctactttctgcccagtaggtccaatagcacgaaatccagtatgttggaaatcattttcagaacaaccgaaccagttatatccagtgatttcaatattagtaaaaccgcttgaagacaaaactttggttgcattatcagcatcagtacatcctactaaagacactgctaatactaatgctgcgatagaacgattaatatatttcataattttcacttaaatttaatggcttgaagaagactaataactctcaagcggcttctttcatctttaactgtaaaagaaagagggtcaccagatttcatagtgatagtgcattcaaaagcaaaaccttcgggaacttcttcgaagaagtcaaattcttcatcataaattagaacattactctgcatactgtgaagaatttttccgtcatttccagatgctgtactaatcattgtaacgttattacctttcatatcttcaacgataaattcgcttgtagatattacagcattaatagaaccattcctataaatagcagaaaatagatatttcttttcttcaccttcgcgaatgcgatatttcttaccgattttaaacataattaccctttaagtaagtcgtaaaatccgccattcacatgcttaggggcagagactaaccgaatagcaatccgatgacaatcaggacatacatcagtatctctttcagaaattttcttgattttttcgtattcttttgcgcagtcttttgattgacatttataatcataaagcggcataattattccttaaagtgagctttcaacatctgatacaaggaccatgcctgttcatcattttcaatagtaactttcattacagggaatttagattgatcagttatcggtgcagattcttcctgctcttcagctgcctggtatggattttcaacttcattaaagaattcagcttcattcgatgaaagccaaataaaatcttcatccaaaatatctttaccagaagatagtactaaatttccagcaaatgacataattttaataggacgcccaagagcatccacatctaaaattttaaaaggatgcatacctaaacggcgtgcatagattccgttatcagtatggtctttaataaaattttcttgagcttgtttatttttaaattgataccatttattaacttcaaatttaatagccattaataaatttccttccagtaagttgtgccatcttcagtgatttcacgaaatacaccgtaaattggttgtttatccccaaccttttcatacacataaaccgaagtcaagtgagtaaacttagcagtgtgttccttttgaactactaccaaatctggatctaataatacatcttcaaattcatcattagtgcaattctgaacaattttacgtttcatcataatttcctcattaattgaacattggagcgatgcgtttcagaagagtatcagcgcacctttaacgaattatccattttattcttcaagttgttttctgtatcagtagttgatattgatatagtaccataatcaactactgatgtatatagttttatgaaaaaattttaaactttatgcatagcgagctttgctgtagtgtttaatccaactttcaggaatgactttgtatgttcctaaaaataccgcgttgtataacttaacgccatcttctacccattgatcagtaatgtatgcacacataacgcgagtacgccgaggaagtggttgtccaccttcgataaattcaaactcataaggagcaatgaacttaatagcttgaccgagtttccacttaaagtctacacctacatgcgaagtatcaatcgtttcaattcctttagcgggaacagctttcaaaaacgcagattcaagaaatttcgcgcgaacataaccaaactgaggtttagactttccatctttaggaatgatacgcacttttacttcagaatcttcatctttaacgccgtgtttaagctgaatgcttacaatttcgaccaattttcctgctgctttagaacgggatttatcagatacacgagcaatttcaccaatattaataatcatagttatctctcacttgttaaaaagattttatactccacaggaccattatactctggtcccaagagtttgtaaactattaattcaaaatagctaccactgcactacgaggtactacgctaaaatcacctgcatgaacaacgttcagaagttcaacaccatcttcaatccattggtctgttacccaaccacagaccgaaataaatggagtcttgatagctaccgcatgagttagaaggtcagtaggatcgcattcttgaaagaggatgaactctgcttcaaaaactatagttttaattacttcatcattatctaaacggcgtactcgaatcacgtaagctttattcttatcataccagttactttttgaaaagcttttaaccacaaactcgccttcaccaaaaacactagtcaatgctttataacccaaatttagttcagtagttttaatttcagtttcaaccagtttgtaggttttgccgatttcaatagcggtagtcatagtaggttccttaatttccagtggtttaacagggcatacataagtgcttacaacatcaaaatcaatcagtttagctaccggatttggtatgtattcaggattataattaaatttcataattatctcatttcaataaaatctacgagttcagcatgcgatttgcggaacattacttggtgcccaccaatgataacttcatcttcaggaacttcgtatacagcgagataaaatcctttagaagataattcttcccgctcttctcgtgtgaaccatctcatcatatcatattcactagcgaaagcaaaatgataaagacctataaaccatcctggaatatgatattctactccaacataatctttcttgaacttagtattaattactatattagcgtttttaactaatagtttatcttcgtgtggtaaaggaattcttttattattatcgctatgatgcataaaattaggtctgtcataacctacgtgtaatagccactcttcgctccatgaatctattatactcctgtacggcgttatttgaacacaaagatttcgacgtattgttatagcatcttcataatcaagaatactaaacgatgattcaacacgataaattttcattttattatcctcagtagctatggtgttataataccacaactaaccgaggaagtaaacaactttttatcgttttgttggaagagatagaggatcgcattcttcctctgacggagcatcttcaagacccatagcatagcgcaaagcatacttcatcatcaggatgtctttcgcacagtcatgaatagaatcatgtgcaacgaatccatctaaagttccctttggaagaggacaagtggtcatatcacgaacaagtagaagtgcttcaattctggtacgaatatcacgctgattccagaatttacacggttctaacttaaatgtatcaagctcattctcggaaacgccgttaagacgttgaatatcgcgaatgagatcgactaaaattggaaaatcaaacgacattccacggcaccagccttgagatttccaaggatcgatattatgtgcattgatgtaatcattaaattttgcaataccatcgatagtgcttacatcttcatctgatggtgcaatattttttcgagcttcaggagattgattcttccaccattcgatagtgcttttagtaaaaagacgatgtcctttttggctttttaaatcaaacttgattttaatgccgcgtgaaactaattcatcaaatgtttcaactacttctggattagggtcaaaggcaataacagccaaatcaataacagctgccttttcaccgcttcccattgtttcaaaatctataataaaatcaaacattaaattttcctcgctaaatcgcgaatttggcctacagtatagtcttgaatataaactttattaataggttcatcaataaattttgccatagattcaatatctttttgcatctcttcaagactgtatattatctttaaagctttttcgcgaatagtaatattttcaggaccctgattttcttcaatgacagctttaacatttgtcataagagatttaaactggtaccaactcaattcaatcattaataatcgccttataaagatagctaatttcgcctaaaatataatcattgattgtaacagttttcacttcaccacaaaagaattctaacgcaattaaatctcgttcaatttcttctaattgaagcctcaacttactagattctatttttacagtttcacgatttttgctataagcaatttcataaatttcgcttactttatcttgaagaagataaaactgatctttagttatttccacgaatagcttcctcaaatttaatcagtaatttacaaacactttcatctagtgtaattaccgtatctgtattactgtgatatgattgtttttcaattcgtttaattgctaatatagtatcacttataagataaagcttatgaaggagctcagctcctgttaccataacattaagattaagattatcttgcttattagtatgcttccttataccatctattagacgatttaaatattttgaattgatgttaatcatatatcctcacacataaaatacatcataacgaccacgggtaacaccaacataaagaagttgttgagccaattcagcatctgcataatgaatacaaggcgtataaatgaaagcacggtctacagacataccttgagctttatggaatgttgatgcaggaagtgctttcactttactaaactgtgatttagcatcccaaaaatcactccatggagcttttccgcctttgttccaatttttataagtttctgccgttttacctaaaaataggttaaacttatacagttcttcatcagatgaaattattttaatcttttcacgataatattcatcatcgccataagtttctactgttaaatcccaatgacgaattaagtattctccaggaacaccacgagctttaacaaacgtcgatgtatactctgcttctataatacgaactaattgtccgttattaaaaataatttctgacacaggctttccatcaattttatatgttttaattaatggttcctgcattacaataatttcaccgacaataaaatctttatcagtttcaaaaatctttttacgaataatgctatttaacttgtcaacagatttattcgtaaatgccattacgcgattttcaaacaaatcatctagagatttgacaattgaaaaataatttaccataaaatcgcgtaaagcggtatcaccagtaaatccacgtactccatgcccgtcaacaattttatcataaatccacttaccgttacgaacgtcagtagctacatcaataataggagcattactgcgtttaacttcagtaagttcacactgataaaaatctttgtgtgtaaagaatggactgatataagcagtattttctcctggatcaacaggtctaatttgcttattatcccctattccaattatagtacaccaaggtggaatagttgaaagcagaattttaaatagctttctatcatacattgacacttcatcgcagattaataccctgcatttagctaaatctggtacttccttctgttcaaaaagaacattttcttcatatgttaccgggttaattttaagaatgctgtgaatagtactcgcttctttccccgacagttttgaaagaatctttttagctgcatgtgtaggagctgccaaaatgataccagtttcacccgtagatattaaagcttcaatgatgaacttagtaagagtagtcttaccagtaccagcaggtccattaatagttacatgatgtttcttttctttaatagccctcataacgatgttaaaggcatttttctggccttctgtcaaatcatcaaatgtcatcggaaagtccctgcaattggaatactaacaatacgcccagtatctagaattcgttgatataatctttgtgtatctacatcaggcttaacatgtttaacttctattttattaaaccaaaacttgcgtggagtctcaactagtcttggaattcccatttttaaatctgttttatactgtgttttcaaagtatcgaaaactttatctgcaatatcctttctaaaaaatactgcaggatgatgctcatcaagtggaaccgggacagtaaatccttccatatctcgataaactattgcatatacataaaccataattaacctttaatcagttggaataatgatgcgctaagtggtaagccgcgtttcaattttaatttaccaatgaaaccaatcttttcaaaacgttgcagaccttggataactttatcatatgtatcgaaaagcgattcagcgtcagttaatttagttttagttttccagtcagagcctttaagaagaacgttgagtttagtaagttcatggccttctgcttgatgtgagccattaatgcgtgctttcaaagcaacaattctaagtttagattcgttagataaaggttgatttttcatcatgttcgccatatgcttaacacgattttcacgttttgctcggatttttaaaatagtatcataaacctttttaatttgggcccatttcttctcgtcgagattaagtttctctactttacgggcagaaggattagcaatacgtcttgcaacagcgtcacgtttctcaataagttcttctaatgttaaatcagaacgagccgtgttatattttttcttaactgggataacattacctttaatgtagccgatatcgttattaaaacgttctaaggataatttctcaccttcaacagagttattgaaagattcgcctgagtaagcgcagaccttttgatcaagaatgtttttaaggtaattaaagtctaagttaaaatccttagagcgtctcttcgcagaagctctggtgtggtcaagacgacgattgattttgttaattttattatttgataacataatattttcctctgtcttacggacgttaggtcatttagctgataagcttataatatcatgccctcaggtagtgtacactcttttttcataaaatgctttaattttttatgtgttataatggttctgagttccatccggttattccaattcagtcagtaactgacaatagacagattccagattgtataacgtccatcttgaataatagaatctacacgcagtgtagtccctatagggagcataaattcacattcgtcagatataagtctagcattagaccgtcttgtcgcttcagggaaagctccattgaactcacaagatggcgcagccagaatcatgttaagcatatgttcacggaagttgaaagcaaatggcgcatctttgatgcagaacatattaaatgttccgtaaaaattatacgaagcaaagttacgtgctacaccgaacactgggctgaagctcattactctgtcaaatttaataatactaccaatgcctttatcatcgagtgcggccatagttttcttagagattccacgatacattgtctcaggaacagaagacgtccaatttctacgaacgattgaacttaactcctgttgaatacagtctggcttgttttccatacactgccacagtacactttgttcaatgtcgctgaattgactatcaatttcgtactgcaatacatcttgatattcggggttttgagcacgacgaaccatttcttcaatttcacactcgttatacggcataaacatttaggtttctcctgtggttgataaaggtatagtatcatcatcggaagagtttgtacactaaaaattcaacattttcaaatgaatgattttgtataatcgagataaagggtcatattctaagtcttcaatttccacaatctcaaatctagagatacctgagaccatgtactcttgttcagattcaatcatatctaggacgtcaacacgcttttcttccataacatgcttaggattctttccggcaagtacaatgttaaccatgttttggtagtaatcaaaaatgaacggagcattcctgagactaagaatagtgtacgtctgatattcccaactcccagagaattgacgagctgtactgaaatcagttgtgaacgatgttactcgtccaggagaccaatggcatccaacagaaagaagtgaaagacgttctacttcttctggagttacaccacggtagagttctactggtactgtagaagtcatatgcttacgaacaagatggtctaattcatagtggaaatccgggtcttccttagaatcggtgcaagcccagagaatgttttgttcttggcgggtgaatttgctatcaatcagatttgttaggtattcgcgttcttgaagttcagattgacatgtcatgatagacctccatttaaagataagcctatcataacacgagaggagggaatgtaaactactttttaagctttcctactaaaggaccatcaggaccaggttgttctaacatgaataacgatgctttaaaaagcaatgtcaaccctttcaccattcgataccatgtctcaaagtctttttccttgatttctagtaagaatttctctttcaatttctctttcatttccaaggactccatggcggagggtcgtcataataagaggcaaggtctttcagggcttcaacaggtaaactaaagccgtgtcgttgtataatactatctagttcatcaacaagttcactacgatgcactttaggagcctcaacttcaggctcgtcaaacatactcataaggtccatattactcacctaaataaaaactaggctgctcggagaatgtttctagcgctacaccttttgtcttaaaaaatttccaaatagctcgttgcaaatggattaaatctgctaatgatgtaataaagtattttttggcaaaatacttatggtctcgcttttcaaacaagtctaaacgcttttcaggattcacataaacggcattttccgtagattcataacctaagtcctttataccttcttcaagactaaacggagaatttttagaacgagtaatagctccaactcgctctacacggattttgtaacctttaggaatctgcaatttgcagaattcttctacgatatattgcggattatttagacttttgttaatgagaatagctatttctagtggagtcttatcttctactggtatatgtttaaacgacttggcttcaagcaaatacattttaaataacatagcatccattataatttcctcgatggttcacccatataaagttttacaatacgttcgccttcatcttcgacgagcttttcttcatgtttctggaattctttagccatattctcttcaagaacatccagccaatcttctggttcgactccatcattcaagcttttaaaccattttactattctgttcattcacagctccctgagcttgaaccacaatcagaataacttgacccggaatcaccaggccaagacgatacgtatgaatgattataacttgaagagcttgaagcagacttaggacgaacaacttcttccatcattccatcaccgatatattcccaacttttttcgtgtgtatcaggaatcggcatcataccttcgcctggtttaacagcaaacaacttcttcagtatcgtaagcattaattgttcctcgaacaaaacgaacaccaccgtcatcccaacggatttcggcattaaatttgacgtcttcaccatccatcatgaatgagtgtacgactacatcatcgtaatatccaagaccgtatttcaacgaaacttcttgagcaatcaaagcacctaatgtgttattaggtttaatccaacgatttaacatattgttctcctcttgagtaagtaagaatatcttaacacagtttttagtggttgtaaactgtagaaacaaaaaaaaaggaatcccgaaggattccttaaattatttaaccacttactggtgtaggggtaaacattgcagcgttcttagttttccagtcagctgcatcagaaactacagtagaataagctgccttttctgatggaaagatttggtaatgagaatctgcaatccgatgttcgtttgaataaatctcaaacggcacagaaacttccatacctttaacttctttaccttcaccagcaggatgcgtaaaggttttgatgtttacataaccacccataattaactcctttgttgtttaattacaggtgtatttataacttaatcagtaaccattatcctggcgttcaaagttgtgttggtttttcaagtagtaaagtttaaagatttcttcagcggaaagacccagaccttggaacatattcagaacaaagtggagaatatcaatcatctcgaatttaatttcaagctggtcttcaggagacagttcatcgatacgacgattacgatattcagcatgttgtgctttccatggcttccatacagcagatgcgtctttttcaccattactcataccaccaagagaagtcagaagttcacggaattcatcatcaatataatctttctgattacgcagccaatcaacaacttcacctgcagtagccaaatcatcaggatgacggttatattcaggtttatctttagctaaacgaacctgtaaagatttctgcatatcaagcataacttgcagcgggtctttttcatcaccgagaatatcccaatattcattttgagctttatcagcgccttcaatcagttgtgaacattcgttaaagtaagccattatttttcctttcaattcatgggttaatagattaattatacaataaatatataaagcaataaggaggacatatggtacaaaaattaatggcacttgttaatgccatcaaaggtaataagaaacgtatagcttttactatttctgctatggtaggaattttactctggaactttattctatcacctgttgcaattgcacatggtattaatattccagtagttactcttgatacatttgtagatttagcatttgctttagttgggttaatttaaatcttagcatatttagataaccgcattttagccattaacccctgggcaatattatttttcatatattccataatttgttcaggggttgcaccttcctttctaatcatatcattgacgtcttttgatttccagggagatttatcccaaaacataaccctttctcctgcatcaactaatttagtcattcgtttgatagtgtcagggtgacgaggttcattatctaagacccacacacgcctatctttaaatggaacaacttctaggtctaattgaccacccgtaatagctataccattttcaataaaaagtgaatctataggtccttctagaacatatacatcgccatctttaactcgttcgactccatatatttttgttgcctcaggataagctttaatggtgatatatttttgaggagcatctttctttaatgcacgtccttgaaaagactcagcttttccattagcattataaattggaataacaagacgaggctcagaaatttcctttttgtatgttcccggtgctatgctattaactaatttaggccattcggttgtaaaccaaagatatttccatttatcctttggaatacaacgagcttttacatattttataattggatggtcttccgccagtttatctaatctaacacatgacggaagagatttaattattttcttctcaggttgtttaggaagttctttaggtttttctactggacgacttttacctttttcttttcttatttcaaagatatactcacgatataaatcgggttcaaactcctttaaatatattccgattggtgcatgatagttacagttataacaatgaatatttccttcattattatcaccataataccatccacgggctttattttggtcggtttttgaatctccacacactgggcatctaaaccgtaatttaaaagttgaactattatttacttgtgtgaatttaggtaaatgagctaatgcacgatacgcaaactcattatcaatccaaggtattgatgacatttttactcttctttttctttagattcctcttttttctttttaggaatctgttcaggacctttatttactacagcgcctgatgttgttccagtagagatattttcaggattaccacctgaatctccagctaccatatcttctttaataaattctttatatgttttcatattaacctctattcataaaagcattaaaaatttggtcatcaatagaaacatctactttagactgtttttctgatggtaattcatatccacatattacaattttgtgatcaatatcaaaatacacagaagcaatatgattaatgctgctttcagtaaagtctaaatcaacatcaatatctttttgaccaaagcccaaaggataaataatgcgagtaattcgattatctttaacaaagattccaccgacatactctgtactgcgtttaaagtctacacgccgacgaaatgaaaaatattcaggctctttatgagctcggctcatagggcacaacgaataactagaataagagatgtcaaatcctacgccttcaatatgaactaaattgtcatgattaaaccaattataatcatatgccaagtccattagattgtcatatgtgaaaggcaccggattaacatcattggtcacaagcatataattagcaactgctataatttcattatttttaacgaatacaaaccgtgattgatgtgaatgacctggacctgcgttttcacgattaatgatataacactgggcacctttatatttgtacgtgtctttacacttgtgcatttgataaagcattattcacctaccacttcagcgatgatatttttattattaaagtttttatcgcaatacagaacataattatactgcattacaccaccagacttaagctgtttttgcacttcagctttcatttcaggacgatcacgctcaacgatattcataatatccgcttcaatttgagtttcaacttcagtctgatctgcagtcatagaccattcgcacaaatctttgtcataacccgccatagcaggctgagcagcgcaagaagataaagcaaaaattgcagcaaagataaattttttcatgataatctcctcagtagtttatgtttatatagtatctcaatttccaataaaagtaaacagttattttaaaacttttgcgtaatcacatgttacaaactgtttctctaacttggcgattttacgaaagtatcttttgcattgacgaatctgtcgctttgtagggcgcacagcaaacttaataaattccactcgaccaaatggagggctttcttctgccggaatatctaatactaattcccacgtatctgcaataagtgctttgaattgagtatttttcctgacattatacggagtaggtttaaataaaacgatatgcatattatcctcggcaatccacttcacataccttcttgtcatcaatgaaagctttaactagtgctttattaacttcagcatattgagtagtagcccattgaacgtcatctttcatcattgtgatctctttagtaaacatgctttcattcttaaaccaccccataaaaactacctttaccaattccataacaatctcctcatttaaccaacaagactactataccatagtcttgtcagcttgtaaactaaaattttaattcatttgccaaagcatctaactgagctcgagtcgattcgtttctttgatagcgattctgctcagcttgtatctgttgtgaacctgctacctcactcacttcagttggagtagaatcttgttcaatttctacccatttctgatttcctttttgaacacccatcaaaaacttattccatttattcttatcaccatatcgtgatttgatttgcttaataagttgttgttcagcagctgctaactcctcggtttcaatgaccgcaagcataaaatcagctgttgctggaagaccggcagattctgcaatatcgctcatgttaacatcagaagaatcccaagcttgtttaccaacctgtgctgcagtccaaagaacagtttcggtttcaacagcaagagcacgcaattcctctgcaatagctttaacagttgtgtaactattttctgaataaactcggatgcgacaagatttacaaatacctagatagtcgacaataatgattgttggaacaaaattcttcttgagcttcaattcgtttaaaagtgatcgaaatgtattagcatctgctccaccagtaggatactgtttaacgattaaacgaccgagagtagatttctcacgccatttttccatttttcctttatactcagcgtaagaaatatgtccatcatcaatgtcatcaagagaaacatcaagcatattagcatcaatacgcttagcacagacttcttctgccatttccatggaaatgtaaagaacattatgtccgagctgcaaataatctgctgccaatgaacacagacctaatgacttaccaacgttaacaccagccattaaaacgttcagtgttccagtttcagctccgcctttagtaattttatttagaattttgagtttaaatggaaccttacgagctttattcatataagatagccaacgtgcttcgtagtcatccatccaatcatgaccaacgtagctatcaaatgaaattgataatgcttggcgcatgatgtcaggaatagcacctacatctggcattttcttatttcgtttttccggaggaagctcagcattagtttgaatttcaattattttagatgtggcgttaaacatcgccctttgctgaacatatttttctgtttcttttactaaccagctatggtcttccggagaatcggccagttttgaaataagtgtttttacaccagaatattctgtttcagtaaatgaactattttctaacgcaacatttaacgcattaatagatggaacgctatggtactcgttaacatgagatttaattaatttgaatgtatttttagctggaccactttcaaaatattctgaatccatatatggccaaacttttgaaaaataagcttgatcaaatatgagatgagaaagaataatttctaccacacttactccttaaaagaatttaaattttttctttgaccttttattaaatgcatcttgtagttgcattgtaatacatttttctacatgaggagctaactcagcttttctttcttggtcaagaacagcaaagtccattacgacttttccatcaacccaatctaattttgtcacatacacaatgtgtgtagaaccgtcttctagtttaatgacaatctcctggataacattttccatggcagatttaattatcttaagagattcattaaaaagacgttcttttctttcttcttccccctccgaagagggggattcatcgataatttctagatctaaatctaaatcatctttattcattaaattcttccatatcacttaactgatctaggtcagtttctaaatcagccgctgatttacttttactttctggagatttaaatttttcaacctttgagttaatcaattcatcaacttcagcttcaacaatttcattactatcaatagcacctaactgataagcacgtttaatagcatctcggaatggttgatgcttaaataaaggaccccagaatgtagtgcagttggtatcttttgcacgccaagatttttcttcgcgaatcatctcaccggtttcttcatcaagaaattcacgggcataccagccatttttaggttttactacaaatcctaattctagagccatatctaacaatccagaataaggatcgataccaccgtcaaatttaacatcaataaagaatttacttttttctttaacggtacgagatttttctacatttagaacaaattgatacccctgaagatcagaaccatctttaatctgacgtttaccgataatgaatacagtatcagccgaatacattacgcctgtaccacctgtcatcacggttttactaaacatttcaattgtttcaattgtatggttaaccgcaacacacggaatatttttaatgctaaaataaggagtaacgatacggaataatgacttcagtgatttagcacgagtcatatctgccacagatttttcattcaaggcatcttccgtttctttcttagaagccatattaccaattgagtcgatgaatactataaccttttcaccacgctcaatagcttcaagctgattcaccatatcaattttcagctgttcaactgattgaattggcgtatgaattacacgttccgggtcaactcccatggatcgcaaataagctggagtaataccaaattcgctatcatagaatagacaaaccgcgtcaggatatttgttcaaatatgccgcaaccatagtcaaagacatatttgatttaaagtgtttagaaggccctgcgaaaatagttaaaccagactgcataccgccatcaatcgcaccagaaatagcaatattcagcattggaatttttgtacgaattacatccttttcattaaagaatttagatgtagtcagttcagcagtcattttagaagtggaagctttaatcaaacgggattttaaatctgcaatagacattcattttttccataggcatcattatattttcctcactggttaaagatagagtaattataacacaataaatttaggcattaatcaactgctatcggatgaatagcattaaacttatgaaatgcttctgatttttctttacgcgaaacgcacatgcgaagaacctttaatggctcgtcttcttcacccaacgattttcgtttttcaatattagaagttttccaacgagcttgctctggaaactctctattgatttgctcaagcgctctattatgtttagaattactacgaattgaactgcacccgccaggagcttgtgcttttccagatacaaccagatatttgaacaaggccaaatgcggataaccttgattaattaaattgagaaatgcatacatatcttcgcacaaatcaatttttccatacccaatttgttctgtcgtaagttttccaaggtcataccatgtattcgtgaatccatatgaattttcacgataattaccccaagatgaagtaattttaaaaattggtagacgagcatgaccgtgataatacccgcaatccatagcatcttcaacatattgaatcaattcatagaactgttcacgagttaattgattaattttatctacgcgccgtttatcgtctctctttcgtattgaactcatacggatagtagtatcatcatcaatcatccagattcgttgacctgcatacatatcagtaattgctttacgagtaccggcaattccattaacatcatcaggaatagttacaattttagctctagacccataagcatcataataagctttttcttcgtgttcacgcactacaatatggggttcataatcagtcggaaacatattaagggcagaaactgcccctacacgctgataacttggaattacgaattgaatcatttaagtgccttacatttgtcaaaatggtatcttgtcatatttggcccacgtccttttagtccgcaatgcggacatattttttctatcaaattatgaggttttcctttacgatttttagacatcgtttctttaattattttagctttttctacgccaaaaatttcttcataagttttaccagaattttccttggctcgatttataattccatatgcctgctcatttttaccatacattggattaccttcgcctttcattcttttagaatgatcaggacgcttgattccacgaaaggcatttccgcacttatatctttcttctggagatagttttttaccgtacattccatttaatttgcctggaaaacttcctccccatgcttcattctttaaattatatgaatccgaacaattagcagcatctaaacaagttaaaataatttcttcaacctgtctaaacactggtccttcatataatatttctttattaaaggattttattccatatttctttttagcatgttgccaaactacacccgaaccatcataattcgggttgtgaccatcatgacttcctatataccactttttagttttaggatgtttatacttataaacatgtggcacatttacttccattttccagtataatcctttttagcaatatgagtctcaccggtgttccaccaatggtcaactaaataaaactgattttcgtacacatgaagacttccaacgttccatataatagaacctgctttatattgccgcgatgggtcgcctgcattcaaatcagatactaatttatctagtacgtatttttgccaagcataatcattacgatagcctgcccagcaatcattgcttctcatgctaacaaccgcattgactttcttatcacgaatcaggtactgtactgtattagtacacatgaaatctgacataccatctttattgtagtcaaattgcatggatggacgagtataaatcatgataccacgtcgagaatcaggattttgaccaagttcagctaaacacatatcatactgagcatagttatcttctgaccaaatagcccaaccataattcgagttaatttcgcctttagaagatgctacctgctgccaaatctttggtgtttcacctggaatatctttaacaaacaagctcatagatttataccattcaagttcgcgctgaatgtattcatcattaagagcgccaaaaataaacggttcatctgctataaatgatgcgccaataatttcaatagttttaacgccagttttatcaactacgaaatctttttcttttaatgcaagccccaaatgaagacggatttcttcaactgtcatagagtcattaatcatttaaacctcaattgatgcattcatatttaaattgtaacagtaataaaccccaccctatgataagagttggaatcatagcaggaactgttacgctatagtatatacttattataaccatcaagattaaaagcaatgctgctataattttgcttttcattccttctctctgatgataattacttgatttggctgtgcagactttttagtttcacccgcaattgaccaaataaatgtaataaaccaaccaataattgaccagttaaacagtaaagatgtgaaaaagattcctactgtcgattttgacccacgcatcaaggcgataaaccatggaagcatgtatataataatagccaacacacctgaaactaaaaccataaaaattgaacctgctactaaagtttccatgttttcctcacttagtcaaattttttacacatgaattataagaattcactacatactccatcggagcatttttacctgtacgccactggtaattattagcccaatttgcccaaagttcagcgcagtagttttcaattttttcttcgcgtgtaattacatctgaattacgatatgcttgagcagattcatctggacgaatagcttcgtcaaaattcgcctgcatttgttctactgtttgctttggagcttctttataacacttgacattaggattataaaatttgcttgaacagtttacaatttttcctgcatcagactgatttactaccggtccttgagctacacaaccagtaagacctaatgcaataaccaaaatagcgattttcataataatttcctcaaatgcaagtagtaattactccagtagtgcttatgcaggtattacccatttgcacacctaaagatccatttgtattcacatgaagattatcatcaattttaactgatattttaccattagtgtgaataacggtgctagattcaatcacaggttgagtatcattttcaacactaacaaatggaactgctgctaatgcaactaaacaaactgctaagcatcccataacaattttcatttcattctccaaatccgtatcagtagttgatagttgtatagtaccatagaagaacagggatgtaaacagttttgtgaaaaaatttttagggaatccaaagggtccagaatcatctctttttcataagtatagatttatattacttgtatgaaaaagggacctggaggtccctagatttattctatcagccaaacaggaagtctaacgaagctttttcttcatagtccatgccagccgattcacacatacccgcaagcggtttaacaaacgatttttggaacaaagttgagtggtcaatccaagatagcacatcagaacgaatttcttttggaagttctgtacccgatggccaagcaatgcacttgtcaccaaatggatttccttcacgtaatggaagaaccattactttatttccatccaaaattggagctacacccagaccactaacagctcgacgataagttagcacaccgcgaatatggaacgggcatttaaatcctggccaacctttatcatcatatttcgctatatcgttcgcagtttttacttcagcaataactttatagtcaagttgacgatattctttctcaaagttcttgtagtattcttggacagactcttcaccttcttgaagaatacgacgaatactttcttcgagagcttcttgtactgcttttggtgttgaactctgctgagtttccatacccatgatttttagatgcggttcagcaaatcgtttatcttccatatcataaacgttcagagcataacgctttttcgctttccaaaatccaccaataccctttgaaccaagtggagggcaagaaatagcttcacggtccatatgcatcagatgctcgcggttattcatataatcacataactcacgatatgcaacatcaatcataggttccatctttttcttaccgaactgattcataaattcaaccaaatcgttctgctctttgaatcggtcaagaccaactttttcaataactttatctacacaaacatataccgaatcagtatcacctgctgcgatgaaatcttcgccattagttccacatactttattcagatactcattaattttacgagcaatccactgaataccaacttggccgaaaattgtgatagcagtagcatttcgcaaatcatagtaacggaaatgaatattaccaagagcaccataaagactgttaataagaattttacggttcagctgatttgtattagcaagtgtagcagctttttcacattcctcaatcagactattgagaacagattcagtataattcgacagttcatttaagaaatcatcactgaacttaacatatcgttcaacttctggtttagttgaacaagaccctgcgcctttcataataatctttttaatagcttcggcattcatttcttcagcgaacattttctttttccagtctttacgctggaaaaatactttagcgatttcctttggaatgataccttcttgatgcttatcatacatccatccattcggagaacaagaatattcatcactcggtttaggagctgttcctgcaatatattcatgaattggatgaactttaaactgaccacgaatagtctcaggactaatgttaacctgacgaataatgctcggatacagagacgtcaagtcaaaactcataatatatcgacgagcaattggtttaggttcaaatacgaatgcacccggaaaactctgtttaacgtgcgaaccctgttgaggaataaccttatgttcacctttcaatgagttaaaaataatagcatcccaagttttaataggactcattacaccagaaaaaggcattttagcataataagacatacttaaaactagatcgataaacccgcgaattttatcaattgcttgaactgattctacgtcaatgatgttataactaatgtatcgttgatgattagtctcacgaagtttattaataggaccatcatacggtaatttaccttttttggtttcatgttgagcaactgattccaaagagaatgacggcaaattagtaaaagcgaatttcttgtacaaatctaaataatcaagaatagatacgccatcaatagaataaatttctttgctaccgtacatattttgaattagtttagattttactcgaccgattggagagaagcgtttcatactacgttcaccgagaaccattttaacacgattcatgatatacggaacgtcaaatccctcaatattccaaccagtaaaaatagcaggtcgtttctgttcccagagattgatatattccatgagcatatcacgctcattatcgaatggcatataaattactcggtcaagaatttcttgaggaacttcatcaccaccttcacagtcaagcttagcagctaactttgcatcccattttgatactgaaccgtacattgaattcaaaaggtcgaaaacataaaaacgatcatcaattgaatcataatgagtgatagcatcaatttcatattcagctttcattggatcaggaaatttatcaccagtaacctcaatgtcacagttagctacacgaacaaattttcggtcataaacaatttctgaaccatacgtatcactgatataagcgagtttaaaatcgttcataccaagagcttcgagaccgatgtcttccattcgcttcatccaatctcgagcatctttcattgatggaaatttttgaggagcgcaatttttaccatagatgtctttgtactttgactcttccttacaatgcctaaacatagtcggaagatattctacttcacgagtacgttcctttccgttttcatcaatataacgttcaacaatgttatttccgactgtttcgatagagatataaaattctttcatagatattccttagtttatagcccgagttattaggctcttgatatattatactccaattaaggggccgaagccccttgcttaaattagtactatttgtcgggtgaaaattgtcaatccatctgcattaattgacttaacgactgcagtaaagtgtttttgttctgggtgaactaatttttgaaattctacctgaaattttagttgaaggttttctggtaaatcgaaaagtgtttctgttgcagaaagattatatttttctttaagagacgccatgtattcttgtggagttatagcagtcatattaattaccaatcgtatatttaggaacgagtttccattcatgtttttgtttaaaagaaataactcggaaattattagttaaatctttcataaaagttctttgaccaggaacgatttcaatcagtccccaatcttctaacagccatgcaatcgaatcacgacgaacttcatcttcttctgtcatttcaacttggcgaccatccatacgaagcatttctttaaaatgaacgatatagtatagtccttttttctggagaatgtggcaggactgatacagaactttatctttattattagcaattcccatacgagtcaaagtttcttttactttcagaaaatcttcaggttttttaagagtaatttcaatcattttaccattccaatgctagttttttgagttgtttctgttcttttacgttcttagtcacttctttcaaaaaatcatccgtgactaatcctttaagttcttttaatactaaaggtagttttccatttttagtaagaattgatttatagttaattgcatcatttgtattaacttgataccgcttagcaagtaacttaataatcaatacttcggtggaatcttcaaccagttttgcccatttaccatatcttttaccacgaggaactgcagccattagataattaaaatgagcttcatcacttaaacctgatccaattaaattcatagcatatacagctggcatgcactctggaaattgtgataatgcattttcaaccatgaattttgaataatctttttgaacaatagagcatttagttttattattaatagctccaattatttcaaaaaattcattttcagctttttctttaaaagaatcagcagcggattggacagctgtccaatcttttgaataccaagcaacttgatgctcgtttaattgaatatcatcttcaaataagctcatatcacttccactgcatttcgcacgctaattgaatgaaaagataagctaaatgcaattcagtattagctgcaataccatgatactgattattttcgcctacaatttcgtacatacgaataatactctgcggagttacacgtgaatagatttcttcggcaagtttaccaacgaaccacgaataatcagctgcatattttggtgctaaagctctgagttgtttaacatctttatttttgagagactcaagaacatcatcaatagcaccacgatcgttagtaaccagtgataaaataccagcatccaaaacacctttagatgaataactatcgagctcgccaatagttttacgaaaatcaggaaaattctttttaaccaaagctgctacaactttcatatcagctatagcaattccttcatgcttacagatttcagtcaatcgacgaatcatctgcttcatcatttcaattttatcttcatcggtcggttgaccgaacgtaataactcggcagcgtgactgaagtggtttaataataccatcaatattattagcagtaataataatactacagtttgaactataagcttccataaaggaacgaagatgtcgctgagattctgctaaacctgaacggtcaaattcatcaataacgattactttttgacgaccatcaaatgaagcggcgctggcaaaattagtcaaaggaccacgaacgaaatcaattttacaatctgaaccattcacaaacatcatatcagcatttacatcatgacacaatgcttttgctacagttgttttacctgttcctggagaaggagaatgaagaataatatgtggaatcttacctttacttgtaatagatttaaaggtttctttatcaaaggcgggaagaatacattcatcgatagtagatggacgatatttctgttcaagaatgtgttctttttcatttacggtaatcataatttcctcattcaagttttagtgtaaattataaagggccgaagccctttattaaaaatcgtgggtagaatcagcttcaagagctaccacataattcgcgtgttcaccttcaaatttagcagcaccttgtttaccttttgcccagagcagaagtttataatttcctggttgcattttcatatttgccatattgataatgaaattaaatgtattttcaccatcataatcaccaagagtcaaagaatatttaacacgggtcagagcagaatcttctactttattaaaaccgttaattacgattttaccttcttttaccgtgatagcaattgtatcaatctgcagaccacgagatacacgcaacagctgttgaaggtcttcagctttaatttcggtaacaacagatgctaccgggaatggaattggtttattaggagcaactactgtactcggatcggctgctggccaaaaaattgttgaacgggcatcagcaattttaatatttccatcttctgactgggaaatttctgcatcgtcattaactagggacagaataccgagaaaaccgttcaaatcgtaaattgctacatcaaaatcaatagtgtcagaaatatttgcttccgcataagttgtaccattaactgcgcgagtcataataaattgaccagatttaagcataatgccagagttaatagtagcgaaatttttaagcagagcagtagtatctttagacagtttcatgtaatttccttcaattcaaatgagatttaattttataactaatttaataaagcaattaacgattaaaatcagccgcaattgtttccgcaacaatttgagcagcaacaattagacgttcatctgcattaccgcaataatcatcttcaaggcgttcaccacatgaagtcataataaatttagcaccggcgtttagagattctgtagtatgtttgcgcattagttcaatccatttattacttacttcacgatcgatagcttcataatacgcatgacgagcaggtgcagatttaattttgttctgaataacttccattgcgttatcagaaagagacaaaacccatgctcgacgaattttattttggttttgtggatttgattcagaacgcacgtgttttggctgaatatcttttacatcaacagtataattcacagtaattttagtcataatacacctttagtcataataatcagtaacagtccaagcttcattcctgttggacattattttcgtatattctgctttaaatgcattcctaagcatagattcagtaactatatgctcttcattagaaaaattatttctcagaatatatcgttttatttcaggaatagttaatagatgctgtccagttgaatattccatgtttttcctccacagagattatactctaataaattaaagcataatctcttataaattaaaccattacagtaaaccgaccaactttcttcatttgaagatgctgaccatatgcttgcgggtcatggtctctatgtgaaataacaaaaacgttagtattttttaaactatctaaaatagttgaaatagcttttacaccttcaacgtcggtcgctgaatcaaaaacttcgtcaagaattaacgtgtttattttaacacctgaaactttttcagcaatatcacgccaagtaaataaaagagcaatatcaattcgtgctttttcaccttgactgaatgaagcataactaaaatcttcgcgaccacgggatttaattgtctcattaaattcttcatctaatgtaaacacataatccgcttccattattttaagataatggttaatctgcttattaaataatggaatgtactttttaataatagcacctttaataccagaatctttgagcatatcagtcaaaattcctcggtggtatttttccattactaaattagtttttgtcttaacaattttatcaagttcttcttgaagcagtgctatttcatcagcatggtcaataaactcagaagatgctttttctatagccgctttaacctttttagctttatctactgctgcgatcagagattgctttttattgcgaatatcatttgccaacgactgttgggttttaatattatctcggtattcatcaacaagaacttttaaattatcacgatgtgttgaaagctgttcaaacgaatgcgtacattcagaaactttatctttaattttagaaacaactttatcaccggaactcaattgtgacaaacaggttggacataatccaccttcgtgatacatattaatgactttattatacgagtcaatttttgatttaattaaaactgcttcttgaccgattttattaaatgcatcagtcgggtcttcatctaaaacaatattaactaatctttcattagcttcttctatttccgattttagcgttctagcttcttttgccaaatcatcatacatattttgcagacgagtaagattgtcacccgttaattttttctggcgttcaacgttatcattatatattttaatttgttggataatactatcttttttaacgtcaagcacttggttttgtgaatttaattcacgtattagtgctttattaagcttatccatttcagctaatgttcctacctcaagcaggtcttccacaagctttcttcgcgcaggggtcgacaaacccatgaaaggggtataccctgctgtaccaaggacaacaatctgcttgaaactggcatatgacattccgataagctgttcaaattctgcttggaaatctttactgctggcagattcattaagacgtgtaccgttaacggtgatttcaaaaacgttcggtttttgtcctcttttgatatagtactttttctcatcatattccatccacagttcaactaaaagttctttcttatttgtgctgtttattaattggcctttctttacatcacgaaatggcttgccaaaaagcccaaatgtgatggcttctaacatagtagacttaccaccgccatttcgtccagtaataagagttttttgaaccttatctaattgaatgtcaataggatttccacctactgacattatattttgatacctaactcggtttagtttaaaattcttcacaaaagattccttttaatgtatcttttagaccattctatcatatcatcataatctaaaaagtattcatcaaattcagccatgcaaacaacgccttgtgctgtttttgatgtaatataaattattccaacatatctagaatcttcttcggtataatcaatgtttgctatgaattcatcattaatgtcaaatgtcgaaaacttcacagtatgcatccttaatacaagatacggccatatctcgtaatgatttaggtgtgtcattatctaaaatgttgaagttaaaggacacagcccagtcagtgcagaccgtaacctttttaatacaattatcttcaacctctagcggttcaaaccaatattcaataatttctttatgcccaatatcatcttttacttcgcattcaaaatgctgactcatcataacatttttaaattcatcaaaagtcattgtgttgcctctacatatagctgatttgcatattgaataagtgcttcacggtcagaatcggtgatgtctggaattgcattaatgtattcttccatcaatgtctgaagcgattgaacttcaacttcttcactgtcatctgactcgacagagttatcaatctttgacacaactcgtaatgaatgcacaactttctctagttcagattcgaacttcgtcagatttttgtctacttcagttactataacacgtactgatagatttgtaaaatctttatagtcaatttttcctttaaatggataatgaattctacgatgccaggtagtattatttggaataaattccattcgttctgtttctgtatcaaacatccagaacccacgagggtcattctcgtcacctgctgttagtgtccatggtgtcccaatatatctgacgttagcagcctcagaaatagtatggaagtgaccagaccacacttctttataagtcttaaggaaatcaggttcaagaccatgagatttcattcctttataaaaataaaatccattcagttcccagtgaccaacacaaaaagaagcagatgaagttttgatatgctcaagaatttcaccagtattttcttcacacatccaaggaattaaatcaattaaacatccgtcaaaatctactgtagtaggcttatcatatactttaacattaggatatttagccaaaagctcagtagaggcatttggatgcattacatttttatagtggagatcgtgatttcctacaatagtatgtaatgtgattccagcaccatcaagcatttgaactatttcacgggcaaactccatagttttatgcgtgattgcttttcgcacatcaaaaatatcaccatattgaatccatacagtaattccatttttcttagaatattctatcgcttgcttaattccatcaatttgaataccgcgaatccactcatcatcggctttaacgcctaaatgccaatcacctaaatttaaaattttcatatatcaagaaccgtcattgaaatgcaaaataaaattattgaaataaacccatctggcgtgctaaagaaaccaatccagcatgctctagtgaatagataaaatgcaagaaaaagtatcacatatccaagaaatatcattatatcaaactccgtataaagctaaagggccgaagccctttattttgtaataatgtcaaactgttctttaaagcagaagcttgaatcttgatgctgatacaaaaattcatatgctttttctcgctcacggtcataaagagctcggtcagatgacagttctttaatacgttcaaacgttgattccatatcattttcatcaaaccaaatgataccgctatcatgcgaggtcaaaggagtattatcaacacggaattttaaattttcgccagtagatttccaaaataccggaattgttccacatgcaccaagctcgagatgagtatattctaaagaacgttgtagatattttttgtccaacttactcagctgataaccaaaaccggatttactcatgcgttcaagcatttcgctatttacataacggtcaagaatttgcgttggcaaattaggagcaattttaatttggtctacttgatgaagacgataatactcgtatggaattcccttttctttaataggaatgaacgctggagaacgttccagaccttccataatagtacttagtcctgcaggtttaagatgtttttcatgaaaatcaaacatctggtaaaaacctttccatgtagtcgtacgaccaatccaacggttgatattcatgttaatttcagaaacatctttccagtaggttgatcgaaccttcgcaatatccataggaggctgaaagttgtatacggtcggtgcttcttcaatatcatcaaacagagaaactgtttcaggataccattctttcatcaaaactttattaaagtcaccattatcagaatggctaaaaataacatcagctcgacgaacagtttcttctaatcccaaatttcggcgtaaagaaagagaagaatggtcatgctgataaactacaacacgaaccgaaggtttaatgttatcaataatttttttatagttattaattgtgtcttcttcgactgaagtagcaggaactgaattgataattagaatatcacaatcatttaccagcttaagcgttttatcgtattcttttgccaataaaaccggaattgaaaatgatttataatcatgtgcacagttacgagtaaatgatttatctttagcataaaccaaagttacttcatgaccatttttaataaaccaatcacgctgctcaagagaaaatttagttacaccacaaccttcaagacctcgagccataaaaatacatactttcatttaatatcctctttgttttggtttattttaccaaaaatttataaagcaatataggagccgaagctcctatccacataatacgccatacagaggctcgttagaacttttaaattttatgcgcttatattttatagttccttctgctttagctttatcatgagactctttaaagcgtctcatcatttcctctttagaggaacgaattttattataatctatttcagaagtctgggtgttcatctttcacagttgccaccattttttgacttgataagaatcaacccacactttcatattagggtctgctcttacaataggaggattaacttctttaattgaactatcatggtattctttttcagaaattttcacacaaagatgaccattcagagattcagtaaatcctgcattaattttaagacgcttgaattttacgtgtgtaagcatcaatcatatcctcaatctgcgatctagtagtcttccaaagaatactaatgagttcatcgttgtatggctgttttagaatatcccgacttttcttgatagcatattcgtattgagcaaaattattattttcagctgcaatctgagcgtgcttataaagacgattcagttcgcgtttgtttttagacaataacttatttgcttttctttctgcttcaagacggttcttttcttcaatagaagaaataagcttttccacttcatcattaatttcgggtttatcagtcatattatttctctaatataaaataaaaatcatcatctgttaaatgatacctgtaatttaattctacaccattagatttaaaagcggtatcatacggattttctggatcaatatcaatgtcaagagctaaaacttccctgagatacattttaagtaaatagggaatagcttcaacttcaggtatttcttccaagaatccggagaggttaatcgttagcctcatataaaaaatccaaactaggagaatcgtctacaacacttttcttttcagcccccggtgttctataggttgattcttcgtaatgcgtcattttatcgtagatgtcttgaataaaagtttcatctactaacgcaaccatatcgtcgtcacgactgtcatagacattgtgaacgaagtaactatatttctttgcaacttccttacgttcttttttaatacgttggacgaatgcattaaaacaagcttgagttatatacgcatgtgggtttttatatttcgtttcatcaaaattgtgaagccccttaatagaagcttctataccatctgcaatcatttcttgtttccaagactgggtgtatcctgaaaagttgaaacgtttagataagccttctgcaataagcataatggctaatccgatagtatcattctgacgaactactttatttgggtctttattatttgctaattctgttttccaatcaataatagcttgtaaaagctctttattgtttacgtaattatatttaggcttagtttctgacattttcacctcttagctcaattcatagatctattatatcataatatttgaagatctatcttaaagcatagaggatatcagttatctaagtaaacagtatgcttggaacactttttccatcatctttttaaattcatgaatatctatgtaatgactagttaaatcagcatgatataaaaagtctaaaaacttttcatgtgtactaacatattcactttcatttaattcagaaacatggctttcccaatatccaacaccagtcttatttgggaaaaatgaaattttcatgtatttgtcaacatagaaaatgccataattttcaatagtaatagaaatattaataaatttcatacattcatcaacttagccgcttcaagagctgcatctagtgaatcaaattgatcaacatattcaatcaattcgccgtaattagcatataaccaccattggctaaattcatactcaaggatgaatccgtttccttcaatttgagttaaaccaatgccatttgtatttacttcatacccagcaagacgtaaatcgttaataagagcttcgttcataattataccttagtaattttcaggtctgcaaattttttcttgcgttgatttttcatgcgacgaatagttttatcggaaatttcatgcttttgataagctttagattctacaccaaaagctttaacatcaaattctgacaagatatattgaaccaacaattcacggacagtattgcgtccaatcttctgatcattctgtttcatcgtctgatgaagctctttttcccatttatccaaaatttgaggagttacaatatcgcctttttctagcaaagaaactactttatcatatgcgtaagaattaatgacgtttttaatttgaatagtcatacattatcctcaattacgttaaaattttattatccaaaaagggccgaagcccttagctaaactttttggcacccttccagccttcgtacatcattgcgactgacaatgacaaagctccttcacatgctgcatacttattattccagaaccaatttagaaaaacttcatcctcaataccattgtgtttcatgttctggaaaaatttggcgcgttcttcagcaattcgctgcgataatttagattcaggattcatttaaatttcccaattaccattttcatcaataaatttaatccagtcatttactgaccacttagttgtatcgccttttggagtaacatttaaagtatataacccctgcttaaaaagcattcgtttgatattcatattttcctcagctataacgataacactcgtttgatttacgtttagcaactcgttgagaagtattataatcaaaatcatcgtcaatgtaaactgattttttcaactttcttacttcaccgcgtaattgacgatttaactcatctttaacttctgaatcaatacctttcattctacgccatttatctgagcgaaaaatgttttcaaccatatctttatgacttacaccatcaggagctttacgctttccgaaatagtcataatcacgaactttcaagtctttacgacgatacgttttacccatggagtttaatttccttagcaactgaactaaatgcagcacgatcgcaaatcatgtgtttatgtaacttaagtataagataataaacatcataaccatttacgtaagtaacacgaacagcattaccattaatgagataatactgcccctttttaatttctttatcaaccataaccatatcaattcctcaaaggcaattcatatgttaataataccacagtttgagctcgttgtaaacaactttgtgaaaattattttagggaatgataagaagggaacgatagcttagaatggtaatatacagaatgtgagaaagaaggacccagagggcccgtcttagtcttctatgatatctctatcatatccaagtgaaatgagagtttctttgaagtgtttaatgttcttttgtctagaatcattaatgaaaatgactggataacgaatgttaagagatgtgaatccagcgcgtttagcaagagatacaatcagcggacgatcatactcaatcttaccgttatttgtaagaactttatagaaagtaaaaggagcattgagctcctttagaagttttgtaactgattgacatccaggacaacgacctacttcttcggggatgccatagatttcaatcttattctttaagttcgagttttgttccacgagaaataattccttgataagcccagtatggcgggttaacagaatcctcaccagagttttcttcaggaaaataaacctggataacaaatccagatgcatcaaaggtaaaataaaccgtaggcagttcacctaacaattcggcacgagcattaatttcttcgagatctcgttcacgtccagcccaaaaactaggatttagactacattcgtaaaaataatagtcattaccgaacatatcaaaacccttccaactctctaccacataccgctcaaaactaatcataattaagcctttttatcaagaacagaattcagcttgttagtaattttatccagacgctcattgaactcgctagaagataaacccttttctggagaaatcaaactaatcacgaaaaatatagcaataaaaggaataaggaaaatagctccaactgccataaacagaaagaatgttacagttgtaagaaaatcagctaaacctttacgaaatttatacatattttacccttaattgattaaccaagcattgataagcactaaactatactgcgaataaaattctggaccaaaatgaaaaatcatatcatttatagtatccataatgtaattcaatttaatcatgtgtccacaccccatcggtatttgaccaaagccgctgattatctgatcctctccacagctttttggtcggaagatttttctcatacttcccatcaataataacatcaacatatttaagcatttctagttgtttaatatcttcaaacttatatcctgtccacaaccaaatgcttttatttggataaagattttttactgtttgaacaatgcaatgaataacatctcgattatcaggatagagagggtctcctccagttatagttaatccttctatataatcattattcaaacattcaattaattgttctagtgtttcaccagtgaatggaataccatttctagcattccatgttgatttattataacacccttcacatttatgcaaacaacctgtaacgaaaagaacggtcctgcagccaggaccattaacaaaatcgcaaggataaaatctatcataattcattggtgtttaaccctatgcatgatttctttatttttaccgagattaaatccgcgttcgttcggatttcccaaataaccacacgttcttcttatggtattcatctttttaggatcagtttctccacaaatagaacaaacaaatccgttttcagtaggagtcatttcatgggtacttccgcatgtaaaacatttatctaccggcatgttaacaccaaaataatctaaatgttgtgcagcataatcccatacggcctcaagacctttcaagttatttttcatatcaggaagttcaacataagaaatgtgaccacctgtcgcaatgaaatgatatggcgcttcacgagaaatcttttcaaacggagtaatattttcttctactgaaacatggaaactattagtgtaccagcctttatcagtaacatcctttacacttccatatttttctgtatcaagtttacagaagcgataacaaaggttttcagcaggagtcgaatataaactaaaagcaaatccggttctttcagtccactgtttaagatgagcattcattttagttaaaatttctcgtccaatatcacgaccgacaagaatattcaattcgtgaataccaatgtatcctaaagacactgaacttctgccgtttttaaataactcaattatatcgtcatcaggtttaagacgaaccccgaatgcaccttcttgataaagaataggagcaacagtagctttaactccttttaaggaactaattctacacatcaaagcttcaaaacataaatccattcgctcattgaacaattcgataaatttctgttcattgaactgtgttccaatataagaatctaatgcgatacgaggaagattcagtgttacaacaccaagattattacgtccatcaagaatttcattaccggttgaatctttccacacactcaagaaactgcggcaacccattggagaaacaggaatagatgagccggtgatagctttattgttcttagctgaaataatatcaggatacattcttttgcttgcacactctagagcaagctgcttaatatcatagttcggatcgtctttataaagattaacaccttcttcaacgaacataacaagcttagggaaaataggagttatcccatcacgaccgagacctttaatacgatttttcagaattgctttctgaatcattcgttcagtccagtcagttcccgtaccaaatgtaattgttacaaaaggagtctgtccgtttgaactaaagagagtatttacttcatattcataagcttggaatgcatcgtatacatctttttctgttttagattgggcataattcagtgcatcagcgatttgccatttttctgcatcctcaatatgttttgcataggtgcgtttaacataaggagaaagtactttatctacattcgcaaaagtcgttccgccgtattggtgagaagcaacttgcgcagtaatttgtgccataattgcagtagcaacgccaattgatttaggagtttcaatctgtgcattaccaagcttaaatccgttttcaagcattccttttaaatctactaaacaacaattagtaaatggaagagcaggggaataatcaatatcatggaaatgaataattccgctttcatgcgctttcataataaaagacgggaccatatttttggcaatgtgtttagacacaataccagccataaggtcccgttgagttggaaaaacacgagaatctttattagcattctcgtttaaaaggtctttattagttttatgaatcaatccttcaatttctttttcaattgtcattttaaactctttctaagctgcttcttaaatgaagctattaactgtgttttggtgtcagattcattatattcaaatcctctttgaagcatctcggccatcatttcctcttttcctaaacgagaaaattcctttgatttatctccaacaaagttagggtgaatattattttgggtgtaatcggattttaaataagtaagtaaattttctaaccattcaagataatcaacaccttgtccctttaagccagaacgattaaatttatgcttcatttgaccttctgcggcattgcatagattacaaagcaatccacgtacctttcctgcttttggtccatttaattcatggtcatgatcaagatgattagcttgaacatcaggatttagttctcgttggcaaattaagcatttaccgttttgtgcattataaaatttttgtttttcttctttgtataatttgccagtcaataacataataaaacccttaccttaaatagataagggtatttattatttttaagtattgtaaaacattcgatgcaatcgtttatactgtcgaatcatctttttagtaggacgagaataggttcctacgcaagtggtcatatgagggtccgtagaatgtcctttaataaaaagtttccaaaccttaccgccatttaacttttcagtataaaccaattcggttttcattaaaatgccttgtcagaaaaagaattttgagttttttcaagtattataaaacatttgatgcaatcgcttatattgccgaatcatttggtcagaaaaagaattttgtgtttcaagccattcaatatattctgccgcagcttgcatcaggttaccttcataatcatcaatatcttttttcaatgccactttagctaatgcatatgaaatacgttcaccttgaaaagcggctttaggcttctgaacatcttggctagttctctctacaacttcttcaatttcgccattttcaacggattcagtattccacaagcaccaatacgtaattggcttatcatagatgttaataatctttccgtcggaaagttcaatttcaataattccagtatcaggctctatatcatcttcacattcttttgtaagttcacgaactttaaagacagtacctgcactaagttccggccagtaattacatagccctgtatcaacacgattaattctaaaccacttatctactgtaatcatgtcccatctccatatcaattaagtcatttatcgttggttcattatatactgtttcttcatcagtgtaaaccggttcttccggctctggctctacagtttcccatctagccgcccaccagggtttaaccccgaagcttattaagttcttcataatcaatccaggattctagtcctgatggcaaatcagattcaatttcccaaagaagctcttcaattttctgaagacgatttagttcttcagcaggaatagtaaccattgacggagttcttgatacgctaatatcgtaaatcatatttaccccagtttgaccatacaatcaccatatttccatttagaaatagacttttcaccgttagaataataaacttcaagtttagcacgattatttttaatttgaataacctttgctgtcatcaaagttccatacccataataaactgcaacttcatcacctacatataccgcgcttctgcggtaatcatgaatatagtcagttccttcgagcatcatttaaaatattctcgcagttggtcaaatccaccaatatgacttccatcaggagcaaatacctgaggcattgtcaagccgatttgagtatcacgacctagtttagtcagaagctcagcgattttctcatcatcaaaaacacctttttccggcataatgttgataaattcaaacggctgtttcttcacagtcaaaagacgttttgcattatcgcaatacacgcatttatgaatgttgctatcataaccatatactttaaacatattattccttaattcctagtacttgtttaaaagtctcgtcgtaatcaagactttggcccgtttgttctttatgtttgtatataatatcacttacttctgatagcatatttttatatgaacgagttaaagcagatttaagcacgctgtatctatcaggaaatttaccgtgttcattataataagctattgctaattcacggactgccttttcagcagcctccatatattctttacgcttggtcatttttaatccaaaatattattaggcattggttgaacactcacaagttctttaaagaactcagtagagtcaggcaatttaaccatttccggagcatgcttactgaatttatgtttacattgacggcatttatattcaagctctggtttacgccagttaatcaactgaacttgttcagtaccgcattcagggcaattaggaacgtttttagaagctctttcacgtcgttcaaccatagccataatagcatcccatgctggaggtttaaaatctaaatcgtcgcagccgtgaatctttccacgcatttccatatcatcttcctcaccagccataataattttaattaaactggaattacttgaagctgcaatgtcttctaataaacgctttttcatttcaatacctcaatagcattacgtaaaccatttgcttttgcattaagagcttttaacaatttggtgtgttctgcaatttgggcttcaacttcaatcaaacgggcattgagatattcacgttcttcactcagattatcaaccttttctactttaggctcttttacaactgtcttatatgtattagggttcttcagtttaattagaatgcgtgaactgtacagcattgaaccattatcttcggtttcgtcatacatttccactacgtccataatttttaacatcatgcggagtttataagacaacgaacgaatagttttgttgtgcttattaatttctttagctgtcatggtgccaagattacgtgagtaataataaggaacctggatattaattaatactgatgaaccacctggcttgtgtgttacttcatcagcaataacccagtccttaacatgaactgtatttgtacggtcatcgcccgcggtaaatagtttgcgagcatgcttaaaaagcatattcacttggtcattgaattgacaagcaaatttatcagcaaatttagtttcaggaatggtagaaaaccaatcagccaaatgagtctttttaacatcattaacaatagtaaattcaaccaaatcggttatagatgtctcagatttaatgaaactcggcttcataaagtttttaatgttctcatgagctacagtagaagataacatacgagaacgtttaaaccattcaagcaaattgcctaacgaatgagaataagcgttttgagtatctttacagatatgattttcctgaccaacatattgaaggaaatcacgaagaatattattgattactgctctgtgcccgatctgataattacggtgtttagtaataagactgtcaaaataatcaatataatgtttacgagttttcatattcttctcacttggttaatggtttatactccgagccatccttggctttaaattacttaattaactgtaaagcttgttcaagacgatccaggcgattaacagattcttcccaaatccttttagcctgctcatattctttctgcgctttattagaaatttctagaacttctttataagctttttctagtgcaataacttctggacgaatttctactggttcaggcgaatcgtcaagacattccattagttcctcaagggtagtttcttctttaggagtattcacaatttcatcacatttttgttggtaaatttctttatcagtcggtgagtacgcacactttacttcacggagactaactacaattttatatccttcccaaccgcatatattcttaaaaggataagtatgaatattttctactgtttccatacaaagtaatgcggtctctaactgacgagttatatcgctagcaattgagaaaaatttattaatgttcttttgattagcttctggtgtaaaaaattcataattcacaaaaatagctgctttatttttatcaagctcatattcttttatgataatcatatcagaagcccaaggatggatttgacgataatcaccatagcataatttagaagctgattttagaatttgcttcttgaaaagtctaaaattactaatccaacgacgagtaaaaatattctcagggtcttctttattattaagatgataagaattaacatcaccgaaccaactgtatcctactacatctttagttcgtttaatttctttcccaaatttaccaagaatatcttgattaactaaatatgaaagaagacgagaacctttaaaagtttccttaatatcatctttatattcgcgactagaaattttatgaacttcatgaataaatttgcttgaagaaacaatacttgcatcaatattattgagccattgattgataatggaaataacactattctgactaaacacaggtttaactttatcatcaataacgctattgaatgatttgatatattcgttacgagtcatattaatctcctcagtagaaagtaagaacattataccacatccttgtggcaaagtaaactagtttagtgcatttagtgcgttgttcagtttagaacgttgcttcgtaagatttttgactttttcttgagctttttctagcatcttttcagcttctaacacttcattagttgctttaacgagttcatcatctactgccttgatagacttctcaatcgcatccgcgtgccatttttcaacaggtttaagactcggattttcaacaggaagaaaattcactttattgaatttccatgtatctttattacctgaactatacatccaaaatttaggatcgtttgatgagtaattggataaatttaagatatcttgcacttcctgctttttctcttgcgggacttcgtcctttctcaaaaaatcgtatttaaatgaaacgatcatatcaagttcatacgttgttgtatgttcccaatttcgctcaaaatgaggtaaaatcttagactgaaccgcggcaactacatccatatacttaaatgcttctgtcaactgtgatttaaggcattcacaaattgaaagagaattttttgtattaggtttaaagctaattcgtgcagttctgttattttcttttaatggtcttacttccatctgaagagtataaccatcaaatttcagattctttaagttaatatcagaaccttttaatcgactagccgtcgacaaaatttgctttaattgtttacggaatagagcaataaatctccactcaatacgataatgatttggattaaaaaatccagatgataaatcaaccttactctgaccaacgccttgaacaaatagaggatttttataatcaatagttttacagaaatcggtgagctgctcacgagccgtcatttgtgtaatataccccgctttactaaaatgacgtaaccattcactgctattcatatatttaaagtgaatatcacgattaactttatcagggtctaaattattttggcacaaaaatgtcataacatcacgagtatagctggcattacgaaccatatcttcaatttgagaacgagttttcatggtgttccttaagatttaagtaaatcgacaattttaattaacttttcacgctcagatttagctttactactcagtccagatagtctgaaaatttcatcatcatattgttgaatagaaatattcagctcttcaatctgtttattaaaataatcaatttgttcagagtgtttttcgttactacgaactggtacaggtttcgtaggcaatttagttgaactggattcatccgggcgataaattaaaatacaacttgaaccaatagggcattttgcaccagatgaatattctaatgttccagcttcttttaaaacttcaaaagctaaacagagatgatgccccatattaacataatctgtagagcgagctctgatgtaataatcatcgccacgaatactaaatttaaagcatttaaggtcttctgtattattggtcttaaaaatcatttgtttatctagacctttagctaatcgagcgcctaatgctaataatcgtctttgattttcccacaaatccgcaatcatttgatcgaatgataattttggcattagtcgaccataaaggtcatatcctttattataattacgaaggatttcactcgcattaatacgagacaatgctccaattttattaagggctttcataatgcgattagataaactcattccagatccgtttgttcgctgcaaatgtttttctaatccaaatccaatatcaactttaaacttatctaaaatttctgcatgaacatctctgtcaataacattcaaatccaaagttgagttaaatctatgaaaaaatttatctggctctgcactgcgaaatacagtccattcattcatcatttttttattaactaaagatttaattactgcattgacattattaattactactgacatattttcctcactcaatttcaattttactaaatatacagaataagatggaacagactatataagcaccacacacagattgaactaataccattccaaagaaccaaacaatattatcaaacaatgtctgttttacgtcgaaaggacgtaaacttacagtaatattatcacctttttctattgaagaatacatctctggggaaatatattcactaaatctataaccatctttgagttcatatacggcaataaacgataaactagacccttttccttgtgttcctgtaatggtattaactacagtaacatcataatctttataatgcatataatcattaattgcgtaataaccatatgcaattactacacataaacaacatatcaataaattcaatcttttaattatcaactgtttcataataatctcaattaaaagggcttagaaccattataccatccttggtataaagcggttatgcgagtaccgtctttaaccgttcttcaaacttccgaagagtattttggcgttcagctctttgctttttgtaagtttcaatacgctctgaaatgagagtgtatcgttcatttactgattctttcataaaatcaggaatttcacgagaagctttaatctcgtcaaatttatcaataacagcttgctcttcagcaattaagttatcatacattaaaatatctttcttgataaactcaatatcttcttgagttacacgagataatttagatgctttatcctttttgtactgttcgttagtatcacgagaccagtgtaatgtacgatttttattcgtatttttgtaaatttctacaataccgatctcatcgataataacgatccaattccaacgggatttgtaaatttgtcctccatcaacagtgatttcacctccgattgagatgtcattaaagaacttgctttgcgcttcagatttaaatttaccatcgttgtaatttactaagttgaaaatatctttagcgttcattttctgttcctccgtagttgatagttgtatagtaccacggaggaacagtcttgtaaaccactaaaagaaacttctttcacaattttttccactgaaccatgcgcttaccgctttcttagtctcaggagcagtgttatccataaaccattcaaaggcagcctttttatgattctggagggcttctcgggctttaatctgctcacggtctattaacactaacatatgagcctttcttgtcaccatgggcttcttatgattttttgaatactcccagtcatttgtccatcgcattgtcgttgcgaacttaaatactgcttctttaattttagtttcgtaaatttcacgagcctttgagtataacatcattacctccattcaccagtttaattctagtcatctttttaatggcagtccatataatctatttctgaactgcctttttgtcatagaagtcctcttatgaattatttcagaagagtaacctcagcaatttcttcccaaccgtttttgtcggtcataataaagtcagcaagataaagagcagtacgcagtgaaacattgcgtaaacgattaacattaactttcatccatgataatgctttataagtttcttcatcagaaagaccgcgcttttgcatcatgtcagttgaaagaataacatcttcaaccctgaccataatttcttcattagtgtgaacacccaaatccaaataaaccgagcgggacactaatgcttgtaaatgtggagcaagtttagtaccacggtctaattcgcggtcaatgtcaacgtttgtgataaaaacaatcgttcctttaaattcaaactcacgctcaatgcctttttcttctaagtaagaagacgcagtgctccagcagactttacgggtctctccggtgtccagagcggcttttagaagattaagaatgtccatatcagagaaaacatccacatcatcaatcaaaaggacagaattctcttcacgattattccaaagctgctcataaagaccaataccagagattttaccattaatgcttttatattcaatgtatccaatatcatttgctttatttaaagctttatctaaagaatacgttttaccaatacctgctgcgccagagataattaatgaacgaatatttccgttaataataccattcgtcatcattcccataacattaaatcttttattaatgcgggttttcatatcttcatatgattctttaacttcttcaacttttacaccatcatatgaaatatctgatttgtaaacccaaacaccgcgacgtttaccgtcaatttcaacaaaaactttaccatctccttgtgcatctaccggagcattatctgggaaccattcgcctaagagctcaaaagttccagagatttctttaccgaagtagatacccttattgatagttacagttttcattttattctccaatctcacatttgttttgatagggtaatagtatcacactactacccttctgtaaacaatttattttaacgttcgccaaatttttactgcttcacggcgagatacttctacagctccaagttctacagctttttggcgtcggcgagcgtgtaagtcataatgtttaatgcgtttatcttgaaaccaagaacgtttcattcctattgcttctgccatttcatgaagctcttcaatatctccatcagtgaacatatgacaatttttagttggatgaccgcgaagtttccatccatgattcattaaaacatctacgtaaactgtcattgattcttctccaaataagtttcgataattttctgagcgagataaactgcattatcttcagttgcatcttctaagaaactttcaaaacactctgaaatttcttctgtgtcaatcaacttttttacttcaattggtgtaattttcattttgtttttccgtttaagtgtttgttttgatagttgtatagtaccataaagctttatgcttgtaaacaattttgtgaaaaatttttgaaataaaaagggagcccgaaggctccctatcatttataataacttcggtggttttcaagataaaccctctcaaggaagtcatcccaaaaacccatgtctactttttgctgcataccgttcttagaagcttcagtagatgctgcttctacttgatcgaccacatcttccaaaaactcttgaaccgttttaaatggatgtttacccaacttcacgtcgagaataaatggagcatcttggagtggataaaccaagtcaccagttttgtaaatttccaatagttggagtccaccacggcaagcatgactcagagctttccagtcaataccttcattggcttcggccttacgagcacgttcacagtattcagcatctaatttgttcagtgactgcttaagctcaataagagaaagcgttgtctgatatttacgacccaacactgtgtagaacgtctgtgggcctgttttctcatgattatggaacacccattcacagaattcgttttctggaagacgatgcttaatatcttcaactttagtacgacgctgcttaatagaaccatcttcttggtaatcaacccactgctcagggatttgattaactactttcaatacatcacgtaatgcagccaaacgagaacccttaacgccgtatttagaagcttgcttacggacatatcctaaataggatttcatgttagtcgtataaaaacgagaacggttgtcttgaataaacttccacacatcaggcaaatcagatttaaccactagttcaggtggagtgtgaagcatatctaacgctacagtttcaccatctgctgctaatttaaagaaatatttaagactgtatagttcatggtcaatatcatctttagtgtttttagatgatgtgttgttagtgtttttactcatgtgctctttgacatttccgataagaatatcgcgagcaggaggaacaaagatttctttaaaatctacatcagattctggggtagaagttccataaagatgactaccaaaatagcttttcattactgttttcatcattcagccttatattcaataacaggacatactttagctttacgagcttttaaaaattcaacgataaccgatttcttgggttgaataggaggtaaacctttatacgccctatcaatattttctacgtgtaaagcataatcctttttccatttataatctttatatttttcacgcaaatgtgcaggaataacaaatgaaccgataataagtaaaacaaccaaaagcgcaagtataaatgctgatggaagaagagtccataaactaccaaaaataagccatttctgtaggctttctgcacaaataattgttagacctgcgagtatagtacatccgaaaaaagaaacgaaaaatgtagggataacaatagaccaaaagtatgcacacagtgtcttaggtcgtttccattcgtcgttaaacagtttgaataatttatagtgccaagagttttcattaataatcataattataatcatcctttcattgaaggtgtaacagttgttaaatacttaatcatagcctcagcttctgattttgataatgaaatttctccattgttttgacgaatagaaataaaatccggatgacggtcaccaccagcttttaaaacacacatataagtatcagtttcatcttcaatatttgaaatgattgaagcagttccacatgaatgcggtttttgataaatcaatacagcttttcttccgccatttgactgttcataaacttttaatacatcaaacaaatcacttcttttatcaatagctaaaatgttattttcatcttcaacgttaaatccttcggatacttcataaagtgttacccataaatcgccaatatcaataacagcgttcacttttccatgactttcaagagcatgacaaattttcttgatttcgtcataactcattttaataatatcatctccttgaataagaaagatgtcatttttaaattcaacacgaattaaaccacttccacttgaaataaacatatttcctcactttgaaatcatagttggaatgacagaatcaagataattctttagcgcaatagcttcgtctttggtaaatgtgacaatatgtgctcgagaatcatcattttggcgaacaagtacgacatcgccatcttcataagaagtcttgacatccaaagtcgtagtatagtttgcagctactggattaataatgctagcaccgcgatctttagcccattgaagtttaaccttttcgggtgtttcgactgtttcagattccaagaattctttcaccttggcaacgaatgttgcccaattgttgatagaaagacacataaattcagtttcaatattaccgccgtaaaggccacgataaaaacgaacttggaggtcgcctgtaatattagttacaccggtaactcctgagggagcataagataaaatcgcagccagttccataggaagaatagtaatactatcgtcttcctgcgtcagaacgtatacattatcacgtttttcgataaccaggtcaccgaacaaatcagttgtttcaattacagctttcatattatttaccaattaaagtttcaatataagaatcaagatttactttagcttcttccataagaattttgtatttaatcttgttagcatgtccggagaaagctgattcatcaataattgttgatgtatgaacagctctactatacgtctcaattaattctcttaatttaaaagcctgctcacttgtcattacatactcctttgaaccatatcaataatgttattcaccagattataagtaaacattgggtaattatattgaatcatcacatacacaacaaacaaaactttcattctcttctccttggcagttgacaagattactataccataaccttgccaacttgtaaaccattaaatggcgttttcaataaaattctgaagctttgtgtgagcatcaaccatgattttcatttcttctttggcgaaagctgtacctctttcccgagaagaacattcatagtcagaaactgcattagcatattcttcaattagtttcattaaaaacatctgcttttcagttttcattattccacctaatcatttcaagatattgaactaacttagctttggatttatccaaatcctttttagctgcttctataccatcgtatgaatatccttcacaatgctcaactgctaattggtatgaatctatttcaatatcacgtgctaatttaatgattttttcaaactgttcacgtgttagcatacttaagctctcgtattatgatcaataatttcatcaagaaacatatctaacgcttctatagcattatccactttagtttcaaagtctttaatgcctttattcgaaatacccgatgaataccaagcaaagtcaatcagctcttcatctgctttacgaattgaagccactaattccttgattttatctgcttgctctatactaatcattattccaccacatatgacagagagaatattgcacacgccatgtgagttgcaacttcatcacacatattataacgtttcttaagaagttctacaagttcttcactagtaacttcatccatgtcgacgaaaaaatcaccattaatgatgacgtagatatttccttcttgattaagtgcttcaattttcatgatgttctcctctttatctaatagttgtatagtatcacggctcaaacgaaaagtaaaccggtaaaatgaaaaaagtctcccgaaggagactaatgctattcgagggaaagaagatatttactttggtaaaacattccagtaatatcatctatcgtgctttggatggctggaggcatttctttataaatgctgttagattggtctagtatgcgatcaatcattttaattgtgtcggtaggaagtttactggcatctggaattgaaggcgtgtattttctaccagaataccccaaatattgctcaccaaatttatcaatcaaatctggcaactcagagaaaataaaatcgtatgctttgtgtctagcataacttttagtttcaaaatgtgcagaatgaaaataagcttgtgcagccattaataaacctaagtattcatctgcctttgaaggttttccactttgtgaaaagtcgctgaatttcattcagtctccaatttaatgttcataattctagcgtatgattgtgccatctccgcgcctcgttctatacattcaaaatcagaagagcacgggtcatttttataggtcgttctcataaaactatagaactgttcagatgattctacgcttttattttcaaaaagcatataaacatgtctaataccagattccataaatttatcaaaatgaggatcgacattcgcttcaattggtggagataaagcaaatgacaatcctagcatggcaaaaagtgccgttgcttttaaggccataaaggcctcctatcatttttgtcctgtatttactttatgccgatgcacggccttaactttatcaaggtatttttcaaaatttcgcaatctagtatagtctgccggagattggttgagtgatacttctcgacgcaaagctgaaatgatatttccaacttccctacgaatttcatctaattgaagcacagtaagattgcgaagttgcttttcagttaattgtagcatatatacccctttagttagataaacctatttataacttttgcactaaccgagctttttagttaattcattccaatgttttctacacagagaaacataaatttcatcaccaatacagatttgattaccttctttaactggtgttccatcttccattaatcgagctgtcataatcgcttttttgccgcaatgacaaactgcttttagttcaataagtttatctgcaatcgctaaaagttctttagaaccttcaaacaattttccagcgaaatcagtccttaatccataagccataacaggaacattatatgtatcaacaattcgacttaattgatgcacctgttcagtttttaaaaactgagcttcatctacaaatacgcaatgaatatctttttgtgcttcggcccatttatagaactcgaaaatatccatatcatctgtaataatattcgcttcctgtttaattccaatgcgagaaacaacttcacagacagaatcgcgagtatcaatagcaggcttaagaactaatacactcattccacgttctttataattatgtgcagcagtcaaaagagaagcagattttccagcattcattgctgcataagtaaaaattaaactcgccatatcaccttcttaaagcgtattcacataagctattaattcattttctttcttatcaaaccgatcagcaaattcttcctgctgttcaggagatagcgggccgtattcatcataaaaggtgtttgcttctgtatgctcatctagaagttcatggataagctcaaacaatttatctttttgttctttactcagactcatatattaatttccaggagttttaaaataattcgcttttgcttaaatatttccatagttaaatgaccagtatctttttgaccgattccaatggcaaaacctttattaacagcgagttcaattaaattatcaagctcacgtaacacttcgtattgtaactcaaaactattcattttggtttaccttctttaacgaaatcaggataaggataaaatcctgaataaaatccttcacctttatgattgatgcatcctttattagaacaatagcaccaataatcgaaatcacaagccatttcatcattacataaagcaaaaacaaccggccacttacacttttcacaatgggcatttttaagaatactagtttggctcataaccatgtcaccttcaagcaatattcttctacatgctgtttacgacctttcttatcaataaaggtatattcaacgaatgttccaatgtagtctttatctacatcatgtggactattaattggacatttagtacggcaaatgcgttcccattgacgaataattactgctttgtttttaggatcaaacggatgcgggtaatgtactttcataatccaccactattaaatcaatatcaggagtaaacatgtcaattaatttagaaaccttatcccaatcgccgccagcgataccacaacctatgcgtggaatgtaaattactggtttgaacaaaagggtttctgcctgtagatttaattctatcatgcagtttactaaagcaccataatcaagattaggacctggttcgtattgcgtgtacaagttataacatatgccaaaaccattaggtttatgtttaaaaacaatagacatatcgcctaatttatcacgagaaccgtactcagtagtggttttatctatttctaaaattttgggataggctcttgctaattgacccgctacacctgaacccatagtatgaaaacaattgcacccgtgcgcaataatattaccttgaagaaatagggcgacaatatcgcccttgatatattttacaatcatctagtactcaatcctcgattataagaatctaccaaacggtcaaccattgaatgacaagcggctttatctttctcctccgcaactgaacattctaaagtattccactttttagcatatcgttttaacaatgtatcgtttttgtatctgcttgatttatctctttctccgtctttatatgcatatattaatttctgcgcaaattcagcttggcatgctttatttttcccgcaataatccgctgcagtacggtttacatactctctaatttcagtatatgatgtatctgctaacgcagaaaatgaaattaatcctatacataaaaccaaaattttagtcatttactatttccaaaagtttattatttttaaggtaattagccttttctaggacttcagaagcatatttagaacctgctttaacattccatcccgaattataagaggatattgcttttcttatatcacccttatgtatatttaaccaataagaaagttcaatgtacgcccaggaagctgaattggatcgtttattcaacattctttttatttcagcatcggtcatattataaccaagttccttaactctcgctcgcatagtaggcaaataattttggaacattccataagcgtgatgctttggtttagattttaaattaactccgccagagctttcttgccataaaatggcagccattatatgacctaatccgctcttgtggatatttttgtgtgttttatattttccatccttagaaaactgttccccgaattgatacgcgtaacgcatgttatcgagttggacattactgaaagtatgctcggagctatgtgccatcattgaaatggccaatagaccagcgagtagtgcttttctcatgcttacctcattgagttttaattactgctttagaagcctttcctggtaaacgacgactgttgataattgccatcctgcattggagtgacgggtctttgaacttctcattaggtttacaaactgtaaatccaagccaaagatttccatctgtgatttctaaacgtccaggacgatattcaaccccatcaataaaatcctcgtcaatgtcaggacgcggaggcatactcaggaattcattaacttctaaaacatggtcttttattttgtggaataattcaaaaacatatgtctcatcaatctcccgttgaattgcacgatcaagaagatgttgagaatattttagatgaaacgatgagactcctgctgcttttgatgcctcacgaatctcattgttaatttgacgaaactccgactcaaaatgacgacgaagcttatttcgacggataaaaacttctgtattgatagtcatgttgttctcctcttaactgatagaaaaattataccacagtcaagaggaaaagtaaacagttattctttaaatctaatcaatttattcatagactttgaaacttctgcacgaacctcatgtaagtttttaagctgttcaagacgctgctcatagtaagcaatttcatcttcttcgagacagtcctgtgaatcttctttaagataacgtgcatagtcctgaaaagctttacggactacttcctggaagtcatcaagactttgaattttcttaggagcgacagatacacgacgaggtgcagtataattactcataaccaaaccctgcacttaattgagccattagtatttttcctctggttggaacactgcacgacaagcccacatactggcttctttgagtttcgttttagcaatagttaactgatcgaggctttcagcataattcttcgcgagttcatagtcttcacagctatcaaatgcttcccaaaattcatcgtataaagcatcaaagataagtcctaaacgaacttcagcgtctttgatagcattcactttaccgattttctcttcagtatgcggcttataacctttaatgtcttcaatcatatttgacttcctcaccagtacataaatcatattcaactaaacgaataggttcatgaatgccatatccttgaacagaaatttctgtcgtaggataaattccatcaatatcacccatattccaggcttcattaaattgctgttcgcctgaattactaaaccactcggcgaaagcatttagcacatcttcagaaccttcaataattatctttgccattacaaactctcggtaaaggtacgagcgataacgtcgcgctgctgttccggagtcagagagttaaagcgaactgcataaccggatacacggatggtcagctgcggatatttttccggatgcttaactgcatcttccagagtttcacgacgcagaacgttaacgttcaggtgctgaccaccttcaattttaactgtaggctgttgctcaatttcaatttcacgggcatgcaaaccgtagaaaatttctgggtctacaaaagagtcctctttaaaggttttagagacaataattcgtgcttgaataccatcttcaaaataaatagtacctttgtgtgtgccttcaagaatttgatatgctttcatataaacctcaattagaaaataaatttatccaagattgttctttaattaaaaatggctcagaatcatatgccattaaactttgggtgattagtcctttaaaaggtccatcaataaattccatggtaaaatatggaattttattcattagccgtgcattaggagcagtgcacaaaactctgcatcctttgaatacgcctttttgtaatttgtattgcttgggataaaattcgctcaaaatgttattatttgccaaaatttcaaaatgattcaccaatttatttttaatagtttttggcgaaaaataaagatattcgaaaagctgtgtgtctgtcatcattgcattccaatcacaaaaaattgaggacgaactgtttcacctgtttcagcattatagcttcgacaacagtgttgtaccgttttaatatggatattgtaaatcttatccatatcaggagctttaataggttcgtcaattatgtacaagatacgagaaagcgataacccacggaatttatgaccttcattaccgataaaactacggacagaatcagtaaataaacggaatcgaatatcatcgctagaataacgagaaaattctttttcaatgttgccagcagaaattttagcgtaagctgaagtattagaaagaacaataactgttccgccatcatacagccaattagcagcaaagttagtcacagcaattgatttaccggattgacgtccaccatctatacgaagtgtgcagtactgtttgagcacatcttccattggtggaagataatcattcttacaaatttcttctactctagcatcagaatggtgtgtaaaagcattcatcagggatagataaggaccagttaaaaatgttctcattttattctctctaagtttgggccattccgtggcgcatgaattgtccatttctgtatttacccattaccgcacttgggctcgaccttatcacaggttagcgggaatccctcacagaatcatgaggtccaggttgttcccatattatttgaacgatttaacgtactgaatagaacccttactattcacaaaggcaattttaccatttttattatacatggtagcagtacgctgataaccataggtttgtttaccagattgataaccaactaatgcaaaattatcttcacccattttattctgtttagcgcgaatgcgttcatgaccatgtgccataagaaccttagcatcaccagttgcaatggatcgacgagttttttcatcttcaactgcattaacaaagtcgtcaaatgaatcaaatttagcatgagatttattatacaattttccatctactgcataattatatccctgtacatccatctcaacttctgtaccatcatccaatacagcagtaattttttgaccttttttaaatttcaaaagatcagtaaaagattcagcaataatttgagaattaatagctgcttcagtgataaattcttgatatgttttcatgggtttcctttaaatgtaaatatttttaccgtaatacttataccaatgtggtttcattaaaattttttcatcaagtcgttgttgactcaatttaatagctgatttgcatggattataatcatttttccattctattggaatatcgctgatgtcaggaacttcagtatcttttatactgaacccgcgttttaagcattccgttataatgtctaattgacgctttcgcaaaaattctaacttatcgtaaaagaacgtaacatgaccagaacctaaaataaactcggaagatattttaaaatctttaacgcgcttaccgtttgccacatgcttacgaactataccaaaaacacgcggcaattcacggtattctgcgattaaatgttgatcagcaagttcagatactaaagtcaaattaatacgagtcattttatccctccaagtaactgtgaatatactatcacaattctaggagaaagtaaataactttatagatttttatacgcgtcccaagtgccagttctaaacgtagcaatgactcgttttgcgcggttaggtgtttgattataccatctacttttagctaagttaactgctgcttcatcccagcgtttttgctgaagcatacgtaaagaattagtaaatcctgccacaccggtttctcccatttggaaaaccatattaatcaatgcacagcgacgaacagcatcaagagaatcataaactggttttaatttagcatttctcaaaattccacgaacagcagcatcaacatcctgattaaagagtttttcagcctcatcttttgtaattacaccattgcaattacgcccaatagctttatctaattcagatttagcaacattaagtgatggacttttagtaagcaaatgaccaatgccaatagtgtaatagccttctgtgtctttatagattttaagtctaagaccttcatctatacgtaacatttcaaatatattcataatacctcctaagtgtttatagaaggtatttataaaattaaaagaggttgttcattattcggtaaagtgaaggacccatcacatattgccactgagtacgaggaataagagcaaaagcatccatctctggaatcataacgccatctttattttcaaaataagactcgcaatggcaatttctgaacatctcatgctctactggaatcgtataataaaataactgtaagtctttattactagaatatttaaatatacctaggtcttctagaaggtctggattataattgctaaaaccggtctcttctaagcattctctttttgcagcttccagtgcattcaaatcagaactttctacacgcccctttggaatatcccagcgatgtgccatcattccaggcttacgagaaccagtaacccgacccataaataaatctttatcttctgtcataaagataataccagctgatagtgttttcattttaatttcctgcattcagtgataaagttatttaaattttgagtatatttcttttcatcaaaaatcttttgttgtctgcgtagccgccatggcatttcaatgaacgtgtaccatatcccagataatattgctgcagtaaaaatattaacaagtatggttaaaagaatccaatctcctattctgtccattggattttttataaaaaagtaaaatacgaatgatgtcacaggaagactaataatataccacagaatcataattttatctgtgaaccaatcagcgttcgttaacttagcgctaccattatgaatacacacgaatttatcatctgttataatagatggcttagctgcttgatatcccattctaaactccctaatcaacaaatttttcatatcttcggaacaaccattccagtcaactctatcaactgaaatgccatcatccccatcatctaaatcataccagcgagtttttaaaatcatttaattttcctacaatcactcacaaactcttccattgattctttttcaatataagacatatagctattatattcctttaattgtattttgtaatccttttttctttgccaatttattttaaaattatcataatgaaaatataacattgtaccaaagaatgaaaataatgaaatcgctatagtataatgaagttcactccaaacttctattatatctattataccgctgacgttactacggatgtttaaaataagacagtcaattaacaatccaaaaagactacccgcaagagatgcagccaacgctacagcaaaaattaaaaatgactcaggaagagaatatttgactttatttagttttggcttttgcatcgtgattccttaacaaatttcataatttcatcaaattcatgcgcagcaagtttaagctgatgttcctttttaatctttttacactgagctttccaatcacgtacacgtttacgatagtgtcttccttgataccaatatcctatccaatttataggtactaataaaagcggaactattaatggaagaattagcattaacacaagtatttcgccagaatcaatatcagtcataacatctaaaacacctccaataatcaatagaattacaaatgatatgagtataacaggacctattaacacatcagtagaaattatctgacgctttggttcatacttcacaggtttacttggaaggtatagtgatggttttgacatattctctacattccttaacaaatttttctagtaataaatcactttcaaaattgggattttctacaaatttatcaaaaagatcatcaacaatagttaagatattctttttactaagaatacgtttattttcatgcttcgtttcagaatcaactataagagtaaagaaatatttcttgccctgaaattttacagtagtatcaatataaaataaatttgacttttgtaaattacgtttaaaccatgcgtcacttaaactataaacaccgagataatcaaaatcgtcgtttaaataacaaaccgtccattcaggagaaatgaaatcagtaaattcaacatcaaaatcacacgtcaatgaatgaattgattcaatactgttaatgagtattccaggacgtattaaagactttttacctctagaaaatcttccggaaaggctttcatcagtttcatatgaagacccccaatagtaattacgtccttctgccatgcgtttaagagcatttagtaattggtctggaacatcaacctgtctttggaactcttcaaacattgaattgaaatcactttgcattttcattttcattcctatttactccaagtataaggggccgaagccccttatcattatttcagagaattaatgtattcctgaacatcggcagaggtagtttcaaccccagaaatattaccgttaaaggtttcaactcgagcaagggtatcttcaatatcaaccttagtcagtgctgcaatttcaactacatcatcagcagtactaattccaagggcatttgctgcacgagtttcacggatatattccaatttaaccgcaagttcttgacgagcatcatctaactcaactactttcttggcgatttcaattcgcatttcagcataaccgtcagccttagtagtcaactgctcagctgttcgacgatatagtaaaccgagtttagcatgcattgttacatcttggccttcggaaagaagtttacgaatttcacgctcttttgattcggcctgtcgattcttttcgataacaagttcacgaatacgtttttcttcgttaatagatttaacagaagcagtttttagatctttaattttatcaagtagttttgctgctgcagcagtatactgttcttcgacagatagatttttagccatagcagaaccaagtttagtgcgaataaactcaacaattttcttcagtgtgttcatagtatttccttaggttaattgagatttaaaatccgtaggagtataatactctatcgtcaaattataggctcataatatctcaatcatgagcctgcgtaaacttatttcatattattgaaatattcttctgcgatttcgtcgttatcatggtaaactttagaagacagtttaacataaccttctgctgtgaacatattaatcacaacttttacagtataccactgaccgtcttcattacccattactgcataggtttcaaacatcggatgatcaggaccgataactttaatatcattcactgtacgaccgaaatcttctgaaacgcatttcataaagaagttgaacagttcgccgtaattatccatttcattctccaagttgttttctgtatcagtagttgatagttgtatagtaccatggaagaacagagatgtaaacagttttgtgaaaaaatttttagggaattctagggcagggatgggcaattaaaggataggataatatattataaagggtataaactaaatgatgcctagagaggtccagaaaggcctagataccaaaaagccctatcatttagatagggatttaaaattatttacctagtttacttattatagcttctgcagcagcttttagcttagatgcagtgttaatacgatttttaatttcagtatacgcatcgccaagaacatcaaggctatcagaataaacacttacactattgcgttcgctatttgaaatagaacctttagttttgcggtcaaaatcggtgtacacgtcttgaagatcgcgggctgccttctttgcatcatccaatgcatcaagagctttattcaaagcattaacgtattttttagtgtcgaacatattcttagaaattttaacaggtgcgcgttcaggagtagctaacacagatttaggaacctgagcgccagatgccaatttcttagaaattttgaaaaatgctttattgaatttattttcttgactcattgtaaaagaactattatcgatgttgtacatttcaatagctttagctttccacttaagaaaatcgccgcggtcttttgggtccaattggaagaatactttagtaagatctgcttcagatggtaattttgctgcttcggttaaaaattcggcataggttttcatttaaaatccttgaaataatttatcggttggttattaattatttattactttgttactatccgtaacagcgttatccgagtgattcaaactaaaaagccccaacctttcggtcggggctaagaatgtcatttgatttgtttagcagaccaaatgcggtctttaataattttttggatgtcttcaacatactcaagagagtgagcatgtgggttatctttgaaactataagcacgagctagtttttggccttcagttttgattactaaaagctctttaaggatagcttcatatttggagataattcctttaacaatatttttctcttgtgcgactttaggatctgctttaggagcaggtttacccgaagcctttgcaaaagcagcgccagtagcaactaaacttttccaggccatactaactgcatttcccgtaaatccttccgctttcatgtcgcgtgcgaactggaatcgtgattcatcagaagcatctttgtaagaatatttacccgctgcaatggctgcttttgcgacagcttgaatttcggtgctagatgcttcatttaacaccgcttcatttaaaaattgagtatatgatttcatcttatttcctgttttaattcggggttttaatatacttatttatactaaaaagccccaacctttcggtcggggctaagccttgcggcaaccttgtcggggttccacctgctaaggcaagtgtttgtacgaaacgccgggattcgaacccggttattaagcagttgacgctactcaatatttttaaaaggccatatccgaacgttccgtcaaaaacgctactcggcttacggcaaagatatttcctcgaatcgataattctgtgcgccgtttcagctgtgatagtaaagagccagaacacagtaaaactgtgggaggaaactatactccagggaacatcagtccgacgacttaccggtagcgacccggcttcttgtttggtcgagacagaaggattctaaccttcaacctacggattagaagtccgttgctctatacaattgagctatgccccgtaatttaaaatttcatttttcgacctttaaaccatccttctggaattgggtcagttttcttaatacgcttagaaactttttcatctaatgaatgaatccacatcataccgaattgggaattcttttcaccttgttggtgtttatttctggcgtgagattctttcattttattaatagtttcaggagtatgggtcttacccaagaaagatttagtatttaaaaatttctctctatacttaggattatcccaaagctgtttaaacctttctgaacccattttacgatatttttctttaaggtctgggtcgttctcaaatctggttttaaaagcagcagccccttttaaggaagcttctttctttttatccaaatattctttagtgtttaaatggtcccaaccaccttcaccacctaatttcaaattataaacatcagggcgctttaaaaactcttcagtcacaatattcttttctgactcaaacatagaggttttatcgtcaaagagctctaatatttctttagagaaattttctataccatacttgtcttgggatctttttaataatttaccagaacccatatatccatcatctaaattttcggtagaatgagcgcctatatagattttattattaattttatttgttattttataagtgtaatggaacataaatatctcctatttctaagagtatttatgatcccaaaatatggccctgggtggaattgaaccaccatctggcgattatgagtcgcttgcttgaaccttccagctacagggccttgatatgctgattgacggaatcgaaccgccgacatcctcattacaagtgaggtgctctacctactgagctaaatcagcgaaattacggaggcgataggatttgaacctatgagtcgccggagcgactgccggttttcaagaccggtgcattcaaccactctgccacgcctccagtctccgtggcaggatttgaacctacgacattctgctcccaaagcagacgctctaccaaactgagctacacggagtaaattaaatttgagcggataatgagaatcgaactcacatcatcagattggaagtctgaggtaataccattatacgatatccgcaaactttggtacgagaagtgggactcgaacccacaaggaaatcattccgcagcattttaagtgctgtgcctttaccaatttgaccattctcgcgctgggaataaaggactcgaacctttgcatcctggaatcaaaatccagtgccttaccaacttggctaattcccaattattaacaaaggctctcaagcaagaacccttgatgatagagggtattaatcagtgcgatatgagttaataataacaaataattcttaaagcatatttaccatttatgataatacatgtttacgatgcattcaagacccaaaggattcttgaaaatatcatattcaagaggacctttttctgtttcaataaagaaatcaaaatttactgtattaaatttacggtcttcctttactaatttaacttgagaagatgaacggtcaatgtaaaccttttcaacttcaaaacatgttaaaatgccataatcatcaatcaaggctttagctgcttcttgatcatatttatatccattttcaatggatgatactttagcataaagaatcattatcaaccttcatcaacaacagtatgcgtattggcatttacgatttgccaccaatcaaagcgattagaaccatacatcggtttgttttcattttctttgataatgtcacggagttcatcttcagagaatgctttagcaattaaatcggtatacccaccacggggataataattatcacctgcaaacaaaaggaaatttaccttcccggaagcaacatatgcttccttaggatacttgtttcctgcgtggtcaaccacttcaatataacggtaaggaatatcggttctttcaacccattgccatgccgccgcaggggaatcgaaagcatctacacctaaacgattatcttcatctttagacggattattttcgtaatccgcatatacataatattcaacgttcattattcacctttagaaattttatccataacaatagcaattaaaccaattaaaaatgctactacaagtgaaaacacattttctgctgtagtcaataatccacatataaatccaacaaacattgaaaaactaaaagcggaagcagaaattgcaatagcaacatttcgaattaattcacaacgtttcattttattctcctcagtagtagatagggtaatagtatcactaccctatctaaaagtaaacttattttttacgaaaaattgatttattttctgctgcccatttttcaataactgcagcaggaccagtaacaacaattttatcaccgtaatcttctgcggcgagttgaccgaaattatctaatgcatcacgaagaactccatgaggcatttcacccattttatctttcttgccagtgtaaataaactcaacttttacatcagcagtttcagcaataaattcttggtaagttttcattttgatttccatttggttttgttttgatagggtaatagtatcacaactaaaaccctatgtaaacaactttgtgaaattattttaaatcttctaatcgtttcttcatcttagaaccatttttagcaatttctcctgcatcggagcataatgctaaaagtgctttaactttagtttggtctcctttaaaagatgaaggatcgactgcagcagcaagttctttaatacgagagaaaagacgctcagcttcagctaaagccattccaagctttacttccataccgtgagaagattcagtgatagtagtttttgtagcaaactctttgaaagttttcattttattttcctaattaattttgatgaggtaatagtatcactacctcatcagcgtgtaaacaactttatgaagttattttaaatcatctgtccaatcgagtttaagaggctctttatattcacgatctaatacgaccggaatttgtacatcaccgctaaatgataagggtccaacattataagacagtgttatatgcggtgtgtaatcgtcaaaatcatgtgtagcacctagcgcccgcgcatacatgtgtcgacagcgcagatattcagaatctagtacaagtacaagagtagatccatcttgtgttttccatacttctaaatgtccagaagaagctacttcaaaacttccgcttgatggaacatacggaacatttactcttgaataacatatagtcgaatgaattttttctctaggaactggattaggaacacgtaaagagcgctgaagttcttccagcgcatcaagtgttaattctgaaaacttagctgctacataaagacccgttgaaaagtctttaaattccattattcttcatcttttgcttcatctgcagattcagcagtaagattcttgacagcttcaacgatttcttcaaccttaatagtatctccagtgatacctactgcacgagcaatttcagccaaagttccttgcagaattttggattcttccatcagacgagccgcttggtcctgcgtatcaagaatacgagatttcagagttacgatttcagcagacagtttttgttcaatagtttgttcagacattatagtacctttagtgtatttttaattttagaaaaaagttcttcaagagaaccatcgtttgtaattactaaatcgccatcacgaattggcaatccagcttctgtaatatgtgtatcattggatttttgaccaggacgaactacatgaattaccgtagcacccatcgccctagccgcatccatttcatgatcttgacgagtatcaggaacgatataataatcataacctgagttaaatttatcaagataatctaaagcaaataattttacccagtacatgcggtcgaagttattaacaatcaaatccgtacctagggcttgcatcagacgacggactgaccattgatcttcaatattatttataacgtcaataatcttgttaaatgctacggaattaactgattcttgtccttcgtcatcaaaaacaaacacacctttaattgggcttttaccattaagatagcaaaatgcttgttccataattgtgattacttctaatttagtcagatttaaattagtctcacgatcatagtcaattccttcaaactctttacgagttaagcaaggatagtcggtatttgctgcaaatactccccatgcataagccaatgcatccttaataggaccagcaagttggtatttaactgcagaataattgctcatgataaaatcagcagtagtatcttttccactacgctttacaccgcttaaaaagattagtttcatatgtttctcctcaaatttagttaagattataacacatgaaactgaagcattaaacttccgctataatttttccatctttttctacttgaaaatacgtataaggaatcgttgctgtacatactaaagccgggtctgaatcttctgtgtagctaaattctacttcagataggtcagaaacccaaggcttataaaaatttattgacatcacgatttcagttttgctattatctaaaatgtaaagcgtaatgtattcaggacctgttttttgggcagtattttcacctgtaagatagttgctagttcctagcatccattcatacattcctatccacgacttaagttcttcatcaactataaatctcacaatgagtggatcatactcaaatgtaacacctggacgttgtgctcggcccagtccaaacggcccagtcacggtatcagtaacaggtattctaattcctggaataggaactgactgagcatttaaagtaaaagcagatgtagtattactatgtggtattgatactacaaagttagttgtatttgcttggttaaaaatttgttgcagagcttgcgacatatattcctcataatgctttataactgttggtggtataatgggtctaagtcccttccattcaattccatttagaacaaacaatagaaaagaatggaagataatagaattagatatttgaccagactttgtttgcagagaaacgttttccttttgaaacgaactgctgaagtggcatcaacacaacgttcgcccagtctttcggggcgatttcaacaaggctacccataatattaccgggtatatatgccttaatcatttggtctgcacccctaaatcctttcacttgactccaatcaatttttaatttcgttttattagtaatagtaggtgtatttgaatattgctttaaaagctcttctaggaattgctggcgagctttaggtggaatatagtgcaagttcaatccgtacattaaattatgcttacctaaaccaaggtaaattatcaaaggaaatttatcccagtaaggaagagtttccttgtgtttagcatcataagcaaaagcatatattcgtcccggctgcgggcgaacaactttatgtccttttacttgcttaatagtttcagcaaaccactttctggttttattattaattgctgcgccttcattacgaattttatcgcgcaatgtttgtctgaatgaatttatcataagcagttgtctttcttgcttattgagtttattcattggttttgattcaagcttttgaatcttttcagccgttttaattcctgaagcatattttgacattgctgaagtaaacgtagagtatttgattcctctttcttcagcaaattgctttcctgtcattccttttgctttggcctttttatattcaagacctatctgaatccatttcttttcgtttaatgattgcttaacctttggaacttggggagtgctttcattaattatttgaaaaatagccattatgcccccttaaagccaagagctcgtaatccatcttctgttagaattctaaattttattccacgcttttcagctaaagcttgcgctgctttccatttgtcggtattaacggaatatgtataaatttcattcataaatcttttcttcgctgcggttgttagatgtgctggtttaactggtggttgtgtttcttttttaggctttatttcaataaaaaattcttgtccagaagaatctttcatccaaatatccatgaagtatctacgttttttcccttcggcattacaaaaataaggaattactgctgtttcactaccccatgcaataatttctggatttttatctaaccattcaaaaaagaatttttcccaatttgatctatacgtaatttttttagggtcacctctatattttgatatatttttaggaacccattttccagaatatgccattggattctccttataaatagataatatatttataaacaggagggcccatgctctttacattttttgatccgattgaatatgcggccaaaacggtgaataaaaacgcgccgactattcctatgacagatatttttagaaactataaagactattttaaacgcgctcttgcgggataccgcttacgtacttattatatcaaaggttcaccacgcccggaagaattagcaaatactatatatggaaatccacagttgtattgggttttattgatgtgtaatgataattatgacccgtattatggatggattacttcacaagaagcagcttatcaagcatctatacaaaaatacaaaaatgtaggtggagaccaaatagtatatcatgtgaatgagaacggtgaaaaattttataatttaatatcatacgatgataatccatatgtttggtatgataaaggtgataaagctagaaaatatcctcaatatgaaggagcacttgctgctgttaatacgtatgaagatgctgttcttgaaaatgaaaaacttcgtcaaataaaaataatagcaaaatcagacattaattcatttatgaacgaccttatacgtataatggagaaatcttatggaaatgataagtaataaccttaattggtttgttggtgttgttgaagatagaatggacccattaaaattaggtcgtgttcgtgttcgtgtggttggtctgcatccacctcaaagagcacaaggcgatgtaatgggtattccaactgaaaaattaccatggatgtcagttattcaacctataacttctgcagcaatgtctggaattggaggttctgttactggaccggtagaaggaactagagtttatggtcattttttagacaaatggaaaactaacggaattgtccttggcacgtatggtggaatagttcgcgaaaaaccgaatagacttgaaggattttctgacccaactgggcaatatcctagacgtttaggaaatgatactaatgtattaaaccaaggcggagaagtaggatatgattcgtcttctaacattatccaagatagtaacttagacactgcaataaatcccgatgatagaccactatcagagattccaaccgatgataatccaaatatgtcaatggctgacatgcttcgccgtgatgaaggattaagactaaaagtttattgggatactgaaggatatccgacaattggtattggtcatcttatcatgaagcagccagttcgtgatatggctcaaattaataaagttttatcaaaacaagttggtcgtgaaattactggaaacccaggttctattacgatggaagaggcgacgactttatttgaacgtgatttggctgatatgcaacgggacattaaatcacattctaaagtaggaccagtctggcaagctgtcaaccgttctcgtcaaatggcgttagaaaatatggcatttcaaatgggtgttggcggtgtagctaaatttaacacaatgttaactgctatgttagccggagattgggaaaaagcatataaagccggtcgtgattcattgtggtatcaacaaacaaaaggccgtgcatcccgtgttaccatgattattcttaccggaaatttggaatcatacggtattgaagttaaaacaccagctaggtctctgtcggcaatggctgctactgtggcgaagtcttctgatccagctgaccctcctattccaaatgactcaagaattttattcaaagaaccagtttcttcatataaaggtgaatatccttatgtgcatacaatggaaactgaaagtggacatattcaggaatttgatgatacccctgggcaagaacgatacagattagttcatccaactggaacttatgaagaagtatcaccgtcaggaagaagaacaagaaaaactgttgataatttgtatgatataacaaatgctgatggtaattttttggtagccggcgataaaaagactaacgtcggtggatcagaaatttattacaacatggataatcgtcttcaccaaatagatggaagcaatacgatatttgtacgtggcgatgaaactaagacggttgaaggtaatggaactatcctagttaaaggtaatgttactattgtagttgaaggtaatgctgacattacagttaaaggagatgctaccactttagttgaaggaaatcagactaatacagtaaatggaaatctttcttggaaagttgctgggacagttgattgggacgttggtggtgattggacagaaaaaatggcatctatgagttctatttcatctggtcaatacacaattgatggatcgaggattgacattggctaatatacttccaatgagcgctgatttaggagaatccatggaaggttcttctatcgacgtcacctttaccgctcaattagaaacaggtgaaacgttagtatctataaatataactagttacgaagaaactcctggggttttagtagaagaaaatcgcttatacggaacatatgaatctgtatttggttttggaaatgacgcgttgaaatatcgtttaggcgatgaatttaaaactgctgcttcatgggaagaacttccaactgattctgatactcagttgtatttgtggaaagctccccaaaacctccagaagacattcacttacgaagtaacattaatatatgactatcaagaacaaagtgaatctggaggttctggcagtaattctaggtcatcttctgatactactgaaccgacagatcctcctgctccagtaagaaaaactctcgttaaaaattatactaaaactatagttggaaattggagtcgttgggctaataaattaagaagctatgtgtatgagaggtcatagatgtcaggattaagttatgataaatgtgttactgctggtcatgaagcatggcctccaacagttgtgaatgctacacaaagtaaagtattcactggaggaattgctgttctcgtagcaggtgatccaattacagaacatacagaaattaaaaagccatatgaaacacatggcggagtgacacaacccagaacttctaaggtatatgtcactggaaagaaagctgttcaaatggctgatccaatatcatgcggtgatactgtggctcaggcatcatctaaagtattcattaaataggatttaaaatggcaaatacccctgtaaattatcaattaacaagaacagcaaatgctattcccgagatattcgtcgggggtacgtttgctgaaataaaacaaaacctcattgaatggcttaatggccaaaatgaatttttggattatgattttgaaggctcaagattaaacgttctgtgtgaccttttagcttataatacattgtacattcaacagtttggtaatgctgctgtgtatgaaagctttatgcgtactgctaacttacgaagttcagttgttcaagctgcacaagataacggatatttacctacttcaaaatccgctgcgcagaccgaaattatgttaacatgcaccgacgcattgaataggaattacattactattcctcgcggaactcgctttttagcatatgcaaaagatacttctgttaatccatataacttcgtttctaccgaagacgttattgctattcgtgataaaaataaccaatattttccgcgtttaaaattggcccagggacgtatagtaagaactgaaatcatttatgataaattaacacctattatcatttatgataaaaatattgatagaaaccaggttaaattatacgttgatggagcagaatggattaactggacaagaaagtcaatggttcatgctggttctacatcgacaatttactacatgcgtgaaactattgatggaaatactgaattctattttggtgaaggtgaaatttctgttaatgcttctgaaggagctttgaccgctaattatatcggaggtcttaaacctactcagaactctacgattgttattgagtacatcagtactaatggtgctgacgcgaacggagcagtcggattttcatacgcagatacattaacaaatataactgtcatcaatattaatgaaaatccaaacgatgacccagattttgttggggcagatggcggcggtgatccagaagatattgagcgtatccgcgaattgggtactattaaacgcgaaacccagcaacgctgcgtaactgcgactgactatgatacattcgtttcagagagatttggttctattattcaagcagttcagactttcactgattctactaaacctggttatgcatttattgctgctaaacctaaatcaggtctgtatttaactactgtacagcgtgaagatattaaaaattatctcaaagactataatttagctcctattacgccatcaattatttctcctaattatctttttattaagactaatttaaaagtcacatatgctttaaataagctgcaagaatccgaacagtggctcgaaggtcaaataattgataaaattgatcgttattataccgaagacgtagaaatttttaattcatctttcgctaaatctaagatgttgacatatgtagatgatgcagatcattctatcattggctcatcagcgacaattcaaattgttcgtgaagtacaaaacttctataaaacgcctgaagcaggtattaaatacaataatcaaataaaagatcgttctatggaatctaatacgttttcatttaattctggacgaaaggttgtaaatcctgatactggtttagaagaagatgtattatatgacgttcgcatagtatcaacagaccgagattctaaaggaattggtaaagttattattggtccatttgcttctggcgatgttacagaaaatgaaaacattcagccatatacaggcaacgattttaacaaattagcaaattatgatggacgcgacaaatactatgttatcggtgaaataaattatccagctgatgtgatttattggaatatcgctaaaattaatttaacatctaaaaaatttgaagttcagaccatcgaattatattctgacccaaccgatgatgttatctttactcgcgacggttcactgattgtatttgaaaatgacttacgtccacaatacttaactatcgatttggagcctatatcacaatgacagtaaaagcaccttcagtcactagtctcagaatttccaagttatccgcaaatcaggtgcaagtacgctgggatgacgttggtgctaatttctactattttgtagaaatcgctgagacaaaaacgaactcgggggaaaatctcccgagtaatcaatacagatggattaacttaggatatactgcaaataacagcttcttttttgatgatgctgacccattgacatcatacattatcagagtagctacagctgcgcaagattttgagcagtctgattggatttataccgaagagtttgaaacttttgctacaaatgcttatacatttcaaaacatgattgaaatgcaattagccaataaattcattcaggaaaaatttactcttaataattctgattatgttaattttaacaatgacactataatggctgcattgatgaatgaatcatttcaattcagcccatcgtatgttgatgtttcatcaataagtaattttattattggtgaaaatgagtatcatgaaatacaaggttctattcagcaagtatgtaaggatattaaccgagtttatttgatggaatcagaaggaattctatatctttttgagcgctatcaacctgtagttaaagtatccaatgataaaggacaaacctggaaagccgtaaagctcttcaatgaccgtgtaggatatcctttatctaagacagtatattaccaatctgcgaacacaacatacgttctaggatacgacaagattttctatggccgtaaatcgactgacgttagatggtcagcagatgatgtcagattcagttcgcaggatataacatttgctaaacttggcgaccagttacatttaggatttgatgtagaaatctttggtacttatgcgactttaccagcgaatgtatatcgtatagctgaagccattacttgtacggatgattatatctatgttgttgccagagataaagttagatatataaaaacgagcaatgcacctatagattctgatccattatctccaacatattcggaaaggctatttgaacctgatacaatgactataactggaaatcctaaagcagtatgctataaaatggattctattggtgataaagtttttgctcttattatcggtgaagttgaaacattaaatgctaatcctagaacgtcaaaaataattgattctactgataaaggaatatatgttttaaatcatgacacaaaaacgtggaaaagagtttttggcaacactgaagaagaaagaagacgtattcaacctgggtatgcgaatatgtcaactgatggtaaattagtttctctatcttcgagtaattttaaatttttaaatgataacgttgttaatgaccctgaaactgtagcaaaatatcagttaatcggtgccgttaaatatgaatttcctcgtgaatggttagctgataagcattatcatatgatggcatttatagcagatgaaaagtctgattgggaaacttttacgcctcagccaatgaaatactacgcagaaccgttctttaattggtctaaaaaatctaacacacgctgttggataaacaactctaatagagctgtagtagtttatgctgatttaaaatacactaaagttatagaaaatattccggaaacatcaccagatagattagttcatgaatactgggatgatggtgattgtacgatagtaatgccaaatgttaaattcacgggatttaaaaaatatgcgtctgggatgcttttttataaatcttctggtgaaataatttcttattatgattttaactatcgtgtgagagatacagtagaaattatttggaagccgactggagtatttttaaaagcatttttacaaaaccaagagcatgagactccttggtcgccagaagaagagcatggattagctgaccctgatttaagaccattaattggcacaatgatgcctgattcttatttgttgcaggattcgaattttgaggcattttgtgaagcatatattcaatatctttctgacggatacggaactcagtataataatttacgaaatttaattcgtaatcagtatccacgagaagagcatgcgtgggaatatttgtggtcagagatatataaaagaaacatttatttaaatgctgacaaacgtgatgctgttgcaagattttttgaatcacgtagttatgatttttattctactaaaggaattgaagcatcatacaaatttctttttaaagttctttataatgaagaagttgaaattgaaattgaatctggggctggtactgaatatgacataatcgttcaatctgattctttgactgaagatttagtaggacaaacgatttatacagccacaggaagatgtaatgttacttatatagaaagaagttattctaatggtaaattgcaatggaccgtaactattcataatcttttgggaagattaattgctggtcaagaagttaaagcagaaagactccctagttttgaaggcgaaattattcgtggagttaaaggaaaggatttgcttcaaaataatatagactatattaatagaagtcgatcatattatgtaatgaaaattaaatccaatttaccttcttctcgttggaaatctgacgttattcgttttgttcatccagtaggatttggatttatagcaattacacttttaacaatgtttattaatgttggtttaactcttaaacacacagagactataattaataaatacaaaaactataaatgggattctggattgcctactgaatatgctgatagagtagctaaattaactccagctggtgaaattgaacatgattcagtaacaggcgaagcaatttatgaacctggtccaaaggctggtgtaaaatatcctcttcctgatgactataatgctgaaaataataattcaatatttcaaggtcaattgccgtctgaacgacgtaaattaatgagtcctttatttgatgcatctggaacaacatttgcgcaatttagagatttagttaataaacgtctaaaagacaatataggaaatccaagagaccctgaaaatccaacacaggttaaaatagatgaatgattcaagtgttatctatcgtgcgatagttacttcaaaatttagaacagaaaaaatgttgaatttttataattcaattggaagtggtccggataaaaacactatctttatcacatttggaagatcagaaccgtggtcatcaaatgaaaatgaggtgggctttgccccaccttatcctaccgattctgtattaggtgtaactgacatgtggactcatatgatgggaacagtaaaagttcttccatctatgcttgatgcagttattcctcgtcgagattggggagatactagatatccggatccatacacatttagaattaatgatattgtagtgtgcaactcagctccttacaacgctactgaatcaggcgcgggatggttagtgtatcgctgtttagatgttcctgatactggaatgtgctcaatagcatctttaactaataaggatgaatgccttaaattaggtggaaaatggactccttctgctaggtcaatgactcctcctgaaggccgaggagatgctgaaggaacaattgaacccggcgatggatatgtatgggaatatctttttgagattccgcctgatgtatctataaatagatgcacgaatgagtatattgtagttccttggcctgaggaattaaaagaagacccgactagatgggggtatgaagataatctcacttggcagcaagatgattttgggttaatttatcgtgttaaagctaatacaattcgttttaaagcatatttagattcagtttattttcctgaagctgcattgccgggaaataaaggatttagacaaatatcgataattacaaatcctcttgaagctaaagttcatccaaatgatccaaacgttaaagctgaaaaggattattatgatcctgaagatttaatgaggcattcgggtgaaatgatttatatggaaaataggccacctattattatggcaatggatcagacagaagaaatcaatattctgtttacattttaaattaagggagcccatgggctccctttttctttataaatactataaactcataaggaaaccgctatgttcattcaagaaccaaagaaattgattgataccggcgaaattggtaacgcttctactggtgatatcttattcgacggtggtaataaaattaatagtgattttaacgcaatttataacgcgtttggcgatcaacgtaaaatggcagtagcaaatggcactggagctgatggtcaaattatccatgctactggatattatcaaaagcactctatcgcggagtacgcaactccagtgaaagttggcactagacatgatattgatacttctaccgtaggtgttaaagttatcattgaaagaggcgaacttggcgactgcgttgaatttattaactcgaatggatcaatatcagttactaatcctttaacgattcaagctattgattcaattaaaggcgtttcaggtaatttagtagtaactagtccatatagtaaagttactttacgttgtatttcatctgataattctacgtcggtttggaattattctattgaaagtatgtttgggcaaaaggaatcaccagctgaaggtacatggaatatttctacatctggatcagttgacattccactatttcatcgcactgaatacaatatggctaaattgctagttacgtgccaatcagtagatggaagaaaaattaaaacagcagaaataaatattcttgtggatactgttaattcagaggtcatttcttctgaatatgctgtcatgcgagttgggaatgaaaccgaagaagacgaaatcgctaatattgcatttagtattaaagaaaattacgtaacggcgactataagttcttcaactgtcggtatgagagcagcagttaaagttatcgctacgcagaaaatcggggtggctcaataatgaaacaaaatattaatatcggtaatgttgtagatgatggtaccggtgactacctgcgtaaaggtggtataaaaataaatgaaaactttgatgagctttattatgaactcggtgatggtaatgttccatattcagccggtgcttggaaaacttataatgcttcatctgggcaaacattaaaagctgaatggggaaaatcatacgctattaatacttcgtctggaagagtaacactgcaacttcctaaaggaactgttaatgattataataaagtaattagagctagggatgtatttgcaacatggaatgttaatccagttactttagtagccgcttctggtgatactatcaaaggatcatcgtcatcggttgaaattaacgttcaatttagtgatttagagctagtttattgcgctccgggccgttgggaatatgtcaaaaataaacaaattgacaaaattattagttcagacattagcaatgtagctcgtaaagaatttttagtcgaagttcaaggacaaacagactttttagatattttccgtggaactagttataatgttaataacatcagagtaaaacaccgcggtaatgaattgtattacggcgatgtttttagcgaaaatagcgactttggttctcctggagaaaatgaaggcgaattagttcctcttgatggatttaatattcgattaagacagccttgtaatattggtgacactgttcaaattgaaacatttatggatggtgtatcacaatggagaagttcatatacaagacgccaaataaaagtattagattcaaaattaacgtcaaaaacttctttagaaggaagtatttacgttactgatttatcaacaatgaaatcaattccattctctgcatttggattaattcctggagaacctattaatcctaattctcttgaagttcgttttaatggaattttacaacaacaagctggaacagctggatatcctctgtttttgtgtgaaggcgctagttcagatacgcaagaaggatgtatatctcttggtggtgaatggaaagaatcaaacacagattattctatagaatatgaagatggaaaacctaccagtcttttatttgatagaaaatttgaatcaggcgatataatcgttataacgtggttcaataatgatttaggaactcttttagaaaaagatgacatcattgaattgactgatgaccgttatgttagcaaaggatcatctaccgaagttactggtgatgtagccttaacagattttgataaaatcggttggccaaatgttgaaaaagttgattcttatactagaacgtataattcaatatcatctattttcgatagcatttatcctgtaggttcaatttatgaaaatgctataaatccaaataatccggtgacttatatgggatttggttcatggaaattatttggtaaaggacaagttttagtaggatggaatgatgatgttacggatccaaactttgctttaaacaataatgatttagattctagcggaaatccttcacatactgccggtggaacagttggaacaacatcagtaacgcttgaaaacgcaaatcttcctgcgactaaaactgatgaaaaagttttaattgaagatgaaaacggatcagttattattggaggttgtcaatatgacccagacgaaactggtcctatatatacaaaatatcgtgaagactacgcaacaacaaactcttcacatactcctcctactaatattagtaatattcaaccgtctattactgtataccgttggataaggattgcataatgagtttacttaataataaagcgggagttatttcccgcttagcagattttcttggttttagaactaagaaaaatgatatttcgattatgaataatcagccagtaggcgctgtaacaatttcacaaatatcaaaaggtttttatgattcaaatgtagaatctgctatcaatgacgttagaaatatggcagagcaaccggttggagctgtattagttaatataagcggcgtatctcctactggcgtgcaacaaaccgactattggtcatttgaaggaactgttactgatacttcagtcaaatcaggtgacccagttattgttaacatgtttggtattccagttaaagctactaatggaatgacttcaattgaatttactagtgccgttagaatagctctacaggaaatggttgtaaaatttattgcaattgattcatttgaagaccatcctaccataggaaataaaatacaagttaagtatttagataaccaagaacatatcttagaacaatactctgataaaggaattactttcaaacaggaaataatttctccttctaaacctgggtatggaacttggcaattattaggtgcgcaaactgttacgctagatagtcacacacaacctacagtattttattattttgagagagtagcatgagtaacaatacatatcagcacgtatcaaatgaatcaaaatatgttaaattcgatccagtaggatcgaattttcctggcactgttacgacagtacagtctgcattatcaaaaataagtaatatcggcgtaaatggtattcctgatgcaactatggaagttaaaggaatagcaatgattgcgtcagagcaagaggttttagatggaactaataattctaaaatcgttacaccagctacattagcaacaagattattgtatccaaatgctactgaaactaaatatggtttaacgcgttattcaacaaatgaagaaacattaaaaggctcagataataattcatcaataacaccacaaaaactgaaataccacactgacgatgtgttcaaaaatagatattcgtctgagtcatcaaacggggttattaaaatatcatctacacctgcagctttggctggagttgatgatactactgcgatgactccgctaaaaacccaaaaacttgcaataaaattaatttcgcaaatagctccttcagaagacactgcaacagaatcggtgagaggagtagttcaattatctactgttgcacaaattcgtcaaggaactctccgcgaaggatatgcaatttccccgtatacctttatgaattctgttgcaacacatgaatataagggtgttatacgcctaggaacgcagactgaaattaataataatttgggtggtgttgcagtaacaggtgaaacactaaatggtcgaggagctaccggttctatgcgtggagtagttaaattaacgacgcaagccggtattgcccctgaaggtgatagctctggagcattagcatggaacgcagatgtaattaatactcgtggtggacaaactattaatggttctttaaatttagaccatcttacagcaaatggaatttggtcacgcggtggaatgtggaaaaatggcgatcaacctgttgccactgaaagatatgcgtccgaacgagttccggttggaactattatgatgtttgcgggtgattcagcacctccaggttggattatgtgtcatggtggaaccgtgtcaggtgaccaatttcctgattatagaaacgtagttggaacaagatttggtggcgattggaataatcctggcgttcctgatatgcggggtcttttcgtcagaggagccggcacaggcggtcatattttaaatcaacgtggacaagatggctatggaaaggatagactgggcgtaggatgtgacggaatgcatgttggtggtgttcaggcacaacaaatgtcataccataaacatgctggtggttggggtgaatataacagaagtgaaggcccatttggcgcgtccgtttatcaaggatatcttggaactagaaaatatgccgactgggataatgcttcatacttcactaatgatggatttgaattaggtggaccgagagatgcccttggtacacttaatcgtgaaggattaattggttatgaaactagaccatggaatatatcattaaactatattattaaaattcattactaaggattacaaatgattgaattaaaagatttaccttttgttgatagcgttcctggcgaaggtcaggaacgtatttcatggattaaaaatggtgaagaaatattaggagctagtactaagtatggaaatgatggatcaatgaatagaccaattgtttccgtgtttaaaaacgtcgaagttcttgatgaaaatgtgggaattcttaaaactgccattgaaacatcacagaaagatattaaaacaattcaaggagttttagatgtatcaggagatatagaagcactatcgcagatcagtgttaataaaaatgacatatcgaatttaaagacacttaccagtgaacacactgatatattaactggaactaataatacagttgacaaaattattgctgatataggtccatttaatgatgaagaaaactctgtttatagaacaattagaaatgatttattgtggattaaacaggaattaggacaatattctggccaagacattaacggtcttcctgttgttggtaatgctagcacaggaatgaaacacagaataataacaaatagtacattattatcttcacaaggcattcgtttaagtgaattagaaaataaatttactgaatctgacgtaggatcattaactgttgaagttggtaaattacgtgatgaacttggtaataaaccagtagattttgggccaaatatttataatagattaaacaccatagatgataaacaaactttaataatttctgatatagcagaaattaaatcttctattggatacccagaaaatgtttctataataacagaaattaataataacaaaagtagcattgaagctattaataatgaattaaatcagagtgaaggtgttaaacagcgcttaacggctattgaaacttctataggttcagatgatattccttctagtattaaaggaaaaattaaaaatcacacaacttctattgagtctttaaacggaattgttggtgaaaacacttcgtctggtttaagagcgaatgtttcgtggttaaatcaaattgttggaactgactccagcggaggacaaccgtctccttctggatctctattaaataaagtttcagtgcttgaaggagaagtttcagttttaaacaataatgttcaaaatatacaagttgaaataggaaataatagaacaggaattaaaggtcaagttattgaacttacttcacttataaatggaaataatcctgacggatcaactgttgaagaacgaggattaactaattctataaaaacgaatgaaactaacattgcggcagtcacacatgaagtaaatacagctaaagacaatatatcctctttacagagcagcgttcaagctctacaagaagcaggttatattcctgaagctccaaaagatggccaagcttacgttcgcaaagacggcgaatgggtactactttctacctttttatcaccagcataacatggggccgcaaggccccaaaggattttaaatgtcaggatataattctcagaatccaaaggaactcaaagatgtcattctaagacgtttaggggctccaattatcaatgttgagttaacacccgatcaaatctacgattgcatccagcgtgccctagaattatacggtgaataccattttgatggacttaacaaaggttttcatgtattttatgtaggagatgacgaagaaaaatataagaccggagtcttcgatttaagaggttcaaacgtattcgcagtaactcgaattttgcgtacaaatgttggatcaataacgtcaatggatggaaacgctacatatccatggtttactgactttcttttaggaatggctggtattaatggtggcatggggacttcttgtaacagattttatggaccaaatgcctttggagctgatttaggatattttacccagcttaccagttacatgggaatgatgcaagatatgctttctcctattccagacttttggttcaattcggcaaatgaacaactcaaagtcatgggaaacttccaaaaatatgatttgattatcgtagaaagctggactaaatcatacattgatacaaacaaaatggttggaaatacagtaggatatggaacagttggtccgcaagatagttggtcattatctgaacgatataataatccagaccataatttagtaggtcgtgttgtgggtcaagattcagatgttaaacagggtgcttataataatcgttgggtgaaagactatgctacagctttagctaaagaattgaatggtcaaattttagcacgtcatcaaggtatgatgcttcctggcggtgttacgattgatggacaacgcttaatagaagaagctcgattagaaaaagaagcattacgtgaagaattatacttgctcgatcctccatttggaattttggtaggttaatatggctacttatgataaaaatctttttgctaaattggaaaaccacactggttattctcagaccaatgaaactgaaatactaaatccttatgtaaatttcaatcattataaaaacagtcaaatattagctgatgtattagtagctgaaagcattcaaatgcgaggtgtagaatgctattatgttccaagagagtatgtttcccctgatttggtattcggcgaagacttaaaaaataaatttactaaagcttggaaatttgctgcatatttaaattcatttgaaggatatgaaggagctaaatcgttctttggtaactttggtatgcaagtacaagacgaagtgactttatctattaacccaaatttatttaagcatcaagttaacggaaaagaaccgaaagaaggcgatttgatatattttcctatggataacagcttatttgaaattaactgggttgaaccatatgatccattttatcaattaggccaaaacgctattcgtaaaattactgcaggtaaattcatttattctggagaagaaattaatccagttctacagaaaaatgaaggaattaacattccagaatttagtgaattagaattaaatcctgttcgcaatcttaacggtattcatgacattaatattgatcagtatgctgaagtagatcaaattaattctgaagctaaagaatatgttgaaccttatgttgttgtcaataatagaggcaaatctttcgaatctagcccatttgataatgatttcatggattaataaatattataaactaattaaagcccagattaggagaaatcatgtttggttatttttataattcgtcttttagacgatatgctaccttgatgggcgatttgttttcaaatatccaaatcaaacgtcagttagaatctggtgataagtttatacgtgttcctattacgtatgcatcaaaggaacactttatgatgaaattgaataaatggacatcaataaattcacaagaagacgtggccaaggttgaaactattctacctcgtataaatttgcatttagttgattttagctataacgctccatttaaaacaaacattttaaatcaaaatttactacaaaaaggcgcaacttctgtagtatcacagtataatccatctcctattaaaatgatttatgaattgagtatatttactcgctatgaggatgatatgtttcaaatagttgaacagattcttccatattttcaacctcattttaatacaactatgtacgagcagtttggaaatgatattccatttaaaagggatattaaaattgtactgatgtctgctgctatagacgaagctatagatggggacaatttatctcgtcgtagaattgaatggtcattaacatttgaagtaaatggatggatgtatcctccagtagatgatgcagaaggattaattcgtactacttatacagattttcatgctaataccagagatttgcctgatggcgaaggcgtttttgaatctgttgataatgaagttgttcctcgagatattgacccagaagactgggatggaacagtaaaacaaactttcactaacaatgtaaatagaccaacaccgccagaacctcctggcccaagaacatagaggttattatggaaggtcttgatataaacaaacttttagatatttctgacctccccggaattgacggggaggaaattaaagtatatgaacctctgcaattagtagaagttaaaagcaatccacaaaaccgtactccagatttagaagatgattatggagtagttcgtcgaaatatgcattttcaacaacaaatgctaatggacgcggccaagatttttcttgagacagcaaagaatgctgattctcctcgtcacatggaagtatttgcaactcttatggggcaaatgactacgacgaacagagaaatactgaagcttcataaagatatgaaagatattacatctgagcaggttggcaccaaaggcgctgttcctacaggtcaaatgaatattcagaatgcgacagtattcatgggttcaccaacagaattaatggacgaaattggtgatgcttacgaggctcaagaagctcgtgagaaggtgataaatggaacaaccgattaatgcattaaatgatttccaccctttaaatgaagctggaaaaattttaataaaacacccaagcttagcagaaagaaaagatgaagatggaattcattggataaaatcacagtgggatggaaaatggtatcctgaaaaattcagtgattaccttcgtctgcataaaatagtaaaaattccaaacaactctgataagcctgaattatttcaaacttataaagataagaataataaaagatctcggtatatgggtcttcctaacttgaaacgagctaatattaaaacacaatggactcgtgaaatggtcgaggaatggaaaaaatgccgagatgatattgtttattttgcagaaacatactgtgccattactcatattgactatggtgtcataaaggttcaattacgtgactatcagcgtgatatgctcaaaataatgtcatctaaacgtatgactgtttgtaatctatcacgtcagcttggtaaaacaactgtagtagctattttccttgcacactttgtatgttttaacaaggataaagctgtaggtattcttgcgcacaaaggctcaatgtctgcggaagttttagatcgtactaagcaagcaattgaactgcttcctgactttttacaaccaggaattgttgaatggaataagggttcaattgaacttgataatggttcctcaatcggagcctatgcttcctctcctgacgcagttcgtggtaactcgttcgcaatgatttacattgacgaatgtgcatttattccaaacttccatgattcctggcttgctattcagccagtaatttcatctggtcgtcgttctaaaattattattactacgactcctaatggattaaatcatttttatgatatttggactgcagccgttgaaggtaaatctggatttgaaccatatactgctatttggaattcagttaaagaacgtctttataacgatgaagatatttttgacgatggatggcaatggagcatacaaaccatcaatggttctactttagcgcaattccgtcaagaacacacagctgcatttgaagggacttctggaacactaatttcaggaatgaaattagctgttatggattttattgaagtaacaccagatgatcatggttttcatcgatttaaaagccctgaaccagatagaaaatatattgcaactctagactgctcagaaggtcgcgggcaagattaccacgctttacatattattgatgttaccgatgatgtgtgggaacaggttggtgttttgcactcaaacactatttctcatttaattctacctgacatcgttatgcgttatttagtagaatacaatgaatgcccagtttatattgaattaaatagtactggtgtgtcagttgcgaaatcactttatatggatttagaatacgaaggtgttatttgcgattcatatactgatttaggaatgaagcaaactaaacgaacgaaagcagtcggatgctctacattaaaagaccttattgaaaaagataagcttattattcatcaccgtgcaactattcaagagtttagaacgtttagtgaaaaaggcgtgtcttgggcggctgaagaaggttatcatgacgatttagtaatgtctttagtgatttttggatggttatcaacacaatcaaaatttattgattatgccgacaaagatgacatgcgattagcatctgaagtgttttcaaaagagcttcaagatatgggggatgaatacgctccagttatatttgttgattcggttcattctgctgagtatgttccagtatctcatggtatgtcaatggtataaatatattaaagcatattaaagaggattaaaaatgactttattatctccgggcattgagctcaaagaaactacggttcaaagcaccgtggttaataactctactggtacagcagctttggccggtaaattccagtggggtcctgcttttcagattaaacaggttacaaacgaagtagatttagttaatacttttggtcaacctacagctgaaactgctgactattttatgtctgcaatgaatttcttacaatatggaaatgatttgcgagttgtgcgcgctgtcgatagagataccgctaaaaactcatctccgattgctggtaatattgaatacacaatttctaccccaggtagtaactacgcggttggagataaaatcacggtcaaatatgtttcagaagatgttgaaacagaaggtaaaattaccgaagtagatgctgatggaaaaattaagaaaattaatattcctactgcaaaaattattgctaaagctaaagaagttggcgaatacccaacattaggttctaactggactgcagaaatttcttcatcttcttccggtttagctgcagtaataactcttggaaaaattattactgattccggtattttattagctgaaatcgagagcgctgaaactgctatgacagcagtcgattttcaggcaaatcttgaaaaatatggaattccaggagtagtagctctctatccaggcgaattaggcgataaaattgaaattgaaatcgtatctaaagctgactatgcgaaaggcgcttctgcattactgccaatttatccaggtggtggtactcgtgcatctactgccaaggcagtatttggatatgggccgcagactgactcacagtacgctattatagttcgtcgaaatgatgctattgttcaaagcgttgttctttcaactaagcgtggtgaaaaagatatttacgatagtaacatctatattgatgactttttcgcaaaaggtggttcagaatatattttcgcaactgcgcaaaactggccagaaggcttctctggaattttaactctgtctggtggattatcatcaaatgctgaagtaacagcaggagatttgatggaagcttgggacttctttgctgaccgcgaatctgttgacgttcagttgtttattgcgggttcttgtgccggtgaatctttagaaacagcatctactgtccaaaaacacgtcgtttcaattggagatgctcgccaagattgcttagtattgtgctcaccaccgcgtgaaactgttgttggaattcctgtaactcgtgcagtagataatttagttaactggagaactgcagcaggttcatacactgataataactttaatatcagttcaacctacgcagcaattgatggtaactacaaatatcagtatgacaaatataatgatgtgaatcgttgggttccattagcagctgacattgctggtttatgcgcgagaactgataacgtttctcagacttggatgtctccagctggttataatcgtggtcagattcttaacgttattaaacttgctattgaaactcgccaagctcagcgcgaccgtttatatcaagaagctatcaacccagtaactggtacaggtggtgatggttacgtattgtatggtgataaaacagctacttctgttccttctccatttgatcgtattaacgttcgtcgtctgtttaatatgttgaaaacgaatatcggacgtagttcaaaatatcgtttgttcgaattaaacaacgcgtttactcgttcatcattccgcacagaaactgcccagtacttacagggaattaaagctctcggtggaatttatgaatatcgtgtagtttgcgatacaacaaataacactccgtcagtaattgatagaaatgagtttgttgcaacattctacatccaaccggcgcgcagtataaattatattactttgaatttcgtcgcaactgctactggtgcagatttcgatgagttaactggtcttgcaggttaattgatatggggcttcggcccctattctcgaggaatcaagtgattatttctaaatttattaaagtgaaaattgtaccatcaaattttaaacattatcaatcaaagggttataaattaacacctcttggagcggttaaacatggatttaggtattatgaaattgatgttaaagttgaagacattaaaggtagtaccgcgtatgtaaaatgccgttgcgataaatgtggaattgaatataaccaacgcattggaagaaacactgatatttgtcgtgattgccgtcataaagataaaatgcgcaataattcatatggttccgcgaataaaggaaaaacagtagaatgtatgcatggcgtaaatcatccaagatggaacccaaataaatctgaaatgcgtgaatatatttcatcggtatataaagaaactcgtaagcataagaaaatttggtcaaaatggccaaatgctgataaaataggagtgtgtggtacaaaaggcgcttaccaacttgatcataaggtatctatcaaatacggttttgataatttaattcctgctaaaataattggcggtattaataatttagaaataatcacttgggaatctaaccgagaaaaatcaaaaagaaatagtgtagatctttgggatttactagaatgattctaaaggcctgtttcggcaggccatataaatacactatatccttaattctttaattctatatgccctaggttaaacatagggatataaatactacagaggctaatatgtttgtagatgatgtaacacgagcgtttgaatctggtgattttgctcgacctaacttattccaagtagaaatttcttatcttggacaaaattttacattccaatgtaaagccactgctttaccagctggtattgtagaaaaaattccagttggatttatgaaccgtaaaattaacgtagcaggcgatcgtacattcgatgactggactgttacagtaatgaacgatgaagctcatgatgctcgccagaagtttgttgattggcaaagcattgctgctggtcaaggaaacgaaattactggtggaaaacctgcagagtataaaaagagcgctattgttcgtcaatatgctcgtgatgctaaaacagtaacaaaagaaattgaaattaaaggtctgtggcctactaacgtgggtgaacttcaattagattgggattcaaacaatgaaatccaaacctttgaagtaactcttgctctcgattattgggaataaaatgaatggggagaaatccccatcctgcttaaagcagagaagtccattataaatataactataattcccatttggagaatacaatgaaatttaatgtattaagtttgtttgctccatgggctaaaatggacgaacgaaattttaaagaccaagaaaaagaagatcttgtttccattacagccccaaagcttgatgatggagcaagagaatttgaagtaagctcgaatgaagctgcttctccttataatgctgcattccaaacaatttttggttcatatgaaccaggaatgaaaactactcgtgagcttattgatacatatcgtaatctcatgaataactatgaagtagataatgcagtttcagaaatcgtttcagatgctatcgtctacgaagatgatactgaagtcgtagcgttaaatttggataaatctaaatttagtccaaaaattaaaaatatgatgttagatgaatttagtgatgtattaaatcatctatcgtttcaacgaaaaggttctgatcattttagacgttggtatgttgattcaagaattttctttcataaaatcattgatccaaaacgtccaaaagaaggcataaaagaattacgtagattagaccctcgccaagttcagtatgttcgcgaaattataacagaaactgaagctggcacaaaaatagttaaaggttacaaagaatattttatatatgatactgcccatgagtcatatgcatgtgatggtagaatgtatgaagctggcacaaaaataaaaattccaaaagctgctgttgtttatgcccattctggattagtcgattgctgtggcaaaaatatcatcgggtatttacatcgtgctgttaaacctgctaaccaattaaaattattagaagatgctgtagtcatttatcgcattactcgtgctcctgaccgtcgtgtttggtatgtagacacaggtaatatgcctgctcgtaaagctgctgagcacatgcaacatgttatgaacacgatgaaaaaccgtgtagtatatgatgcatcaacaggtaaaataaaaaatcaacaacataatatgtctatgaccgaagactattggttgcagcgccgtgatggtaaagctgtgacagaagttgatactcttcctggtgctgataatactggcaatatggaagatattcgttggtttagacaagctctttacatggcattacgtgttcctctttcacgcattccacaagaccaacaaggcggtgtgatgtttgattctggaactagcattacacgtgatgaattaacgtttgctaaatttattcgtgagttacagcacaagtttgaagaagttttcctagatccacttaaaacaaatcttttgcttaaaggtataatcacagaagatgagtggaatgatgaaataaataatattaagatagaatttcatcgggatagctactttgctgagctcaaagaagcagaaattttggaacgaagaattaatatgctaaccatggcagaaccatttattggtaaatatatttctcacagaactgctatgaaagatattttgcagatgactgatgaagaaatagaacaagaagccaagcaaattgaagaagagtctaaagaggctcgtttccaagaccccgaccaagaacaagaggatttttaatggaaggtttaattgaagctattaaatcaaacgacctcgtagccgctcgtaaattatttgctgaagccatggctgcaagaacgactgatttaattaaagaagaaaaaatcgctatcgctcgtaatttcttaatcgaaggtgaagaacctgatgacgaggatgatgacgaagacgaagatagtgatgataaagacgacaaaaaagacaaagactctgacgaagacgaggatgatgaataatgcttctgatccctgaaactcatgaattagttctcgagaatgtcgaagcacttattcctgaagcacagggtcgctttgacgaattgtcttctgctttaaataaagacgatataaatacaattgtcgagaatatgcttgatgatgaaactgatttagcggttgcattagcttctattaatgaaaatatgccgttaaatgaatttatcgttaaacatgtttctgcccgtggtgaaattactcgcactaaagatcgcaaaacccgcgaacgtaatgcatttcaaactaccgggttgtctaaagcaaaacgtagacaaattgctcgtaaagctaccaaaacgaagattgccaatccagcaggtcaatctcgtgctcagcgtaagcgtaaaaaagctcttaaacgccgtaaagcattaggattaagctaatgaatgaaccccaattactaattgaaacttggggtcaacctggcgaaattattgatggcgtaccaatgcttgaatctcatgatggaaaagacttaggtttaaaaccgggtttatacatcgaaggaatattcatgcaagcggaagtcgtcaatagaaataaacgtctttatccaaaacgtatattagaaaaagcggtaaaagactatattaatgagcaagttttaactaaacaagctctcggagaattaaatcatcctccacgcgctaatgttgacccgatgcaagccgctatcattatagaagatatgtggtggaaaggaaatgacgtatacggacgagctcgtgttattgaaggtgaccacggtcctggagataaattagcagctaatattcgtgccggatggattccaggagtttcttctcgtggattaggttcattgactgacacaaataaaggttatcgtatcgtaaacgaaggattcaaattaactgtaggtgttgatgcagtatggggtccaagtgctccagatgcatgggtaactcctaaggaaattaccgaatcacagacggcggaagccgatacaagtgccgatgacgcctatatggctctcgcagaggccatgaaaaaagcgttataaatattattatctaaacaacaggactacaaaatgcttaaagaacaactgattgccgaagcgcagaaaattgatgcttccgttgctcttgatagtattttcgaatcagttaatatttctccggaagcaaaagaaactttcggcactgtattcgaagctaccgtcaagcagcacgccgttaaattagctgaatctcatatcgctaaaattgctgaaaaagcagaagaagaagtagaaaaaaataaagaagaagcagaagaaaaagctgagaagaaaatcgctgagcaagcttctaaattccttgaccatcttgcaaaagaatggctcactgaaaataaattagcagtagataaaggtatcaaagccgaactgtttgaatccatgcttggtggattgaaagagctcttcgttgaacacaacgttgttgttccagaagaatcagttgatgttgtagctgaaatggaagaagaactgcaagaacataaagaagaatcagctcgtctgttcgaagaactcaataagcgtgacgcatatatcaattatgtgcagcgtgaagtggcattgagcgaaagtactaaagatctgactgagtctcaaaaagaaaaagtctctgctctggtcgaaggtatggattattcagatgcattctcaagtaaattgagtgcaatcgtagaaatggtgaagaaatctaataaagatgaaagcactattactgagagtataaatactcctgatactgaagcagccggactgaatttcgtcactgaagctgtagaagataaatctgcacaaggtgcagaagatattgtaagtgtatatgcgaaagtcgcatctcgtttctaattttaaaggttaacacaaatgactatcaaaactaaagctgaacttttgaacaaatggaagccattactggaaggtgaaggtttaccggaaattgctaatagcaaacaagcgattatcgctaaaatctttgaaaaccaggaaaaagatttccagacagctccggaatataaagacgaaaaaattgctcaggcattcggttctttcttaacagaagctgaaatcggtggtgaccacggttacaatgctaccaacatcgctgcaggtcagacttctggagcagtaactcagattggcccagctgttatgggtatggtacgtcgtgctattcctaacctgattgctttcgatatttgtggtgttcagccaatgaacaacccgactggccaggtattcgcactgcgtgcagtatatggtaaagacccaatcgctgctgatgctaaagaagcattccacccaatgtatggtccagatgcaatgttctctggtcagggtgctgctaagaaattcccagctctggctgctagcacacaaaccaaagtaggtgatatctatactcacttcttccaggaaactggtactgtatatctgcaagcttctgctcaagtaacaattagttctactgcagatgatgcagctaaattagatgctgaaattaagaaacaaatggaagctggcgcattggtagaaatcgctgaaggtatggctacttctatcgctgaacttcaggaaggtttcaacggttctactgataacccatggaatgaaatgggcttccgtatcgataaacaagttatcgaagctaaatctcgtcagctgaaagctgcttactctatcgaattagcacaagacctccgcgctgttcacggtatggatgctgatgctgaactgtctggtattctggctaccgaaatcatgctggaaatcaaccgtgaagttgttgattggattaactactcagctcaggttggtaaatctggtatgaccctgactccgggttctaaagctggtgtatttgacttccaggatccgattgatattcgtggtgctcgctgggcgggtgaatcctttaaagctctgttgttccagattgacaaagaagcagttgaaattgctcgtcagaccggtcgtggtgaaggtaacttcattatcgcttcccgtaacgtagttaacgttctagcttcagttgatactggcatttcttatgctgcacagggtctggctaccggctttaacactgatactaccaagtcagtatttgctggtgttctgggtggtaaataccgtgtatatatcgaccagtatgctaaacaggattatttcactgtaggttataaaggtccgaacgaaatggatgctggtatttactatgctccatatgtagctctgactccgctgcgtggttccgatccgaagaacttccaaccagtaatgggattcaaaactcgttacggtatcggtatcaacccatttgcagaatccgctgctcaggctccggcttctcgcatccagagcggtatgccttctattctgaatagccttggtaaaaacgcttactttagacgtgtatatgttaaaggtatctaatctttgacgatttaagggaccttcgggtccctttagttgtttttatggtataaataaatcatataaactgaaaggaaagcgcaatggctaaaatcaacgaacttctgcgcgaatcaaccacaacgaatagcaactcaatcggtcgcccaaatctcgttgctttgactcgcgctaccactaaattaatatattctgacattgtagcaacgcaaagaactaatcaacctgttgctgctttttatggtatcaaataccttaacccggataacgaatttacatttaaaactggtgctacttatgctggcgaagctgggtatgtagaccgagaacaaatcacagaattaacagaagagtctaaattaactctcaataaaggcgatttattcaaatataataatatcgtttataaagtattagaagatacaccatttgctgatattgaagaaagcgatttagaattagctcttcagattgcaatcgttcttttaaaggttcgtctattttctgatgctgcagtaacaagcaaatttgaaaactctgatagcgaaattgcggatgctagattccagattaataaatggcaaaccgcagttaaatctcgtaaacttaaaactggtatcacagttgaattagcacaagatttagaagcaaatggattcgatgctcctaatttcttggaagatttgcttgcaactgaaatggcagatgaaatcaataaagatattctgcagtctttgattacagtgtcaaaacgctataaagttacaggaattactgatactggattcatcgatttgagttatgcatctgcacctgaagctggtcgttcattataccgaatggtatgtgaaatggtttcgcatatccaaaaagaatcaacttatacagcaacgttctgtgttgcttcagctcgtgctgctgcgattcttgctgcatcaggttggttaaaacataaaccagaagatgacaaatatctttcacaaaatgcctacgggttcttagctaatggtttaccgctttattgcgatactaacagcccattagattatgtaatcgttggcgtagtagaaaatatcggtgaaaaagaaattgttggatcaattttctatgctccgtatacagaaggtcttgacttagatgaccctgaacatgtaggtgcatttaaagttgtagttgatccagaaagtttgcagccatctatcggtttattagttagatatgctttatctgcaaatccttacaccgtagcaaaagatgaaaaagaagcaagaataattgatggtggagacatggataaaatggcgggtcgttcagatttgtctgttttattaggtgttaaactaccaaaaattatcattgatgaataaaacaaagggacctttcggtccctttttatttaacttaccaattcaatccaagccggacgaagtacatcttgtaccattttaactaattcctttttaatcaaagaaggattatctgcttgagttagagtaataccttcacgagaagtttcttccaaaatatcttgaacagttagtcccatcacctttccaaaatccttcggaccaatttcaccaattttagaaataacgttatttactcggttcagtgtaacgtagcaagctaaaattcccaccaatttgttatcagcttctgacagttcaactttagctttaataggcttatcagactttttcttttcactaaatttggaattcttgcatttgatggctacacgatttccattatgaagccaagaaggataacaaggtttcaatacatatccttcagcggtaaatacttcgcctttggcttcagctttccaaacacatttgttagcgtcaactaatcctgcatggtctactgtaaaattataatcttggacgacagaatctaaatcatttggcaatttaataagctcttcaaatttaccgcgacctaaaagtggagccattttaaatttaaatgtattacagaatgattccatcatataatcatcgacataagtcacatcatcactttcggtagtaacaataatgtcaaatacataaaaatctttatcgccataatcgacattcttctgaatgccaggtccagcaaattcgccaaagacttgataagatacaactgctgaagtttccataatatcttgtactgctttaatggaatcagcgtaattctttagaataatttcatacccaaagaaatcttcagcaggaagaatcggtccagtacgtttagcgcaagttactttatcacgctcaataatcaatgagaaatttgtgccgtgaatcttttcacgagctacccattcgccgccagtcaatcccaagctataaagtttttcaataaatttagagttgtaatgattttcaagactgctatactttttaaacataattaatcctcaaaatgtaatttctaaccaatcaccatcacgctgatcactattgactttaaaattaaatccttcttttctcagccaatcaccaatttcttcagtaatcaatttatcacgagcagtacaataataactaaaatatgttttaccttgttcagctgctttattagcaagttctgaaaaatctttaataaaacactctagcttaaactgtttgcttttaagtgctttttcgcgtaattgattagcaaaagattcattttcataaagatcatactgttccatttttcacctttttattaatatgtctttttctatagacaactttttctcgagtctcaaatttattcttagcagtcatagctcgagcccataatacagccacttctttcgcctgtaagttcaattcacgagcaatttcaatgaatgactttccagactcatgaagagtaaacaccacaacctcagttctcataatcaatctcatgttatcgagttgatgccattatatacatcattttctgagtatgttttgtgtgctttcaaaatgaagaaaggggccgaagccccttatgattatgattatggataggtatagatgataccagtttctaaagcagttttatgaatgatgtatccattgcgtgattcttgaacatcaacttctggatagtctttcatcatcttctgaagagtgtaacgatgcaggtagtatttactgtctggatcttcagttttccaatctttaccttcttcggtcattttttggatttcatccataacccaccaaccgcaccagatataagctgaagtacgatgtggaagaggatgaacataaggtagttcaccttctggttctggagcaactttatcagttacctgaacttgaccttctgctgtaatagttttgctatcgtaatcagttgcagtaacgacagcagtaacttcaatagtttgacttccaacagatgaggtatcgacagtatatacgttagttgacccttctacaggagaagaatctttcttccatgagtaagtaatttgtgcttcttctggagcacccgtaacattagccgtaaatgtagccgaagcatcttgctgaacgttaatagaaggaggagtcaatgtaacctgtggattcattgttttcttattaacagtcaatgatacttcattagaagtaacttccttttcattgtaattttctgcagttacttgcgctacacacttaactgttttagctccaactgtggtaggagtatagttaaatgtagtagtagtttctccatcgaccagagaaccgtcaacataccactgatacgtagcagacgctcctggtggctgtgaatccaaggcagcagtaaattgaactggggttccaattactccggcagcaggattagcaggagttacggctaacgtagttgtctgtgtcttcttattaactgttaatgatacttcattagaagtaactgtttttgcgtcataatctgttgctgttacttgcgctacgcatttaattctttttactccacttgtagttggagtatagctaaatgtagcagaagtcgcttcaccaatttgagaatcatctacataccactgatacgtagcagatgccccatcaggttgagaagctaaggcagcagtaaattcaacggctgttccaatcactccagctggaggactatcaggagttactgccaaggtagtcgtctgcgtctttttattaacagtcaatgatacttcattagaagtaacgcttagtgcatcataatctgccgcagttacttgagctacacacttgatttttttaactccacttgtgtcaggagtgtaattgaatgtagcgtcagttgcttcgtctacaggagaaccgtcaacgtgccattgatacgtagcgtttgcacctgatggctgtgaagctaaggcagcggtaaattcaattggagttccaatcactccagcatcaggattagcaggagttacggctaacgtagttgtttgtgtcttattttgaactgtgatagttgtactaatttctgctgtttcaggttcagattctgcaacttgattggttgcaactactttaatagtcttttgaccggcaggtccttttagtacataactaaaagttgctgacgtttcttcctgtggagcgtcgtctacagtccaagcatatgtaataggtccatctccagtttgaccactgggtgtagcagtaaactgctgagtctgatctataactccagtaggtgttttaggagttatatcaactgtaaaagtcataagttatccttattttaatgttacgaaagaagagttgcgtgtttcacgaattaaaactgatccgtcacggttaatgtaataaattaagctaaataaagtttggtgtgctgacgcatgttcaaaactagttgggtgagatttccaatcaggagtttcagcaatccattgataaatccaccaaggaacagtacagaatcctggattttttccaatcaactgaagattcgggctaaagttttccggaagagtaaatacagacggcttttcagattcaataatctcagctacagcctgttcaaatttttcttcaacaaatggagtatcttcaatcaaaacatcggtattttcaggaattttatctgtttctactacttcaattttaatgtcagatttaaccggagaatcaatcaaaagtgctgcttctggattgacttcttcatcgtcatattttaacccctctgcagcatcagcagcatcaattaagtctttaatagataacccatcagtctccggcataggttcactagcgagcttctggagggcttcttcaatatcaacaacgatattatcaaaagatttattctttttgacctttataccaaactgttcagcatattcagctaatttagctttagcttctttgttatcatcaagagccttcagctctgcaatataatctttatctatcataatatttcctcagtataaatatagatatatttattacatggtatttagacatgactgacattaaagtacatttttatgattttagtcacgtgagaattgattgtgaagaaagtacatttcatgaactccgtgatttctttagctttgaagctgatgggtatcgttttaatccgaagtacaaatatggccactgggatggacgaattcgtcttttagattataatcgccttcttccattcggtttagtcgggcaaattaaaaagttctgcgataactttggctataaagcctggattgacccacagattaacgaaaaagaagaattatcaagaaaagattttgatgaatggctttctaaattagaaatctattcaggaaataaaagaattgaaccacactggtatcaaaaagatgcagtgttcgaaggactagttaatcgtcgtagaattcttaatcttccaacatccgctggtaaatcgttaattcaagctttgcttgcgcgatattatttggaaaattatgaaggtaaaattcttatcattgttccaacaactgctctgacaactcagatggctgatgactttgttgactatcgtttattcagtcatgcaatgataaagaaaatcggtggtggagcatcaaaagatgataaatataaaaatgatgcaccggtcgttgttggtacatggcaaactgtagtaaaacaaccgaaagaatggttctcacagtttggaatgatgatgaatgatgaatgtcatcttgctacaggaaaaagtatttcatctatcatatcaggtttaaataactgcatgttcaaattcggtttgtctggttcattacgtgatggcaaagccaatatcatgcagtatgttggaatgttcggtgaaatatttaagccagtaacgacctctaaattaatggaagatggacaagtaactgagttaaaaattaatagtatttttcttcgctatcccgatgagttcactactaaattaaagggaaaaacttaccaagaagaaataaaaattattactgggcttagtaaaagaaataaatggatcgctaaattagctattaagcttgcacaaaaagatgaaaacgcttttgtcatgtttaaacacgtatcgcacggtaaagctattttcgatttaattaaaaatgaatacgataaagtttattacgtatcaggggaagttgataccgaaacccgcaatataatgaaaaccttagctgaaaatggtaaaggaataattatagtagctagttatggtgtattttctactggtatttcagttaaaaatctgcatcacgttgttttagcgcacggtgttaaatcaaaaatcattgtattacaaacaatcggtcgtgtattacgtaagcatggttctaagacaatagcaacagtctgggacctcatagatgattgtggtgttaagccaaaatctgctaatacgaaaaagaaatatgttcatttgaactatcttttaaaacacggcattgatcgtattcagcgctacgcagatgaaaaatttaattacgtaatgaaaacagttaatttataagggcttcggccctttggagaaaaagatgttactagaatttaaacaatttctttatgaagcttctattgatgaatttatgggtaaaattgcctcttgccaaacgatagaaggtttagaagaacttgaagcttattataagaaaagagttaaagaaactgaattaaaagatactgatgacatctcagtcagagatgctttggcaggaaaaagagctgaattagaagattcagacgatgaagtagaagaaagcttttaaattaaaaaaggcccaaccaaaaaggaagggccaaaactatagactaaaggtcacactatagcaaaagttgtgtttcatttaattgttcttccgaactttctgaaactggtagttctttaatgtaattatagcaaggcccaggatgtacaggacctttgtctgtttcaacaaccaatgcagaatcgattggagttttacagacaacacaaatcttatctgacatgattgtctcctctgaattatatatctatttatacaactctcatatgcatatcaatgcccatatctttagaataaaaatattcatcaagatatccggcaaattttcctttaatataaaggacatcttcaccacacgggtggtcggccaggatacgaatatcctgacgcttaagattatgctttttcattaagaattgaatttccgtttcaaattcttcttcataattaaaagcatcatcaatgctatatctcattattttccagcctcaaatgctcgcatgtcttgaatatgcttaatagcaaatccgcgtgatttgatagcatcaagagctccgctacagaaatccaataaaatcccccaatactgtaacgaggtatcaacctttaaaacatccttatcagctgatagaactgttttcatttctgatttctcgtaacgatccatactaaattcatcaccatctcctcgtcccgagtagtagtctaatctagctttaagagcaacttttttctgtgcttcaattctaagcatttcctttttaatacttgaatgcttattaagccatttactatataacatcacattattagctgcttcatactgtaatttagtcgaatctataaacacatctttcttcaattcttcttgaagatcttctaatctcatattgttctctattcaattgttattggatggacttagattcattataccacgtttatacgtgaagcattatactctattactggaagccagctgtagttttatctgctcaatatcatcagggttatcgatgactgaaaagcgtatttctactatcaaagtataatcatcataaaccggtattacattaactgctaatttatcaatacgtggctcatagtttcttactgcgctttcgatattacgctcaaccgtgtcagcagtaagaggagtcatattctcaaaaagttggtcagataaatcgcatccaaattcagggtcaaacggtcttgaaccttttcttgttgtaataattcctaaaagactatttttaattgaccttaatccaagtgatcttgaaacgtctttgttccaatccattttcatctctgggtcaatatcagaataaagcttattaatatttgccattacaatagctcaaagaattctttgagtcctcttattacatgagcgtgggtttttccacactctggacacttaattggaacagccaaataaacagtaggctttaaaagcatatcttttatagctacaatatctgactctgtgatgatagaatataaatcttccaattctttttcatttaagtcttcaactggaatgctttcaccgttagcatgaatcgtttctatacatgatactatcatgtgggctatatttttatcatcaaaaattttagggtaatggaatttaattttaatgtcacccagtgtataccagaggtcttctggtgcatctatttgtgtatgtaatagatttatatgggttggtatttcagttccacaggtgcacttccaggagttttcgtgattaacttctccaagagaatgcgcccataaatgaatcagtaatagttctgattcttggcggtttaaatcttttgcatttgtacagtctttgattagctttttaacaatctcttctactgaaccattctttttagcagtaataagttctagatattctttaagagtaaatgcgcgacagttgattattttagaaccaactctcacgtcaaatttgtattcatacatatttagctcctttatttatcatatttataaatagaataaaaggagcatctatggcaaacattattcgttgtaaattacctgatggtgttcatcgttttaaaccatttacggtagaagattatcgagattttttgttagttcgaaacgatatagaacatcggtcaccacaagaacaaaaagaagtaattgctgatttaattgctgattattttggagactatccaaagacttggcaaccatttatatttttgcaggtatttgtagggtcaataggtaaaactaaagtaccagtcacatttgtatgtccaaaatgtaaaaaagaaaagacagttccatttgaaatatatcaaaaagaattaaaggaacctatttttgatgtagctaatgttaaaattaaattaaattttccttctgagttttatgaaaataaagcaaagatgattactgaaaatattcattctgttcaagtcgatgaaatgtggtatgattggaaggaaattagtgaatcaagtcaaatagaacttgttgacgccatcgagatagaaacattagaaaaaattctcgatgcaatgaatcctattaatttaacattgcacatgtcgtgttgtgataagtacattaaaaaatacactgatatagtagatgtgtttaagctattagttaatccagatgagatatttactttttatcaaattaatcacacgcttgtaaaaagtaattatagcttaaattcaataatgaaaatgattcctgccgagcgcggattcgtattaaaactgattgagaaggataaacatcaatgagtatgttacaacgtcctggatatccaaatctcagcgttaaattatttgagagttatgacgcttggagtaataatagatttgttgaattagctgctactattaccacattaactatgcgtgactctctttatggtcgaaatgaaggaatgctacaattttatgattctaaaaacattcatacaaaaatggatggaaatgaaataattcagatttctgtagctaatgcaaacgatattaataatgttaaaacccgaatttatggatgcaagcatttttccgtgtcagtagattcaaaaggcgataacatcattgctattgaattaggaactattcattctatagaaaatcttaaatttggtagaccatttttccctgatgccggtgaatctataaaggaaatgcttggcgtaatttatcaagatcgtacattattaactccagcgataaatgctattaatgcttatgttcctgatattccatggactagcacatttgaaaactatttgtcatatgtaagagaagttgctctagcggtaggaagcgataagttcgtatttgtatggcaagacatcatgggagttaacatgatggactatgatatgatgataaatcaagaaccatatccaatgattgtcggtgagccaactttaataggtcaattcgtccaagaattgaaatatccattagcatatgatttcgtttggttgactaaatcgaatcctcacaaacgcgatccaatgaaaaatgctactatctatgctcattcatttttagattcttcattaccaatgattactacaggaaagggtgaaaactctattgtagtgtcaaggtcaggtgcttattctgaaatgacttatagaaatggatacgaagaagctattcgtcttcagactatggcgcagtatgatggttacgctaaatgttctactgtcggtaattttaacttgactcctggcgttaaaattatttttaatgatagtaaaaaccaatttaaaacagaattttacgttgatgaagttattcacgaattatcaaataataattccgtaactcatctttatatgttcactaatgcaacgaaactggaaacaatcgacccagttaaggttaaaaatgaatttaaaactgatactaccactgaagaaagtagttcttccgataagtaataaagaagtttctattcctaagatgggtcttaaacattataacattttaaaagatgttaaaggtcctgatgaaaatttaaagcttcttattgattctatttgtccaaatttatcaccggcagaagttgatttcgtttctattcatttattggaatttaatggaaagattaaatctcgtaaagaaatagatggttatacttatgatattaatgacgtttatgtatgccaaagattggaatttcaataccaaggaaatacattttattttagacctcctggaaaatttgaacaatttttaactgtaagcgatatgttatccaaatgcttgcttaaggtcaatgatgaagttaaagaaattaattttcttgagatgccagcatttgtattaaaatgggcaaatgatatttctacaactttagcaattcctggccctaatggttcaataactggaattggcaatattattggattatttgaatgaaaaagccacaagaaatgcaaacgatgcgtagaaaagttatttcagataataaaccagttcaggaagcggctaaatccgcttccaatactttatctggacttaacgatatatctacgaaattggatgatgctcaagctgcttctgaattaattgctcaaactgtcgaagaaaaatcgaatgaaataattggagcaattgacaatgtagaaagcgcagtaagtgatactactgccggttctgagttaattgctgaaactgttgaaattggaaacaatattaataaagaaatcggtgaatcgctcggaagcaaattagataaattaacaagtttactggaacaaaaaattcagacagctggaattcagcaaactggaacgagtttagcagtagtcgaaaatgctattcctgttaaagtcgtcgaggatgatacagctgaatctgtgggtcctttattaccggctcctgaagcagttaataatgatcctgatgctgattttttccctactcctcagccaattgaaccaaaacaagagtctccagaagagaagcaaaaaagagacgcatttaacttaaaaatatctaatgctttagataaattaacaaagacagttgatttcggatttaagaaatctatttcaattactgataaaatatcaagcatgctatttaagtatactgtcagtgctgctattgaagctgctaaaatggttgcattaataatggctgttgttattggaatagacctattgatggttcattttaaatattggtcagataaattttcaaaagcctgggatttgtttagcactgattttaaaactttttcaagcgaaaccggaacttggggtcctttattacagagcatctttgaatctattgatgaaattaaaaagttctgggaagctggagactggggtggattgacagtagctattgtggaaggacttggaagtgttctttataatttaggagaacttattcaacttggaatggctaaattatcagcagcaattcttcgagttattcctggtatgaaggataccgctgatgaagtagaaggaagagcattagaaaatttccaaaattctactggagcatctctcaataaagaagaccaagaaaaagtagcaaattatcaagataaacgaatgaatgacgatcttggtccaatagcaaaaggattagataaaattgctaattggaaaacccgtgcatctaactggattcgtggtgttgataataaagaagcattgacaactgatgaagaacgcgcagcagaagaagaaaaattaaagcaactttcaccagaagaaagaaaaaacgctttaatgaaggctaatgaagcccgtgccgcgatgattcgttttgaaaaatatgctgattcagctgatatgagtaaagactcaacagttaaatcaattgaagccgctcatgaagaccttaaaaaacggatgaatgacccggatttaaataattcacctgcagttaaaaaggagcttgcttctagatttgctaaaattgatgctacttatcaagagcttaagaaaaatcaacctgaggccaaacctgaaacttctgctaaatcgccagaagcaaaacaagtccaggtaatagaaaagaacaaagcacagcaagctcctgttcaacaagcatctccttcaatcaataatactaataatgttattaagaaaaatactgtcgttcataatatgacacctgtcacaagcacaactgctcctggtgtatttggtgcgacgggagttaattaaggaataatatggcaattgttaaagaaataactgctgatttaattaaaaagtccggtgagaaaatttcagccggacagagtactaaatcagaagtaggaactaaaacatacacagcccagtttccaactgggcgtgctagtgggaatgacactacaggggacttccaggtaacagatctatataagaatggattattatttactgcatacaatatgtcatctagggattctggaagtctcagaacgatgagatctaactactcttcttcatcttctagtattttacgtacagccagaaacactattagtagtacagtatcaaaactatcaaatggattaatatcagataataattcaggaacaataagtaaagttcctgttgcaaatattcttttaccgagatctaaatccgatgttgatacatcatcacatagatttaacgatgttcaagatagtcttattacaaaaggtggaggtactgctactggcgtgttaagcaatatggcttcaactgcagtatttggagcactggaaagtataacacaaggtataatggctgataataatgaacagatttatacgacagccagaagcatgtacggcggtgctgaaaatagaactaaagtgttcacttgggatttgactccgcgctcaacagaagatttaatggctattattaatatctatcagtattttaactatttttcttacggtgaaactggtaaatctcaatatgctgctgaaataaaaggatatttagatgagtggtaccgttctacttttattgagccgttaactccagaagatgcagttaaaaataagacgttatttgagaaaatgacatcgagtttaactaacgttcttgtagtttcaaacccgacaatttggatggtgaaaaactttggtgcaacatctaagtttgatggaaaaacggaaatattcggtccatgtcaaatccagagtatcagatttgataaaacacctaatggtaactttaacggattagctattgctccaaatctccctagtacatttactctcgagattactatgagagaaattatcacgttaaaccgtgcttctttatatgcggggactttttaatgtattctttagaggaatttaataatcaagcaataaacgcagatttccaacgtaataatatgttcagctgtgtttttgctacaactccatcaactaaaagctcttcgttgataagttcaattagcaacttttcttataataacttgggcctaaattcagattggttaggattaactcaaggcgatattaatcagggaattactacgctaattacagctggcacacaaaaactgataagaaaatcaggggttagtaaatatcttattggtgccatgagtcaacgtacagttcaaagtttattaggctcatttacagttggtacatatttaattgacttctttaacatggcatataactcatctggattgatgatatactctgtaaaaatgccagagaatagattatcctatgaaactgactggaactataattctcctaatattcgtataactgggagagaattagaccctttggttatttcattcagaatggattcagaagcttgtaactatcgtgcaatgcaagactgggttaacgctgttcaagacccagtaactggattgcgtgctttgccgcaagatgtcgaggcagatattcaggttaatcttcattctcgcaatggattaccacatactgcggtgatgttcactggatgcattccagtgtccgtaagcgctcctgagttatcatatgatggagataaccaaataactacatttgatgttacttttgcgtatagagtgatgcaggctggagcagttgatagacaagctgcccttgaatggcttgaatctgctactataaatggtattcaaagcgttctcggaaatagtggaggtgttactggactatctaattcgctttcacgacttagtagattagggggaactgcaggaagcatttcaaatattaatactatgacaggaattgtcaattcgcagagtaaaatattaggagcaatataacaatggggaccgaaaggtccccatatttttatttacggaatgaaatgaaagcagaaactgaagcaactaaactgtcttcaatataaacttcaatttttaccggagcttctgactcaaatttacctgttactacaccttggaaaatactttcagtctgttctggttttgaaaaattttcagaaggaaaaattccgaactttttatctgttccaaaaattttaataaattcatcgtaaactgcttcattaaaagcattatcagcaggaataacgccttcaacgacgagctcttggcctaaaaagcgtaaagaagatttcattttgtgttcctcatgttatgtcagtaagactactataacacaacacgagggacttgtaaactacattttgaactttttagacattccgttgatgttaaccaaagaagctaagatttgagaaacttcattttcctcttcttttgattcttctacaaggaattgattaaatccagccattggacgaacttcaccagtttccattagatggtctccatcatatactgattcttctaattgttcagaaggaggaacgattgtacattcgattagatacttgttataagcagtttctttcataaagtacgtacttactttattaatcttcagtaaaattccacgtggtagaataacttcagcttctgatggaaatcctgataaatgacctggaacgataactttgattcgctcagctcctttaattaccatacccacgctagtttcagcatcttcattagcatatgtagaatgactacccatatgcatcaaatcttctgcatcaacggaaccttctccttcgccagaaaatactgcgccagaatcatctagagccatatagtttttaccatgctcaccgaagatatttggtttaagcgatgtggatacgaagttcttgaaatagaacattttgttttcaatgttatgacgcaaagttttaaaggtaacttcttgtccacgataaagcgtagttcctggaggaagaactgaacctttagcgaatgcagaatccaacgtctcgatgtgcttaatagctcgttccatatattcttcacgggtagaatctggtttacccaaaaggaacgagttcatttcaacatatgaatctgcacaataatcttcaattacatcagattcagcctgagtcagtccttttggagctacttcggtgcttgcgtattcatatgcctgggcagcagattcattaatcaatttataaatgccattcatgacaaattgaataatagctgtcttttcatctggtgtggttttagaacctttaactaaatcattaataattttcttaataacatcaaagctattagaaatattaatgtcagcaagatcgcttaaaattttatcagttttataatcaaagaattctttattctttaaatattcttgagaaccttgatatgttatatcgctctgcaacttgatagatggatcacgtaaacgtgcatgggccaatgcaatatgatttcggaagctttctagttcataatcgttagatttaaaacgagaagcacttctcataccaccgatagctcctttgctgaagtttgaaccaatctgaataacgccagagttcattggtccttctgctttatataccggaactttagattcaaactcttgatatttcttggcagcgaagctatcaccctgtagcgaagcatcgacagtagaatattgagcttgtgctgctaatcgacgactaattttagttttctgaataacagcttgatccgtgcgcttatcattttctaaggcaatagaagcagcaacagcaacagctttaggaacagcattacctgttttaacatctacataaacatcaccaacctttgattcaacttttgtgaataactcagttgaaataggaggtacacctggaatgtcttctaaattggcatttttacggtaaaccataatatatgcatactttttatcatagtcccagatttcctttaaaagaacatatcgacctgctcctttagtacgtactaaacggtcagcaataacttgcatttgacgagcagcgccatttgttttactttttagtacgcggaataagcatgcgtcaattttatactgtttcattgtttgaagagcagtatcaaaaacagcattaatgacgccaattggatttccacccaagtttctaagcttaaccagcgataatttctcgttgacacctatcattacgatatgcatcattttatcgcctggcttaacatttttatttgtatcaccaccagaggtgtatgtacaaaatctaaatccaggaagcacgctttcttcgccggcttggatagcaaaaatttgtggtattttatgcttaggatttaagttaacaaccggcgccgaagcgccgtcaaataattctgtaataagttccatgatttatccttgaacgaacttgtaaggcatgtttgtaatatctatgcaagacgcaataattccaagagatgattctactttctgtttaacatttgatgaaacaaatgatgcaaagtcaactctatcttctatatcacctgtcattgtaaccaattcaccagtttccattaaatggtctccgtcatagattaccgattcggtgagttcttctgtggtcataacttcagcttgaataagcttgttgttagttttaactgttccatcattgtaagatgcatcggttattttattaactttgaccattaatccacgtggcaaaatgacttccatttcatttgaaggcgctaaacttccaccgggtaaaacaacattgactttatcagccccggtaataacccatccaattccaactaaattatcgctagaatttactagtccttcatcagttttatcaatagaaacacttagacgcttttcgtctggtaaaacacctatagatgaatcagtcatccaagtaccaaaaatatttggatataatgatgttgacacaaagtttctaaaataaaaaactcgattttttaccattgcttcgtatattgaaggtaacattcgttgtgaacgatacaaagtaataccttttggtaatcgttcaccatttttaaaggctgaatctaaattatcaatagctttttctatgtcagatgctgtcaaaatacttgtacgctcatctggattatataatcccaaaagagcattatttatgtctacatatcctgaacctacgtattcacgaattccgcgtttttgtgctggtgtgtatttagatgaatctttattttcgactataggatgtaatgaccatccagctgtaagagcatatccacgtaattctcttcgaataatctttgtttttattgcattccaagaattttgtactaactcatttgcagcatcttggtttaaatgcgaatgtttgttaatatttctttcaaaccaagcacctttatatttttctaaagtatcatcgacgatagaagcaatagtttctaaagtttttattgaagtaatagattcttttcgtaatttttctaaagctttattttttatttctgcattaataatggattctttatcttcaggaattatagaagcttctctgaatgccatcccagctgtaacactgctaagagcattctctagtgcaaatcctgaagtagaaattaccgttaattcattagaatcagaaattaaaggcgcgtccgctggtttatttaattctgccgctgaagcctcaaatttttgaaacatcggtgtttcaaatctagaagattccaatgactgactttgtgcaattgctctacgggaaattttaactttaacgattacagcttggtcagaacgtttatcattttcttgtgcaatagatgctgcaattgcctcatttttggttacttgagctccggtatctttattgatataaacatcaccgaccttcgattcaactttagtaaagagctcagtactaatttccggaactcccggaatgtcttctagtgatacatttttgcgatgtataagaatatatgcatactttttatcgtaatcccagagttccttaagaaggacgtatctgccacctgaacgactacggataagtctatcagcaataacttgaatttgtcgagcttgaccagcggttttagacttaagaatacgaagcatacaagcatcaattttatactgacgcattgtttgcattgcaacagtaaaaactgaattgatataattaattgggcttggaccaagaccttttaatttagcaattgaacctttagcagttaatgtaaaaggaacaatatgcatcattttatcgcccatttttaaatcgcgattagtatcacctccagatgtataggtacataaacgaaagcctggttgttcaattgcatcatcaacatgaactgaaaaaatttgcggtattttcttctttggatttaagtttgtaatcggaagagtagtatcttcgtcaaataattctgtaataagttccatcatagcctctctagtgtttattctatttataaaattaaaggcccgaaggcctttagtaatctagtggtaagagagtacgatatatttcaaactttggtcctttttcataggcatcaaatgtttctgtaaatttattataagcgtatgcatctacaaattcgagaatgacttgtgatacagaagtagaaacatctccaccttctttttgagcaatgacaattgtttctaagtaagctttcataaaccagttacctcatgaaaatcaccaaatacatcctcgaatgtattagctttagttttatcttcacgtaaacgaatcgcaatcggaagaaataatttaacgtaatcagtgcggccatcagattttaaccaaccgttgcattcgcactctagaatttttccaatataataattttggttttccataatgcgagtacggtcaagttcatgtgattttacgccggctttgtcttttaagcctgaaccagcatttaccttaatttttccacactctgactcaagaataaatccacctgctttagtagggtctttacggtgaggataaattcctacaatttttaaatcaacatcaattacttctttaaatttatagagattttttgaacgagcattttcccataatccatcgatatttttgagaataataccttcaagaccttgatcaatatactttttataaattaccttagcttcatctaggttatttactacctggttttcaattaaaattactttatcataacctgatgtcatttgttctagtttagaaaaacgtacatcatatttcaaacgaaatgcaggaagaccgtatatttctaccaacgggacataatcccagacctgaaacttcatgcattgagcttctttttcagaaatggttccctttaaagatttattggcgatgccattagatgcagtacgtgattcagctacttcggcgaattctttagctttactaatttcaggataagcatcaaaaagaaaatctaggccttctggctccttttcaacttgctcatggtataccaattcgccatcaattaacacaccttctggatgaatctggcgagcttctgcagtcattttgattaactcttccttaagaagatctaatcctagatattcattaccagctcgtgataaaagacgaacatcatctaattcatcacctctgacttcagcaaagcaccgagctccatcagcttttaattgggcaaaggctggaaatttgatattcttattaatgcctttttcatcataagaacttgccagcatttgaggttgttcaggaattaaacctggccaaactttgtttgcaatagatactgaagcaccacattcaaggtctcgcatcatcacccgacgcaaaacttcaacatcatcttttttaccgtcagtaatatatccagttaattcctcaattgccgcatttccagtcaatttccgagtagctaacgtgaattcaatgaagtcaagcatatcggtaagagtcaacattccaaaactctgggtagcaatacccggtttaggccatttcttgatataatactgtaacccacgagaataagtcagacgatatactcgtttaagcaattcattatctttattcttttcaagaattgcttgcttctgcttagttgaaccaatagatgctatttcgttcagaattttaagaatcattgttcatcctttagagtttggtttacagctctattataaatcaattcatcattaagctcagtcaaagacctgtggtacgtggttctaactttatttccttgcatccagtgcttgacgtaaatgaaaccttgctctacacattttttaaaaattcgttcgtctttttgagctcggaattctggattgcatctaaaaaattgatttacgtgaccgtaatcacgtgtagtattaccttcattttcataaatagtgtgaacaacaaacattagaatgctccttggaaaatattatcaccactagtaggtctattatacaaatactctatgccaccaggtttaatatagttccatgtctgaaacggatgtgtctgatatggatgatatagatgattataaggattaaatccaggagttctccaggtagtgttccaaggaaaagaatcgtttttgatcatcttctcgattgcatcttttatagctttttcactatcaaagctttctttattttcctttggtgaaaaaagcttattctctacatcgttccatgtataaactcgctgagcagtttttgaaatattgtcacgctctcctcgagccatccaataaacaggaacatttaatatttcactcgcgtgatcgcagtggtgagcgagatcgtcaatataacaaattacgttatatttctcttttgcctttttgaacaactcttcttttgaagaatcatgaccacacatcattacttctgagaaggcaccaggaaaaagagcattcaaattaaattgacgattcagcagagcgtcaatagaatcacccagtgctgtaacagctacaaaattataatcttcttttaatttgttaattacacacagagcatctttatatggagacaagtaacgaataaaatccgaacgattgtatttttcaattaacttgacgccaagttcttcatcacaattaaaaagtttacctggagaaataaatttctcatcttggatcatttttaaaatatgttccaacggaaggttatatttctgggcaaaataaggaaggcctgattgccagcttaaacatactccatcaatatcagttaaaatagtaggcttcatagagagtctcttaataggtttaacacatcaataaattcagcttcggttagtattgtatcatcttttgttagaccactagccatgctgtgcttcaaaacttttcctttcgaggcttgtaatgcatcgcgaaagcccctattttggatcgctgcttcaaaatatgcatttgtgtataattctttccacgctggggagtatcttgaaaatggaactccaagccagaagagggtcccacggtcctgagctctagcataagaccttccagcttgttgggcggcaagcccagataacccaaatatacgacgttgttgttcaacgtttttcaccttgcatccttggaggaatccttcaagacctccaaattgaataccatccataacgaaaggccaatgggcgaaattacttaatgcgcatgatggccacctaaaattgcttctaatctctaactcagacattttcaatgcttataatttcaacatcagcccaatgaccatagcaaggaagacgaaattcaactggccagttagggtccttttctaatataatagactcaacttgtggttcttcgtgttcatcagtatacggatttttatctgttactttatatgtgaccttaatgtactgaattccaaaaatcttattaattatattcatactaattcctttaatccgtagataggagataattcatcacccatacgaaggtcttcatttccatctacccaggaaacaatataagcctcttttacttgaacatctcccaatttaaatgcgggtaaaaccttagaaattaatccaggtataccaactccctttaattcaacagtttgacctaaaaagaatttcattagaacctcatctgaaacccatgtgatttaacattaccgccattaatatcagaactattaatttcgcgtgcaattgagggatcaatgtcaatttcacgattgagtttagcgatagctagagtatcacgcccatttactgtacggaattctaaaggacaaaccacatcaacgtagtttttaatcgattcgctagtaggttgcaaatgtgcaggaaggtctttaggtgcctttgagaaaacaacttcacagaaatttttgcgggtatcaaaataagtagtcataaacataatattttcctcaatagggggggggccgaagcccctgttttattttaaatatcaaattcgttaagaactacatcaaagattgcttcaagatgctcaggtttagctctgttactcaaaatatgacgaatccaagttttaaccagaagcttacgattagcgccattccagcaaggatgggtccctaaatcgcgttgacgaaaatcatcatccagagcgattttgaagtttgaaccttccattgtgattgaaaccgtgatgccattttcaaatcgcatataaacgtagttaggagtcatatactgttcaatttcgcatactgatccattttgatgtttccaaaggcaaatagtatcaatagaacttgcaataccattagaaacatatttacgttcaaagttgatgtagttcatttttattctccgagatgtttaattgcggtacaggtatataatatcatatcctgtaccaaagtaaacaattattttactactttccagtgcttcatgtcaagtttaccaacttttttcatcttctcaatcaaacgttcggcacgttggcgagctgtaacataataccattcgcctaattcattttgttcaatttttccaacgattactgtattcaattcataaatccaaccagtaaagaaattatgaacttgaattgtaaaggtgaaatctgttcccataccttctgttgtttctacttcaataatatcaccttcaactgccattaagaaccacatagtttcatcatatttaccattgaagcatttagtcttaactgcagcgttcagattaatcgttttcattttattctcctttgtttgtgtaagataatactatcacaaaggaaccatactgtaaacaactttatgcaatctttggaaaataaaaaaggactcccgaaggagtccttaacttatgctttctgcttaccaaaacgagaagcatcatctcgaagaaccgcacgtgctcggcgcatgatcttctcaacagtttgattgatacgagagttcgacccacgcttgtaaccagcgcgtttagaatcaccaactttcttttcaactgctttctttgctttaacttgttttgccattataaattctcttttaaatgaaaatgcaggacttattggcattgcctgcgcaagccctcaagggggaacataggttttgtatatttaccgacaggataaccataaacctcgtcaacataccaccaagacttacacagataacacttttctgacgcatgatagtaacattcaagaggtacaccataaaactgccggggtcttaaaactataatgattcgcaaatcattaatcagacagttcgatggctcctcgattttagctcacactaaggcagtgaatctccaataaattacttcagtgttaccacaaagtgacgaactgcttttcgtgcagcagaagccagaggcttagcatacttaagttcatctttttcctgaagctcagcagctaatgcagtttgagcaggattcagatgtttgaaataacgcaggatttcaagagcttcggcttcaacatcaatagatgcgccatagttttcgtgaccattattccatgcgtttcgttgcagttcaagagcgtgttgtaattgtttaatcatttaaaaattctcgttagagattaaaactcggtagtcacgttcttctgaatttcatcttctttcgacagatctctcagttgtagactaccacatagaattgttcggttaacttattattccgacacccaattcatattattatttatatcacttataaagacacggaatagctttatagtgacaagtaacgaatttttgtttaatttcttttggctgcttaagacccagagctacaaaaggatgcggaacatttcgaatttgaccaactggaagagaagtcaaatcaccaacttcgcagaaaccttcaggaacatcaggaccgacagagtgaactacacacagttcaggaacttcaccttgaacacgtttaccgataataagtcctgattctgtaacttcttcatcaccggcttgtgcgggttcagaaactaaaataacatattcaccgacagcacgaattggtaactgttgtacttcagacatcgtttttcctttttgttaacagatgaattaataataacaaataattcttaaagcatttatttaccaataaattggagtaaatgctcaactttcataccattaacagaaatcaatttgtcaatagaaaaacctcgccatgcaccaagttcaacatcaaatactggaatcatgtcagtagattctttccgagtcgattcagtcaatttaccagtttgcatggttggcataaagtcagcatcgcgagtacctttcatagtacgaatagtaccatcagacttttcaaaaactacgtttgaaacacccatggacaatttagttttcaaaatttcacgaattgctactttctgttcagttgtcagtttcatttatttacctattacagttttaatatgagttgttccacgttctttaagggtggaaagtaatttttggcatttttctaaatcagatttccaactatatggtctatcaatactagtccaatcagttttataatactgtttccatttagagaaaaaatatttcttatactctacagcaaacgagatgttctcgttagaataagaactaattgctgtaagctttaccaaacgaaatttcattattcaccacagaattcgttgatattttcccagtttaacttattcaagtttttcttaggaacattaaacacttcaatacctgcatttcgcagaatatcatcccagccaggtttatttttatcgtatgtttcgcaataaaccagttttttaattccagactgagctatcgcttttgcgcaatccggacaaggagaaagtgttacatacatagtagcaccttcaattgaagaaccatttcgtgcagcaaacaaaattgcatttagttcagcatgaatttcatttttagatgaccattccgagtgagcgccgcggtgttctttcgccaagacaaaacgatcagttgaaccaaatgatacacattcaggcttatgaccttgaatgatagtatgtttaggtttattcagcaaccaaccttgctcagcagcataatcacaacagttcacaccccctgcaggtgaaccattatacccagtagaaataatacgtccattcttttcaattactgctcctaccttccaggagcaacattttgattcctgcgatactaaatatgcaatttgaagtactgtactcgctttcatttcataatcaccagataagcagatttagcagtttcaacacgataaatttcgtgacgaagtttagttatacttttaataacagaactaattatattctgcccatctttaaagcggtttttcttatcaataaaaattgcgccaaccatctttttgtgaagctcaactggatacttcgtcacaataatagcatcatacacagaaggatgaatactattcactagagtgtcattcattaaagttattctaatgaactgtgctgtttcagagtcaagcgctttatgatcgccagtatcattttcaagacaattatcaattatatcagttaaattcatcatagtacgccatacaccctttgtgcttcaactaatccatcaaaatccagtttaagatgcgatatttgatcgccatcacctggattcacaattactaatactgaacgaggagtttcggtaataacacgaaccgacgtttcaggaaatcgttcagaaaccttatttactaattcctgtgcaaatagtttaactttttcttggaattctttaacagtaattggtttttcacttagcatgttgatcccagctccttactttcaacgtttttaactaatttgacagaaactaattcagcatcttgggtaatcattaccgggccttcttcatactcttcaagatattctagagctttctttttagcttcttcctttgtatcagtttgagcatagatataaaacatgcaaccagtaatacctactactttccacttaatttctttatcagttttaatttcaaatttactgacagaatcatctttttgaacttcttcgaaaaaagaatattctaacatataagcaattgaaaataacgggctaactttataggattcgcccattacatcaacagctttataccaacaatcatcaatttcgcgtttaatgctaataacattctttgcagggtcaatttttactttaaatgaattttccccaataaactgggcgattcgtttattagccccgcaagtttcattaaaaatatctttatacccagttttaaagcgataaaccttatcttcttcaaaccattcgctcatttcaatttcctcatttgttttggtagagctataatatcacaactctaccgtaaagtaaaccattaaatcgctttgaattccgcagtttgagattcaaagcgaatgtcgcctttgataactagctcagcatcaagaccgaatacaacaatgatatgcgcggaacctggatacaacgtaatggcaatagaatccacctggtctggaagcaaagtgttcaatacatgagtcacttgagcgtggattcgaagctcagctgcgttatcaagtttttcaaacatattattagcgataatttggctaaacactacttctacgattttagagtaagtcggaaacatatttacctcacataattttcttcgagccaatcaataacatccaaagcgttatcaaaagttgcgccatctactttgtcttctgtttcataatcaagaacatctaggcctactcttccgtcaacaataggccatagacaaaatagatatttcttttctttttcaattttatcacaaagacgataaatcttttctaggttattcatacgttttccatggtaaaggcagtttagttttctttactactagttcaacatcaggattcttttctcttaatttaaggcattcctcccatgctctattttcactagtaaatacacaaaattgcccattactagtaccgactaaaccactatttacaataataatagcccaagtttcatgatgccacgccattaaaaatctcccgagtcaacttgccagcattcaacaccgatgcggcgccacatttcaactacttgagttcggtcatcaatagctaatttcacgtcaaactgtggtgcgatgtgtttccagaaaatttcttctttaactacatcatctttacgggtatcgccttgttcgcgttgacattgcataactaatggaacaccagcaatgtcctcaacccatttacgggtcatacgataatattttgttgggtcttcttcggttccactttcacggcccgaaacgactacgatgtaatatccttgcttatcgtacatcttagctagttcaacgaccattggattaataatatcggtatcacatttttcaaggtcataaggaccacgaccattcatttttgctaatgtgccatcaacatcaaaaataactgcttttggtttaccaggagtccctttatataccggaagtccgagatattcccgcatgcttttatacattgaacgtaaaacatcaattggtactgctttagttccacgttttgagttacgtttaaccaattcagtccaaggaacatcaaacactttatattcaatttgatgcccaagctctttggcaaactcttcccagaccttacgtcgttcaggattcagattagtatctgaaacaattacacccttcgttccgtcttggcagagaatcatatgtgccgcatcgtgttgcatataagtcacgatgctttctttcttcttggtgtatttgtactcatcacgttcttcgtgtgccataacagactggcgataatcatcacgattaatattataaaacccaggattcttagcaataaattcacgagcccaagtgcttttaccagaaccaggacaacctacagtcaaaataatctttttcatcatttaattcctaagaaaacttcaagaatacgaatattatgctcacgccgtcctttgtacaattcagctgttgattgattcgctgatttactctgaacattggatgaaataaattttatcatgtgatttttaagctgatacatatcaagcccacgagctttcgcttcttttcgcagggctttaccagcatcatctaaagctttagcatgttcaatatcttggctaatgcttgatacattttcacggcatgcatcaatgtaacggtctgaacattcaatataacgttctaacagagttttcatttatttttctcaaccaatgattgaatataatcatgcaggtctttagatgctttaccccacttattttgatattcatttttgagattagcgcgtgattgagctaataaaacatcattagttggaggtaaagattctaatcgttgaatctgtcgtccataaatcattgcagccatctcggattcataaattaatccttttagatgttcaaattgataccatgaaatcatttacatttatcctcttttagctcttgacgataataacatatcatagttttctggtcatgtacatatcgttttacatcattaagccaaatacgaaattcctgagaatcttcaaatggcataccgacccaagctttaccatcaataactttaacttgccaagatagtttagcttcatcatatgactttatctgtacaggccaattaggatgaactgtttctttctttacttctagaggctttgtcgaacaaccagctagaagaccgatagataatattactgctgatagtctaatcatttagaaaggtcctggatgtcttctgcgaacttgttgaaggagttgttgatttgtttttcaaccaatcctggcttacgagccaccacatccgccttctttgcatctttgcgcagtttttcattttcacgctcaatagcagcaatcgcctcacgatttttattattcatcgcatcaatataattatactgaattcgcaaattatttaatgctaaggcgttttcattggccgtttttgtaatttctacaacagacgtttctaatctttcaattttattttttaaaattaaagaagttccgcctaatgcaattacaattaatagcaaacctgctgtcgtattacttaattgcataaagttttaataacctctataatatcgtcttgagaaagaccgttaattaaaatatgatgttcagccggagatttagaaattttaaagcatgcctcaacatcttctgccatatccgatgcgctacgatttggattactaattccaagacgatgttttcccgttaaaggattaacgatgatatagcatttacaactattgatatgaacattaggttgagtctgattaatgaacacttcacaatcatacttagcgagttgattttctaaaaagactttcatctcttcaaccgcatcaggaagcatatcacgggcttgctcaagacgacgattttgatattctttaatggtcgttttccgcttgacttgcttagctaaatctttcttaagatcagtgatatatccaactcgacggtttcctttaaatacagaaatcccatctgtagtatcaccgtatgcttcaacgaccatttcagtagtaatgagctgcaaatccatcataaagtcctcatgttatgtcagtaagactactgtaacacaacacgagggacttgtaaacagcttagtatccttctgggataaattttttataatttttcaaaaaattctgttcgatttcacacataaccttctcttgactatcatacccctggtataagctcatgatgataccgaacaagtgatccattccagcacctttagcaacaccttgtgcttccattgcataagtctttctatctttaccacaatgcttattgtgacagtcaagaactaaaaacagagctcggtctaagtacttcagataagtcgtttcaaacgcctcaatttttctgtatgaatattcatcgtcagcgtacattgctttaagatcatctgatgcaccgtcaataatagtcttaaacaatttttctggattatctaatgaactttttgtactatgaagagacacataccagtcagacttaattttaaaatgagaaccatctttcatcacagcaacatagccttcgatgttttctgcatttttagcttcttctacccatttagggctatcgatttcgaatcgttcaactagatatggacgaagagcagcatctttataaatatcatcatatgaaatgtattcgcctgtttcattttcacgaatattcaataagatgattttcatctcttgataagcaagaacgattctattcgttggagcaacgaattcaaagttagcagtaaatccatcttcagctaattctttaagtctatcacgcaaccgatggtgattaatattcatcaaaataccattagccattaaagcctgttcggatttgattgaaccctttgatttgaacagaatttcatcaccatctaaataagttgataccaaagacccatcttcctttgtcagaatgtaatcaacatcatttaaatcgatattcatcgtgaatggattttcatttaagttaaaaaacttttccataggacgagaagcaattcttactggtttttctccatccatttcaaacatgattccacgacattccaatgcgtctggaagtaaccaatcagaataagatgcataattatatgagaaaattctgtaagttcttccagatgcacttacatcatccgagtaaaaaaacttacgctgtgaatccttacatagttccattaaattgttaaaaagttcttgcattgtgtatcctcttttgtgttttgaatatagtaccacactccatgtggaagcatcattttttcttgtgttgaatattccaaggcgggttaaacagtttaatgaatagcggctcctctaggtcaatcgttgcgattgtcattgtacctaactcatttgtcatagaaagattaaaacattggcgggcgtaaaattcaactttgcttccttcctttagcgcagcatgaattaatgcagatttagtagaatcagacgttttgtctttacgattaatagcagttctataataatttattcttttacgtaaatttttagtttttccaatataaacaagctcatcatttatagcaatagcataaattacgttatacttgtttggaatagatagttgttttatacttccgttgtcgtctaattctaactcagtatatttaataaatgaatactctgttgcaatttctttcataataaaatgggccttgcggcccactccttaaaagtattttttaaaactcatcataactttatcatcaacatcattatcaatctgtgcaacaaggtaagatgacaattctacttcttgtggcgcagattgaacattatcagaattaagatattcacgaatccaaggatatggatgtttaaccggagcatcggtaattgggcatggaagaccacactgcttcatacgagatacagttaagtaatcaataaagctccacatgctatttgtatttaatccaggaacatctccatctttaaataaatgaactgcccaatctttttcttggcggttaacttccatgaaaatatcaactgcttcttgttcacactcttgagcaattttaacccattcatcgccatcagtgccaagttgaagttgacgaataatatattgggtgcctttaagatgaagctgctcatcacgcgcaatgaacttcataatcttggcattaccttccatgatttccatgttcttatggaagttaaaagtgcatgcgaaagatacataaaaacgaatagcttctaaggcattaataacgtgcaaacagaggtaaagagatttcattaaagcacgtttagcttcggcttcttgtttaatagctcggtttaaacgaaagtcggcatcaggagattctttagatagttctacaaattctttaacattttcccattcacgagttttaatcagaacatcatcataataacgtccaatggattcagcacgtttcataatagcttcatctaatacaatctcatcaaataccttcgatggatcagtataaagatttcgcatgatatgtgtatatgaacgactgtgaatagtttcactaaaagtccatgtagcaacccacgtatcaaggcttgggtctgaaattaatgacataagtacagcagacggcgcacgaccctgaatgctatccaaaagtgattgatacttcaagttgttagtaaaaatattttgctgatactgaggaagcttattaaactgtgcagcatccatcattaagtttacttcttccgggcgccagaaaaatgataaggacttctctgtaagttcttcaaatactcgatgccgttgaatatcataacgcgcaataccaagacctgaaccaaaaaacataggttcttttaaaacatcaactgggtttgtattaaaaactgtagacattaatttttcctctttaaaattctgccgcgtttccaacctggcggtataatatcatctttacctataagcgtgcattcacttccattattaatccatttcttaccgcggattcctttataatctcttggttgtattttgtcaaactttgcatcaagttgatatgcccatcgaaatccataggcatattgaaatttaccctcagcacaatatttgatatttgacccgtttccattaactgacctggacgctgcggcaatagagtgaaaggtttctatgaaatccccatctaatgagaatttatgtatttcgatagatgggcatgcatacctattcacgtttgatacatgttgtttagtttcgtttttatgatgcttgcctaacattcctctaggatgaggattatttttccaatatttcttaaagaaatcagaattagctttagcaaataattttctgtgcaagctatacaatctgttattaattctattaccagctttatctgttgccattaacgttaacgcagaggcaagaccaaaatggccttcatttatcttgcatagtaatagatgcgctataaaatgttctctagctgttaattcaactaaattttctttatcatcagaacctcccatgcatttagggactatatgatgtgtctctttatactcggataaatgttcccgagcctgagctcgggaaattaggtcattatagattttttgataattcattacaatttacacgctgcacaatcgtcggctttaggagtttctatttcataatcatcagtaccagaaccatcacgggtattatgataatagaaatttttaatgccataataccatccgtataacatgtcatcaatcattattgacattggaacctttccttttggaaaaatctgcgggtcatagtatgtattcgctgaagctgattgacatacccatttcagcataatagctacctgcgtaagataaggtttattacctttcttagctaatttccacgtataatcatataggtctatgttatgctcaatattgggcacgacttgattaaaggagccctcttttgattctttaacagagactggtccacgtggaggctcgataccgtttgtactgttagaaacttgggaagatgactcacatggcataagtgctgataatgtgctattacggatgccaaagagcttaaggtcttcccgcagcgccgaccagtcacaaacgtattttggagatgcgatttggtcaatctttttattgtaccagtcgataggtaattcgcctcgagaccaacgagtgtctgaataatattcgcaaggtcctttttcttttgcgagcttaatggatgctttaatgagtccatactgtaatctctcaaatagttcatgtgttaaatcattagcatcttcataagaagcaaagttacttgccagccaagctgcatagttggtaacacctacgccaagatttcgacgctttttagctttttctgcttcaggaaccggatatccttggtaatccaaaagattatcaagagcacgaacttggacttctgccaattcattaattttatcttgatcttgccaatcgaagttatctaacacaaatgcagataacgtacacaatccaatttcggcatcaggactattcacatcatttgttggaatagcaatttcacaacacaagttactctgacgaataggtgccttttcacgaataaatggagtatagttattcgtattatcaatgaactgcacataaatccttgctgttcctgagcgttcagtcatgagcaattcaaacagttcacgggctttaatacgctttttacgaatattaggatctttttctgctgcttcgtataattcacggaaacggtcttggtctttaaaataagaataataaagttcgccacccatttcatgcggactgaacaaagtaatgtaatcattctttccgaatcgttccatcattaggtcattcagttgaacgccataatccatatgacggatacggttttcttctacgcctttgttatttttcaaaacgagaagattttcaacttccaaatgccaaataggataataagcagtagcagcgccgccacgaattccaccctgtgaacatgatttaacagcagtctgaaaatgtttccaaaaaggaataacaccagtatggcgtacttcacccatgccaatcttagaaccttcggcacgaatcataccaacgttaataccaattccagcgcgtttagagatatattcaacaatcgaagcggaagccttattgatagacttcaatgaatctcctgcctcaataacaacgcatgaactgaactgtcgagtcggagtacggcaaccagccataataggagttggtaatgaaatctgtcgagtagataccgcttcataaaaacggataacatgttttaatctatcaacaggttcatcttgatgcaatgccattccaatagtcataaatgcaaactgtggagtttcataaatttgaccagtggttttatctttaactagatatttttcttttaattgcatcgccccggaataagtaaattccatatcccgctcgtgcttaatttttgattctaaaaatgtaatttcttctgctgaatattttgacaataattcagggtcatatttaccttcatttacacagtaagaaatatggtcaataaatgaacgtggttcatactgcccataaacatgcttacgaagagcgaacattagacaacgtgcagctacatattgataatcaggctcttcaaccgaaatagaattcgcagcggccttaatgacaatagtctgaatatcatcagttgtcattccatcacggagataagatttaatattttcatataattcataaggatctactgatgttccctcagctgcccaagataaaactttaataattttttgtgggtcaaagctctgagaaacaccactacttttgataacattaattaattgcataagtcctcaacttgaaaatcgtctttaaacaatcggttaactatatgagctattatatcaccatgacacggctttggtttacatgtgcatcctagcctcattccacgtaaaggctctaaatgtgctttagttatttctccggatttaattcgacgtataaaatcttttttgaataattcaatggcagcctcccggctgccagcatctttaccgacgtaatttccccaaaatgtaccacggtgaatattaacatcaaagtcggatttatatttattcactacctggcatagacggcccgcgcggtgataattcgtcatattgtttttccgttaaaacagtaatatcatagtaacaatcagaagaagttttaactgtagaaattttattatcaaaatactcacgagtcattttatgagtataatattttttgccataaatgataataggctgatttggtcctggaacttctagctcacttggattaggaagtgtaaaaagaactgcaccagaagtatctttaaatcgtaaaatcatatatcctcgcaataataaaattataccgccatctttcctttaattggcgggtgagatacatagtcgttaagaacaaaattatgcggctttgcgaattgactcaaccaaaatacctgtgattctgtgtcccattcatcaaattcatctgggaattttaattgtaattcgcataaatccataggttcacgacgcaaaatttctttacattgttctacgtgattcatatagatatgagtattaccgccagaaaatatcaaatctcccggaataagattacatatcttagctacaatatgaactaacgcagcatatgatgcaatattaaatggaagaccgaggaaaacatctactgatcgttgataccactgaaggtcaaggtatccattacgaacattaaattgatagaacatatgacaaggtggtaatgccatctgcttgagttcagctggattccatgctgaaacaatttgacgcctatcatttggcagttttttaatacgatcaataacttctataatttggtctacaccaccgaaatcacgccattgtttaccgtatataggaccaagttcaccactatgatatcctaaatcttttgcttgattttcgtaattttcatcccagactgttttgccttgaattaatgaatcgtgctgaattaatcgtaaatcattgacatttgtgcttcctgataaaaaccaaagcagctcagcaatgcaagctttccaggcgagcttcttagttgttaccgcaggaaaacctttagttaaatcccagcgtaatttagtaccaaacaaagcaattgttcctgtgcctgttcggtcatcggtttcatagccattttcaaaaatgtctttaattaaatcttggtattgtttcatttagtaccttatataaattataatacattttatgaagctaaataatcaatacggtttagcatcaaattttctctcaatttcaggcgtgaagtataattctttgccacgtttggaaaagcgaccaataatatgataattattctcatcaaacatgatattaccaatatccatagctttcaaccaaatatcgatatttctatccagctttatgtcaaaattccaatacggagaactattaccgaaaatactgcaagcggattcagtgaaacaactgctataaatcttgtctttaggaactactaattgatagacacctttaataaactgaggaccctgccactttggctgtttcgtgtctttttctaatagaatagggtaataattaaaattcatatttccgccacgcgttatttcatttatatactgattctgtaagggttgttacttcatctattttataccaatgcgtttcaaccatttcacgcttgcttatatcatcaagaaaacttgcatctaattgaaccgttgaattaacacgatgccttttaacgatgcgagaaacaactacttcatccgcataaggtaacgcagcatataacagagcaggcccgccaattacacttactttggaattctgatcaagcatagtctcgaatggtgcattaggacttgaaacttgaatttcgccaccagaaatgtaagttatgtactgttcccaagtaatatagaaatgtgctaaatcgccgtctttagttacaggataatcacgcgcaaggtcacgcactacaatatgactacgaccaggaagtaatgtagataatgactggaacgttttagcacccataatcataattgtaccttcggtacgagctttaaaattctggaggtcctttttaactcgtccccatggtaaaccatcacctaaaccaaatgctaattcgtcaaagccttcgaccgttttagttggagaataagcgaataccaatttaatcattacgcaaaacccctttcaagaaaccattcagtggctttattagcatcaaagaataattcttcatatgtcttttctttgttttcaaaaactgtcacacaaacacgttgacattctccacagtattcttctgacatactcaaagcgtcagaaaacatttcattaaattcacttaaatcaggattatgcaatgcgttaaaaattgcataatcgaattcatcattcataaattcaaatacaaaaatcatattattttccttaaacagactttttcacaattttccaatcagctttaaactgctcgacgtcagaatggtaaatccagaatcctgcgctttctccatcctcataaagaggacatccatcgcattcatcttcccatcccatatcacgtaaaagatgttcagctttttcaacaagttcagaatctttaccgatgatattaaaataccatttacctctaacttctgaatctttgatgctttggcgttgtaatctcattttattctccttaattgatagggtaatagtatcacgctactacccttctgtaaactactttttgaaagtttttcgcaaaagttcaatgatttcatctacattgttttcgtcaacaatgcagtgaatttttgttacgccagaaaccgggtctttgacttcatctttttcagaagtcggttctttatactcacgaaaacaatgaaattcgtcttcgcaaatttctaaaagtctatctttgaggtaaaaatgttttccatttgcgcattcaatgtgttttactgctttatatccattagcgacggaaacttctttaacttcaaaccatccgccattctctcgaatggctttaactattgatgaattagaacgtgggctataattaataaatgtatcaataagtcttggaacaagttcatactttttaccggtatacattacggtttcctcattttaacggggctgtaatagccccttgataattattgttcaatcagtcccatgtaaaattctgcgtcttcagaatccatgccatcacaatattcattagccataaagagggtgaggtcttcaagaggacctttaataacgatttgaatactccaaaacttagaatcttgcacgcttgtgatactaagttcaggataacgattacgaataatctcttcaatatattcaaaatcaacgatgtcaatatcaactttagccatattattttcctctttaatcatcagcagtattgccgatagttgtatagtaccatggaaggacaaggatgtaaaccgttttgtgaaaaaatttttgaaataaaaaaggggacctctagggtccccaattaattagtaatataatctattaaaggtcattcaaaaggtcatccaggtctgtgtcatcagcactagatgaactgccagagcttgagctcataaaatcatcttcagtttttgtattgaagtcatcaacattgaatgcatccaaatcatcagcaactttatcggctttcttagcagcagttacagcagcaccgcccatcacagcagttcccataacttgaccgaatttagtgctcagttcttcaaacgatttgaatttatctttagaagtcatttcagaaaggtcaaccatttgttcgaacagttctttctggaaagattcatcatcaatgtttggaatcgcagattgattcaggaatttagattcatcgtagttactaaatccggaaacttgtttaactttcagtacaaagttagcaccttcccacggacaagttacatcaaccggagtttcacccatttcaacatcaactgcaatcattgcattgattttatcccagattttcttaccgaaacgatatttaaatactttaccttcgttttctggagcagctgggtcttttacaacaagaatattagcccagtaagaagttttacgtttaacaagactgtactctttattgtcagtgttgtacagatcatttttactgatgtactgacatactggacaagaatcgtaatcaccgtgggtagatgaacagttttcaatataccatttaccgtttttcttgaaaccgtgatttacaagaattgcgaatggtgcttgttcatcatttttagacggaagaaaacgaattactgcttgaccgttacccgcattatcgagtttcagtttccactcgcctttatcttcagaagaaaaaccacctttatttccagccagtttagccatttgtgcagcgagttcagcagtagatttacgtttaaacatttttatttcctttttaatttaattaacagttggtgctatgacgatgtatgacctcatagctggtcagtgagataattataatctatttataataagcaattaatacttgcaagatttcacagtttcaatgaaaacatttttagctttctgtgaatcaatatttaaaatttttctataagcttttaactttatagaataattgttccaaactaaattatcagtctgttcatcatgtttatcgattatatttaaaaacgaatcaagcaagataaacgtctcaaacgaaattatattcgattgaagtagtttaaaaatataactcgactgaacttttggattatactcaaagatttctttaaaagcagaaacttcaacttttttactaaaataatagatattcctaatatcttcttcaaacttaaatttaatttgctttaagcgtccgatatattcacgataaaatactaatgcatcagcgtcagagatatcaccaatccaagcatcttggttagctacaagattgctaataaaaattaaagttaattcttttaatttatacttttctgatagcttttggaaaaaatacttatcccttcgcttttgataagcggcatcagacacccgcatgcaccaattatacttaataacatcatactttccattcatatgttgttttatcattaagtataatttataaactgatttaccatcaatgtatctttcaccaccagcaggcatgcggagtttaatcatagtagaaaatctaatgtattagttttttcacaacgaacaacagaaggacgcaaaagattttcgtcgatagcttctgactgaattttttcaattatacccgaaggaataaatttagcaaattgagtttcaggaatagagttttcttctaagaatgctgttgtagcttcaagataactcattccaaactcttctaccattttttcaataataaatccattttcttgacgatcaagaagctttgctatttcatccttttctttcttgattgaaagttctttttctgaaagaccggtctcatcgaccggacgaatgtcatttagagaaaactgtgtcataaagttcaactacctcttcagtttcagcttcaaacacatcacggttatctttatgatacaaagctaatagacgattaaacatcttaccatcaacgccaagttcatctttggcacgaattcgaatatctttaatcagttcattataaccggaaattttcagtttatgatcagatgcttctttaataaatttagccaagtcttcgccatggatagcttcatcaaattcaaccatttcttttttagccattattcacctcaaaattcattaatgctattagttaatttagaaagacccgcttttacaaaatatgaataaattttgccacgcggtggtaatttatatgaattatagtaattcacaatgtttgaagcaatattatcaggaatataatcaaaatcaattagaactaaattttctttataacgattatactcagattctgagagaagtaccttagcttgctcacgatcattagcaatagcttcaacgattgaagttttcattgaaggagtccgttcaccttcaactctggtaaaccaaaagtcagaacgtactttaactgaagcaacgttatcctttttgtcacccttaagaattttagtcatacaatcaatttcagcagaaccgcttttaattttaacccatttcttgtgcatcggtgaccattgcttaacatttggatatttgtgaagttgagtaaagtcaccgtccgatgaaatgattaaaatcttatgtccttctaaagagaactttttaacaagaacagcaatgtggtcatctgcttcatacttatcaatatccataacaatgtatggcatataagctttcaattcatctataactttatgactggattcaaaataaccttcccagtcccaagtagattcttctcgtgcttttccacggtttttcttataataataagcgaaatcacggcgccagtatccagatttcgcgttatcaatacacagcacaattttagtgtatccaagcgtttttgcttttttgacattaaacttaattgagttcaatatcaaatgacgaaccattgataaattaattttttctttatctgggaagtttaccagagcagttgaaagagcaatttgactaaagtcaataaagcaaattccttctttgtaatcttcatccagcatcatttctaaatccatatgaacctcgttcaattagtgagatttctattatatactatctaaatcttaaagtaaacaggtataaatacttattattgaaaacacaataggagcccgggagaatggccgagattaaaagaaagttcagagcagaagatggtctggacgcaggtggcgataaaataatcaacgtagctttagctgatcgtaccgtaggaactgacggtgttaacgttgattacttaattcaagaaaacacagttcagcaatatgatccaactcgtggatatttaaaagattttgtaatcatttataataatcgtttttgggcagcaacggataatattccaaaacctgctggaaattttaatagaattcgttggaaagcattacgtactggtgccgtatatacaactgtatcatctggaccatatcaattaaaatccggagaagcaatttcagtagatacatcagttggcaatgacattgagtttactttaccaccttctccgcttgatggagaaaccgtaataattcaagatatcggtggaaaacctggcataaatcaggttaaaataaattcttcaaatcagagtattgtcaattttagaggtgaacaggtacgttcagttttaatgactcatccaaagtcacagatggtattcatttttaataatcgtttgtggcaaatgtatattgctgattatagcagagaagctgcgattgttactccatcgactgcgtatcaagcacaatctaatgattttatcgtacgtagatttacttctgctgcaccaattaatgttaaacttccgagatttgctaatcatggcgatattattaatttcgttgatttagataaactgaatccactttatcatacaattgttactacatacgatgaaacgacttcagtacaagaagttggaactcattccattgaaggccgtacatcgattgacggtttcttgatgtttgacgataatgagaaattgtggagattgtttgacggggatagtaaagcacgtttacgcattataacaactaattcaaatattcgtccaaatgaagaagtcatggtatttggcgcgaataatggaacaacccaaacaacccaaacaattgaacttcagcttccgactgatatttctgttggtgatactgttaaaatttccatgaattacatgagaaaaggacaaacagttaaaatcaaagctgctggtgaagataaaattgcttcttcagttcaattgctgcaattcccaaaacgttcagaatatccgcctgaagctgaatgggtaacagttcaagaattagtttttaacggtgaaactaattatgttccagttttacaacttgcttatatagaagattctgatggaaaatactgggttgtacagcaaaacgttccaacagttgaaagagtcgattctttaaataattctactagagcaagattaggcgtaattgctttagctacacaagctcaagcaaatgctgatttagaaaattctccgcaaaaagaattggcaattactccagaaacgttagctaatcgtactgctacagaaactcgcagaggtattgcaagaatagcaactactgctcaagtgaatcagaacaccacattctcttttgcagatgaccttatcatcactcctaaaaagctgaatgaaagaactgctacagaaactcgcagaggtgtcgctgaaattgctacgcagcaggaaactaatacaggtactgatgatactacaatcatcactcctaaaaagcttcaagctcgtcaaggttctgaaacattatcgggtattgtaacttttgtatctactgcaggagctactccagcttctagtcgtgaattaaatggtacgaatgtttataataaaaacactaataatttagttgtttcacctaaagctttggatcagtataaagctactccaacgcaacaaggcgcagtaattttagcagttgaaagtgaagtaattgctggacaaagtcaagaaggatgggcaaatgcggttgtaacgccagaaacgttacataaaaagacatcaactgatggaagaattggtttaattgaaattgctacgcaaagtgaagttaatacaggaactgactatactcgtgcagtcactcctaaaactttaaatgaccgtagagcaactgaaagtttaagtggtatagctgaaattgctacacaggttgaattcgacgcaggcgtcgacgatactcgtatctctacaccattaaaaattaaaaccagatttaatagtactgatcgtacttctgttgttgctctatctggattagttgaatcaggaactctctgggaccattatacccttaatattcttgaagcaaatgagacacagcgtggtacacttcgtgtagctacacaagttgaagctgctgcaggaacattagataatgttttaataactcctaaaaagcttttaggtactaaatctactgaagcacaggaaggtgtcattaaagttgcaactcagtctgaaactgtggctggaacgtcagcaaatactgctgtatctccaaaaaatttaaaatggattgtgcagagtgaacctacttgggcagctactactgcaataagaggttttgttaaaacttcatctggttcaattacattcgttggtaatgatacggtaggttcaacacagccattagaatcatatgagaaaaatggttatgcagtatcaccatatgaattaaatcgcgtattagcaaattatttgccattaaaagcaaaagctgtagatagtaatttattagatggtctagattcgctccagttcattcgtagggacattgcacaaacagttaatggttcactaaccttaacccaacaaacgaatctgagtgcccctcttgtatcatctagtactgctacattcggtggatcagtttcagcaaatagtacattaactatttctaatactggaacggcaactcgtctgatttttgagaaaggacctcaaactggaacaaacccggctcaaacgatgacagtcagagtgtggggaaatcaatttagcggggaatcagacacaacacgttctaccgtatttgaagttagtgatgaaacgtctagtcatttttattctcagcgtaataaagctggaaatataacatttaatatcaacggtacagtaacaccgataaatgttaatgcttcaggaacattgaatgcaaatggtgtagcaacatttggtaattcagtcactgcaactggtgaaattatttctcgaagcgcaaatgctttccgtgctattagcggaaattatggtttcattgttcgcaatgacgggtcagtaacgaattttatgcttactgcatcgggtgatcaaactggcggatttaatggattgcgtcctttagctattaataatgcatctggccaagtaacgattggtgaaagcttaatcattgcaaaaggtgctactataagttcgggtggtttgactgttaactcgagaattcgttctcagggtactaaaacctctgatttatatacccgtgcgccaacatctgatacagtaggattctggtcaatcgatattaatgattcagccacttataaccagttcccgggttattttaaaatggttgaaaaaactaatgaagtgactggacttccatacttagaacgtggtgaagaagttaaatctcctggtacattgactcagtttggtaacacacttgattcactttaccaagattggattacttatccaacgaccccagaagcacgtaccactcgctggacacgtacatggcagaaaaccaaaaactcttggtcaagttttgttcaggtatttgacggaggtaaccctcctcaaccttcagatataggagcgatcccatctgataatggaataataggtaatcttactattcgcgatttcttgcgaattggtaatgttcgcattattcctgacccagtgaataaaactgttaaatttgaatgggttgaataagaggtattatggaaaaatttatggcagagtttggacaaggatatgtccaaacgccatttttatcggaaagcaattcagtaagatataaaataagcatagcgggttcttgcccgctttctaccgcaggaccgtatgttaaatttcaggataatcccattggaaatcaaacatttagtgcaggtcttcatttaagagtttttgacccttctacgggagcattagttgatagtaagtcatatgctttttctgcttcaaacaatacaacatctgccgcttttgtcagtttcatgaattctttgtcaaacaatagacttgttgctatattaactagcggaaaggttaattttcctcctgaagtggtatcttggttaaggggagcaggaacttcagtttttccatcagattcagtattgtcaagatttgacgtgtcatatgctgctttttatacttcttctaaaagagctattgcattagagcatgttaaactaagtaatagaaaaagcacagatgattatcaaactattttagatgttgtatttgatagtttagaagacgtcggagctacaggatttcctaaaagaacatacgaaagcgttgagcaatttatgtctgcggttggaggaactaataacgaaattgcgcgattgccaacttcagctgctataagtaaactttctgactataatttaattcctggtgatgttctttatcttaaagcacagttatatgctgatgctgatttacttgatcttggaactacaaatatatctattcgtttttatgatgcatcaaatggatatatttcctcgacccaagctgagtttactgggcaagctgggtcttgggaattaaaagaagattatgtagttgttcctgaaaatgcagtaggatttacgatatatgcacaaagaactgctcaagcaggtcaaggcggcatgagaaatttaagtttttctgaagtatcaagaaatggcggcatttcaaaacctgccgaatttggcgtcaacggtattcgcgttaattatgtctgtgaatcggcttcacctccagatataatggtacttcctacacaagcctcttctaaaactggcaaagtgtttggacaggaatttagagaagtttaaactgagggagccttcgggctccctttttctttataaataatattaaaataaaggggcatataatggctgatttaaaagtaggttcaactgtgggtggatctgtcatttggcatcaaggaaattttccattgaattcagccggtgacgatgtactctacaaatcatttaaaatatattcagaatataataaaccgcaggcagctgataacgatttcgtttctaaagctaatggtggtacttacaccggtccaattactattaattacggggtaaatagttatcttcaattaagtaataatgaaacccccatccgaattcgttctggtggcggcactggtaatactcttgtagttggtggctcttctggcggtattagttttagaccagcaggtagtgaaatcactactggacaaattacgattacgccagaaggtttgacaacatttaccaaagctgtaacggctccatctgtaactgttacatctactccttccgcagcatctgatgttactcgtaaagattatgttgacggagcaataaatactgttacagcaaatgcaaactctagggtattacgctctggagacactatgacaggaaatttaactgcgccaaaccttttttcacagaatcctgcatctcaaccttcacacgttccacgatttgaccaaatcgtaatgaaggattctgttcaagatttcggctattattaagaggacttatggctactttaaaacaaatacaatttaaaagaagcaaaactgcaggtcaacgtcctgctgcttcagtattagccgaaggtgaattggctataaacttaaaagataaaacaattttcacaaaagatgactcaggcagtgttatagaattaggtttaaaatatggaggaacaattgatggttctttaactgttaatggaaatataattggaaatttaacaggtaacgctgcaactgcaacgaaattaaaaacagcacgaaaaattaatggtatatcctttgatgggtcaaaggatatcacgctaactccatctgacataaatgtcaatagcacaacatttataaaaaataatggcgaattacctgttgatgctaatttagatgagtatgggcctgttgaagaatatcttggcgtttggtcgaaagcaacttcaaccaacgctcaaccagcaaataaatttccagaagaaaatgctgtaggtgtgctagaagtatttgtggccggtcaatttgctggtactcagagatatacaactagatacggaaatgtttatattcgttccttgactgctacatggaacggagtaaatggtccgtggagtgtgtggcgaaatattcaatccggtactcgtccactgtcaacaacaattgatcttaatgatctaggaggcgctgaacactttggtttgtggcgaaatagttcaaattctattgctacctttgacagaaatttcccagaagaggggtcgtcagctcaaggacttttagaagtatatgaaggtggaaactattctcgcacacagagatatacgaccagatttggtgttgtttatactcgctgtcttgctgctgcatgggatgcatctgcgcctaattggggaccgtggcaacaagtcggtaatgtcacaccagcgactttctatgatggtgaccttaatgattttaaaactcctgggttatataatattttaggcactgatgccgttattaactgtcctaccggtgaaggtttgccgactgttattgttggtttgctggaagttaaacagcgtgcttctggcggtgctattttccaaaaatttactactgccggaacgggtgcaactactcgcgatcgtatttttgagcgtgcatatactggtggtgtgtggggtgcatggaacgaagtatatacatcttattctctgccaatcactttgggtatgggtggtgttaaaactcgattagcggagctagattggcaaacatttgattttgttcctggtagtatgtttagcgttcctttgaacaaaataaagaacatgccagcaaatatggattgggggacgattgacggaaacctggttatgttttccgttggtcctagcgaacacactagcacagggcgtactgttcaggtttggcgcggtactgtatcccagacaaactaccgttattttgtcgttcgtgtgttcggtaattctggaaatagaacttgcacagtccgccgtgttgttcttgaagatggtcgccacacatggacagctcaacaagattttaatggtgctgttaacttcggtgctcctaccaattttaactctactgttaaccttaataacactaccacatttaaaacagaagttaaattccgctcatctaatgcattccgtatgtatggcggaaaatttggtacaattttccgtaatgatggagagagtctttatattctttccaccgacgaaaatgatcaagatggaaactttaatacaaatagacctttccgttatgaattaagaactggtgatgttactttgggtggtactagtggtgctaacgttttaaaattaaaacgcgattctctcaccgcattttttggtggtgatattaatataaaaggcttgatgacttttgatgccggacgtttaggatcacgagattattttaaatttaaccattggggtgatagtaataatgcgcgcgataacattattcagttagaagacagcaaaggcgttcatttttccactgaacgtactttagcgactggtgcaattaaaactaaattctttggtgaagttgaatccgaaggtagattgattattaaacgtccgggtgattctattgtattatcaacaactgctggtaatgctttgcatattcgcggtgacatagacgggactggtaactggtatattggcaagggtggtgctgataattcgctagcattttatagctatgctactcaggcggcagtacatatcacaaacaatggtgagatttcgctaaatccacaaaatatcgcaatggttaacgttaaccgcgatcgtgtacacattaacggttctggatggattgctagacaaccgggtgattggggcaaccaatggcgagtagaagctccattattcgtcgatcatggttatgtttcacaggattgttattatccaattattaaaggaaaaagtgtaatcaccaatcaagggtttataactgccgtcgatcttggtattcgtcgtgtccctaacaattgggggcaagcaattattcgtgttggatctgcagaggcatcgccagcggctggacaccctaacgcggtatttgaatttcattacgacggtactttctattctcctggtaatggtaactttaacgatgtgtatattcgttccgatggtcgtcttaagattaataaaaaagagctagaaaacggagcacttgaaaaagtatgccgactgaaagtttatatttacgataaggttaagtctattaaagaccgtagtgttattaaacgcgaagttggtattattgctcaggaccttgaaaaggaattaccggaagctgtgtctaaagttgaagttgatggttctgatgttctgacaatttctaactccgctgtaaatgctcttttaattaaggctattcaggaaatgagtgaagaaattaaagaattgaaaacgcctctctttactaaaattgctcgcaaaattagtaaatattttaaattctaacaacaagggggaaatgccccctttggagtataaattatggcagtagttggtgttcctggttggattggaagttcagccgcaaatgaaacaggacagcgctggatgagtcaagcggctggtcaattaagattgggtgttccttgctggatgagtcaatttgcaggtcgctcacgagaaattattcacacgcttggagcagaccataacttcaatggtcaatggttccgagatagatgttttgaggcaggtagtgcacctatagtgtttaatattacaggtgatttagtatcatattctaaagatgttcctttattcttcatgtacggagatacaccaaatgaatatgttcagttaaatattattggcgctcatatgtggggtagaggtggacaaggtggatggactcattccggtggagatggtaatggacaacaaggcgggcattgtattcaaaacgacattggtggacgattaagaattaacaatggtggagtaatctgtggtggcggaggcggtggtggcggcattgcttaccgtgttcactcaggggcagactggcaagatattggtggtggcggcattgcttaccgtgttcactcaggggcagactggcaagatattggtggtggcggcggaagaccatttggcccaggtggtggcggtggttactcaggtggcgcagcttcatacgtcgccccaggaggtggttaccaatacggaaatgctcactctggccagggcggcgatgccggaggaaatggacaaaatgcctggtctgatggtggtaaagttctaaaggttggtgcaggaggagcagcaggttatgctgtcataggatctgctccaacttggcaaaatgttggagtaatatatggtccaagagtataattttgaataaatacccctaaaaggagggtctatggcagcacctagaatatcattttcgccctctgatattctatttggtgttctagatcgcttgttcaaagataacgctaccgggaaagttcttgcttcccgggtagctgtcgtaattcttttatttatgatggcgattgtttggtataggggagatagtttctttgagtactataagcaatcaaagtatgaaacatacagtgaaattattgaaaaggaaagaaatgcacgctttgaatctgtcgccctggaacaactccagatagttcatatatcatctgaggcagactttagtgcggtgtattctttccgccctaaaaacttaaactattttgttgatattatagcatatgaaggaaaattaccttcaacaataagtgaaaaatcacttggaggatatcctgttgataaaactatggatgaatatgcagttcatttaaatggacgtcattattattccgactcaaaatttgcttttttaccaactaaaaagcctactcccgaaataaattacatgtacagttgtccatatttcaatttggataatatctatgctggaacaataaccatgtactggtatagaaatgatcatataagtaatgaccgccttgaatcaatatgttctcaggcggccagaatattaggaagggctaaataattatttgttcgtatacatttctagatatcgatatacaccctcaaaaccctcgttgaattcgtcgatgagggttttcttatcttcttgagttaattcagaaacaattttacgaaatgaattctgatttaactttctaccttcatgcgttactccaatctcattaagaaatgcaataaaattagcacgattctcaacaatatcttctctggaaaatttaatcaaaatagatgcaacagtaataatttcacgaactgtatcaatgtttttattcattaactataccactcaattagttgactttgttataatatcatcagacgcttgatttgtaaactggtctgtgttattttcttcaaaaattttttctacgaattccttgaacgactcgcgttcctgagctacattatgctcgattaccatttcaagattatgactcattcgaaataatcttcaatttcgtaatcatggacataaatcattatagtttttaatacatcatcaatactttttcctggagctggaattacgtaaaaatatcctgcttttgagaggtctttataagttccaatcaagaaatcattattctcaagatgtaactcttcaactaattcattgacaattgaatggtataggtttggtagaaacttatatagcttttctagaatatcaattttgattgtgtattgaaccacggactgagaatcaataatcatagaccttccccttatgtttctgtttgcgattagattctttaaacgctttcttcttatctttatgaacagaagctttattaaaattatgttttgcgactaaattgttcatagtgctgaattacctctcttaaacatttgcatgtgaatgaaaactttttagctacaccacattcaaatatatgttctcttaaatcacgtgtgtcagtatatcccatcttaacaataaaatgccgtattagatttttatctttatcattgagagagttaaaataatcggattttgaattaatttccctggccaaattgaatcaccttcagttgacgttttagttcttttatcatttcttcgttcatcgcaatataaagatcgcgtaaagcaggttttagcattccatttattggagaactaaatggacacacataatcttttcctacaagctttttagttaattccatattacagaactgaaatgcaggttcattggcataaattccccaattagttgacatcattttattggcatattccagtgcctggatttgattcataattccatcaatttgaaactttttaatattcattagtaaaggtcctcagagtaaagttctttttcactaccaccacgttcaatacgtacttgtccagcgtaagttgcaataatcattgcttcttcacgtgtccaataattactatattggtcaataaacccttgatcatcatcacaaacttgctgagtaactaattggggtttaactacatctaaaactgctgccatatctttagaataatgacgagcacccggaataataagagttcgtccatcttttaatctaaaacggttggctgcgcaaacaatccgtcgttggtacttttggttttcatcccagtatgcggtctgccaacaaatttcaggaacttcatctaaaacattttgttctgtgtattcaccactgtaagaagctaatttagcagccaaactttctggagtctcacgtgacaaagctttatctaacagagctaaacgttctttaaaggttttcatttaaaccatcctttaatacgttgccacaaagttttctgttgagctttgttaacaccaattgagcgaataactggttgagattcctggaattctttataatcagcaaggtaaatttcgtaagctgaatccgtaaaggaacttatggctgccatgaaattattgcgaatacctactggagcatctttactttcacgaataatcatgtatttgccagtcttaatctttacaatagttccaagataagccccatggtaccagatgtcccatccctcttgagtaggttctgcgcaacgacgaagttcattaacaatttctaacttgttcattatttattcctcacagttcagatgctacggtgattacagcttcaatgttttctgctgagcgtttaatgtcaagatacacattaccgtttttagcgattttacatgacattccgatgtcagtaaatttctgaatatgatgttccatcattttgtatccaaaaattcgcatatttccattgttgttaatttcaaaattacgaattccgtgagtgcgtttttctaaaatagcgagatagttactacgataagtttcaacctttttaagaacaaatccattttcatctaaaagttttaacatgaagtctttatcttcttccatatcagaagtaatctcacgagctttacgagttgctcgttttttcagcagttccggagcgttttcctgtgcgtataaagttgctgcatttgaaataatatcctgagcttcacctgtaatgattaatccatcaccagatttctccaccaggccttttttaatcaataccccaatattactattaactactgcgttacctaaatctggatgcacctcacgaacttctgcagctgtaatgaaatctttcttagcaatggtaattaaaatcgcagcagttttttcattcagaacatcgttagaagctttgatgatgtaagttactttagacattttaatctccgtttcagttcatttatttgataggtctatagtatcatgtttaaagcagaagtaaacacttttttgcactctttttcaagagctctaataaagtacttacttaatgttcagattacgaacttcgatttcgtcttcatgggcaaaatcaaactgtttgaattctgtgtcacctttaaatttaaaaatcattgtgaagaaagtcagaacaccaggtttttcttcacgaactccacagatatcatattcaataccatctacaaccagtttgttagcagtcagagcatttttagctttaacgatttcgttttcgattttaaatttcattttttgtatctccgggttgtttgtttcagttcatttatttgatagttgtatagtaccacagtatgctttggttgtaaaccgttttgtgaaaaaatttttgaaataaaaaagggagagccgaggctctccctaaaattactgcatgactgtgataactgtcatgataacacgttgaattccgaacgcaagaagacctcctgctacggcaggaacaacacctaaacccgccagtaaaatgccaccagatactaatgcagcgcttgtgataccaatgaatggactcatttgatttcctctaaatctttggtgtattctgtaactacatcagtagttttccaatattcgttttcttcttttttggctttagcttcttcagcaagtttctttgcttcgtcggaagtcatatgaaaaatgttcattccaactagtttatcaacataagaagaatacatatcaattttaaaaagttcttcggtcagttctttgcgagttttaccttgtacaacaatttcacctgaaattactttcttaatgaaatgtgccttggcaaaagctaaacgaaatgctgattcagtttctttgattttgttatcaattcgtttttggacataagttttacgaacttcaacgaagtctttgattaaatcaactacgttatcgtaaacttgcagctttcctttctcattaatgactgtaatattctgagaacgacgctcaatcagtccgaagtctttcataatttttgcatggcgttcttcttcattatcgctcaaagagtattcttttcggaatttaactttgaagccaaagccatgctcaccacaagcatcatcccatgtaatgaagcctttatcttcaagtgggtctaagattttactcacgtaagtttcacgatcatacttatatggaatctcagtgatatgcatttgagttcgtgaagtaaacttatatgttccacgaatttcatattgcccatcaatttcaacgacttcaccacgaaattctgggaattctaccttcggtttagttactttctttccttgaagagcttgcagtacagctttcttgacagaagaaacactatgaggaagaatgtaagttgcataaccagttgcaataccggaaacgccattaagaataacagtaggaataacaggcaaatagaaagcaggcggaatgtgttctttatcttgatgtaccggagcatattcagtatctttatatacgttatagaaatttttacttacacgagcaaaaatataacgacttgctgctgccttttggacagtacgagaaccgaagtttccttgaccgtctaacagaggaaagttattattccaagtgttagccatcaaagcacctgcgtcttgcgcagagttttcaccatgatgatatccaaggtccgctacaccgcctgcgatagaagcgagtttgtgaaacttatctttatttcctcgtgccaaatcaagagctcgagcaataacaaatcgttgaactggcttaaatccgtcaatcatatttggaatggcacgattttcaaccgtgtacatagcataagccaatgcttcattatcaatgatactttttaaatcacgattattcagttgcataaatttaccatactagtgaatgtagtgccataataacatcagaaatgaaaagcacgacttgaattaatccgaacattattccgtaatataatgctatcaataaaatagcaagggctaatgaatagcccaagattttcttaatcattagtagataacaacacaaatgttaaatatgcacacataccctgggctaaagcttgtgaaaacacactgctagcatcgatacagatagttaaaacacatgctactatccaacaaataaatgaaataactcctaataattttgcgatattcatattttcctcactggcgtccgaagacgcctttagttttaagattattacgatagaactgcatcacgtgttcgttgtggaaattactcattaatatgcctgcaaaacgaatttaaaattatcagccaacatacggttcatttcttcaagtgtttgatactcagaatgatgattacgagtaaacgctaaagctaactgtccttttccaaatcccgtcgtcagaggtttcatcttagaagcaggcagataaaatactgtgtataccatattgttatttgcaatagtacgtgcaagctgagaccgacgttgacgaatatgacttagaactgcactgaatccttgcttagaacgctgattacctacataaaatcgtgcagacacacatggattactaaatggacgaccatctaatttacttactaaaaaataaaatccaggtttagataaaatatctttatgcggagttcccaaaaaccactcaccacccttgattgtaccaataacagtagcgcctgcattattcaaatcagtaacagtcatgtatttcatattaatttcctctaaattattttctactccaaggccgcatgaatacgcggccattaaattaatcgtcgcagtcgacgctcaattcccaaaactcttctacggtataagtttcagtatcattttcaatacagaaacgttcattactgttatttgctaaagtagcattaactgtcggtttctcgctagtgctcttaagaggtgaaatacgaattaactgatcaccgttatctaaacagaaaatttcaccaacttttacatctttaaagattttcataattcacctcaaggaatataaaatccgaatgcagttgttgaccatcccatccaatatgggaaatttgcaccaatgtaaaacataagaatataaaaccaaccgctcagcaaattcatcattttacaccattccaaattgtttcaactacggattttaaaccattttgatgaatatcaattccgactactgtcatcaaatagattccaactacaactgaacctaaggcaaaaatcagcatgaaaatgaataaagccggaaaaatattatcgaaaaaccattcaataaatgtaaaagcactgcgtttacgcttcatattttcctcacataaatccaaagtaaacgtttaatacatcaatcattaaaacgattgggaatatactcaaaactattagtattataactacattccatatagctttaacaatctttttcattttctgttcctccgtagtcgatagggtaatagtaccacggaagaacagtcttgtaaacaacttttttaaaaatattcgtaataaatgtgaataccaactactactgccgaaacttgtgcaacccaccatgcacacgcaataagtacagaattcaaaattttcataataacctcatcacaaaagtaaatgttaaacaaattactggaatactaattaaccaaacaaaacaccaacataatgaactcatagttcaatctcaacgatttccaagtgtttttgttttattgcctttttaacacaatcatggactaaatatgaccacgaatcattatattctccattaactaatcgttggagatcttcacgtgatgataagtaaggttgatctgattcccattttgataaaaatactgcagtaaaaatatctccttcatctgtagttgaagtcgtaaatgcaataaattcaccggtaattttatgtttagcgtaataaaatttaaatttcatttttactcctccgtagctgatagttgtatagtaccacggtccttgtggtatgtaaactgttttgtgaaaatttttttaaatggaaagataccatccattgtagttgctttttcttacaaccttacgaaggtcttctctgtcaccgatgaacttcggagtgtactggataacacctggatgaatttctttagtgttgaatataattatacagtcagcgacttgatgatttagaatgggccctagatttattccagaaccatatggatactctccgctgcatcctgttgtcaccgaaatccaacgtgagtcagtttgatgtgtcttaacttctacacgaagcccgcagtatcttggatgcgccaatacatcccacgcgtatgtatatggatcatcgacatcttcttgacctttattaacatacccgcttagccaatctgctacaaaaaactctgcgtatacagcaatacgacatctttcaataacttctgctttatcctggttcgggttttgttttaaagagtatcttgcagtatcagcaattttgaccttcatttcgctagtcaagtcactgttcgatagggtaaatgtcggaatctgaaatagtctctgtaaacccggattcgttttctgcatttagactttcctttttaccactgagataagcgttatatactttaagagtgccgtaataaattcggtcattttcatctaaagactcgcggtcaagttcatcgagctcctttttatccatgactataacatcattacagtaaagaaacccaagtttttcgtgaccaaactcaaatttattacagtacacaatattagcgtgatgatttccgtgcagtttaatctcttttatgtcggaatcaccgatattcatacaataaatcataatttttccttaaaacaaaagggccgaagccctttattttacttgaattgtgcaattcttttctctagacattcagcataagatttcattgagataaactgcaaaagtaacagttcttgctcaactgcattaactgttagaaactttgcgctttctaaaaatttgctcagtgcattaattttgagcattaattgatcgtattcttcttttactcgtgcttgataacctaacataattttcctcagttaagggccgaagcccttatttaaattgttcagtaacgtcttcaactacttcgtattggcaggtacgcattttagcatcgttgtaatcaatcggaattgatactacatcacgcggatgtactttaacttttacaactcggctagttgaactgccaaagtgacgaatataagatttagaacacacatgcagaccacgagaacaagtttgtgtatcatcgtcattcacacgagtacgtggcattttaactactttacccggactgttatcaaaggtatttgagtgacagtcaaagtaattgctgcgaactactttccaagcatagaagtagccatcttctgtaatttcaatatcgtttgctaccaagaaatcaaagagtcgagataccgctttttggcttgggttttccagcagattttccaagaacggaaaataaaattcaaagttttcgcctttttccatcgagtcaagaatacgatcaaccaaaccagaccgcaattcaatattttgatagaacaagcttccaccttcaattcgaacatcgccggaaatatatttttcaacagcgcgacgaacattaattttttgtgctgcttcttccagcttatccgctacaagcagattaagaatttcctggaagtttgaatgagtattaggagttgcgttataagttacaccgtcaacagtaattgaaatgaattttttagatgcattccaaataatgtcagatttagcaactggagcaataactacatcgctattaactttaactgtaatatcaccgctaatagtaactttagagcgtttagcttcttcagcatttttcaaaacacgacgaattgtgtcaaccgatacaccttgccaatcagccaattcctgttgggtgtaattgccacttgaatacaatttaacaatttcagcttgttcgtttttggtcaggcatttaaatattgtacataattttcctta

SEQ ID NO: 12 - DNA, 151263 bp, Unknown
  Myo, Distinct clade
gggcgcaccaagcgccctttctttttacatgtagaggataaacaaaaatgactttaaacgagcttaaaacagcctataacgcaacattaaaaatagccgtgcgttaccgtgacgaatacggttttattgcgcagggtgtgatcctgggcttttctgacgatggtttgatctatgttgatgcacatcacaacaaggttaaacctgaaaacgtcattagcataaaatatctttaaaaacgcttgacaccataaccaggtaggataagatgtatcacatagggcgggaatagttcccgaccacataaaagagaaaaacattatgaccactatcacaacaaaacaagaaaaaattattacagacattgccgcagtagccgctattgctattatcggtacctactatgacaccgcgcgtccttcctccttgcatgagatcgccgccgttgcatcagttggcgtgctgttttacgttggtaaacgttatttatcaccaatgattaacaagctgacaccgtggaaaaataaaggttgatcctgttttacattgtgttatagttatcgtgtagggcggcaatggtgccgcgcccctttgaggatgcaatcatgagtaaagctaacaccgtgctaatgttttccctgattaatgatcccgcttacttgtccaacatgacgcaggagggtaacacattaacggcaacattcaccaataagcttgaccgagtgatcatcatctcactgaaaacagttagtaaaggcttttactcgttagcttatcattggatcactgataccgacgagacaagccaggactatagcgcccctttccctgaatcaatggcacgggagatcatcgccgccgttgtaaatgatggtttgtttactgcataaataatttagaaaaaggcttgcaatcattttgagatagtgtatatttaattcatagggcggcgggaatagttcccaaagcaaacgagaggattacacgatgagcaagtacacagtagaatacacggtagagaatccggtagtatccgaaggtaaaaagatgacatttgccatcagtataatcgctttcgttgtcactatcttatcaatcatcttataaggtgcacaccatgaaaataacagacattatcaaagagatcgcccttgccgctggcgttgaagtcgaggaagtgatcgcgctcaatcttacagaaaacgatctgcgcaactatgaagcggaaagcgtgaaagcaagcggcgcggtcctggtatatgatccggctaacaagtaaggggataacatgaatccgaaagatatgcaagcatggaaagggtacgacgatctaagcgccttgcgcaataagtcaagccgtaaccttagacggttggaagcaaagaaaaagaaaaaatagtttgacaagtccgcgtagtctgataatatgtatcttgtagcgcggcaatggtgccgctcacaagaagagagaaaaatcatgaaaattacaaaaagcctaactaattatgcagcacgtcgcggattatgcttaaccgttgaaaacttagggaaagaagactttttgtgtttttgggagcttgagaatgattgcgagtggatgttttcttattctatctgcgaagatcaaaacggttgtttgttaacctggcgcggtaatatctatttaccggaagaaattaaagaagagttaccaggtacgatcatgacagagagacagcttaaagaagtgatcaattttgtagggcaaaacattaaaaaataatttgacagtaggcaaacaacgtagtaaagtttattacatagagcggcggaatggtccaccgctcacaacagaagagaaacaaatcatgatcccgactatgttttatgtatcgcgcaaaggtcacaatattttttggtctgaagatttaaatgaagctatgacgtttgcccgtgatcgtgttgctatcggtggcgttaacatcactgtaaccgatgaaaacggcattgaatactataacggcgacgatgaagaataattaatgaggcgggggagtattccccgccgtcaatagggcggggcaataaggcaacgcccactaatgagggtaaaatcatgttagagaaaattttcacggttgtagtagtgggcctggtgttatcggttggagtggttgcaactatggctaacatgatcctatcttcccacggtattggataaggtgaatcaaatgatcacgaataagacaggtaaaacagaatttttacgcggcttgcagatcggcaagcctgagatctggcattgcactaaatccgcgcataatgaaatgaaagattttaccgctactttacaacgtgttaaaatatctataacacagaaaaaagccttgttagtagtagaaaacgagatcccgcaaactattattattgtcgagcgtacagcatgaaaacagaaatcattattgaaatcatcaacggttataaagaagcctttatttttgctgaatcagccagggatcatgaaggtaattttattgataacttagacgattatgatttttctcctagcgcggacgaacggatcgcccaggatgtaacagcctttattaatgctaatcttgccgctatttctgaggcaatgagcgacggcgcaacagccaaccagatcgggaatgatttacattttacccgtaacagtcacggcgtaggcttttgggatcgccctgaaatatacaccactaacacagccaaccgcctaaccaatgcagctaagtttatgccgaacgtgtcggcttacattggtgaagataatttgatttatattgaataaaaagtattgacacagatcgccagtgtgctaatatttaccacgtagggcggcaatggtgccgccgataatgaggaaagtaaaatggaaactatcgctattgttaccgtagaaaaactggttgttggtgatgtattcgcgttaatggtgcctaacagcagcaaactgggcgcttatgaagtgatggatcataaaaatgaatcatttggcgacggttgcacaatggcggtaaaatccttaaaggatggaatcatccgtcaagctaattggcacaaagggaatcaagtcggattaatatcagctaatttcttgccagaagagcaaacgttagaccaactatcaggcggtaagacgttagccgaactactggaaacagcgatctaatcaacaaaggggcggcaacgccccacatcagaaaggaaaagattatgagtattgcaacagtattaaccgccgttaaaaccgctgaatcatccggcttgcatgttgagcttatagatcaaccaggtggcgatctccttgtccaggtttacccgccgaaagtaggagatgattattattggtgctattctgatacgttcgaacaagtagacacgaaagcgatcacggcttttattttaaaagctgttgaagaaaataactttcattataacatcaatcaataaactttaagcaggggcggtaacgccctattaaacgcaataggaagaggatagaaagcatgaaaaagatgatcgcagtagttgccctggttgttggtattaacgcgcctgcaatggctaatgatttgcctgaatccatcacgttaaccgatatcaacgcggtaaaccggatcggtgttaattatcgcctatgccttgccgctaaaactttccaggacggcacgacagaataccacggattcgagggtatccgctgcggtgagcttgcacgcgaccttaaggaagatccagaccttgaggccataccgatgaccgtaaacggtaaagcttacgtaaaccgccaacaatgagaaaggtaatcatgacaatggggatcatagtagcaacgctggcgctgatccccttcctggttgaatatgtgctgattagtgttgtcctggtagtcagtgacttattggaaacggttggcacctggttttaaggaataataaaatgaatacagaacaagttagaaaggtattagcagcgttgcggtatcacaaccatagcaaggtaaagaatgatcctgattatgtggattcaagcctggaagaagacacattgcaagctataagccacatgcaagaattgcttaaacgtatgacagagaagaacagatccgactttataggtgaggaagtataaaacagcttgcacgatgtgccggatagtgtaagatgtatttcgtagggcggcaatggtgccgctcacaactggaaggaaaacaccatgactacagctaaccgcctgatcgccgtcctgaataaagcaaaggctaaccgcctggatgttcaaatcaaagagcaagcaaatggcgagatccttgctacggtgtccgatggcggttatgtatcagaatcatttttatcagggagcttagatcatcttgtttggaaattagaaattatcgtggaggatatgcagatcatctaatctttacaaaaacagggcttgcttttgtcctgttttttgttatgcttattgaacgggcggcacctggcgacaggggaagataatcaccggaagaccccgctatatattgatagctaacacctatcaaacaacaaaacatcaaagagataaactatcaaatctttacaattccacctattgacaccggatcacgcttacattattatttatcacgtagggcgagcaatacagcaagcccacaaagaggaaaagaagatgagcaaatcagcaattaaagcagttgaaaaagcgcaagaagtgatcgcaacgtcaaccactggcgcaaaggttaatctcgttggttatctgacagatgaaactatccgtaaaaattggcgtaatgctgatttactggcttgcttattgattaatagtgtcgctaatgctttccagtgtgaaacagccgagagcatggaggaaaacttgtttgataatatggatcaagccattgaaacctatatacaatcaaacctggatagctggaacagtaaaacatggcccgacaatttacgcgatacaactgatcaactgatccgccttgccctgatggttgaacgcgataacgttcacaaccgcacaaagtaagattatacaaggggcgcactaagcgccctttaacgtaaagaaatgtaaataatgcgctatcccctattgacaggggatcggcgttatattatatttaactcactggcagcaaacaacgaaacgaaacaaaggacaacaccatgaacattaaatcaaataatccagcttactccttcgataacgctttttgtcacggtagcgccgccaaaggcttcgaaatcgatggtaaattggttatcgtgaacgttgacggggaagaggttgcagtatatccggtaaacgatgttaaaagccgtttacaatgccgcatggatgttaccgcatatcagcttgatccggtccgtgtagttgccctggtattagaggaagagatcaaagcaatgcatcatagtaataagtttattggtgacgcgcaggataatatgaacgtttgccgccataaagttaatgaagccttgaaagaatgcggttttaaggatctgatgattaaacgtgatgaaaaattccgctttcgtaatgacctggcaaaccggatctactcaatctatgaagcgttataattgacaacaaaacaaggggcgcaccaagcgccctttctttttgcctgaataatgttgatagattccgcctatggaaaacagacacagaacaaaactgaataaatagcggtatcgagctaatcaaccattaaacgaataaccatacctcccagggtaacaggctgttagagagccatttagagcggttaaaatcgatcaacaaccaacaacaaaccatcaaaaacacccttttacctcctttctagtgcaatgataaccattatcatctatccatgtttatctatgcaatataagtgcataactataatgttgataatagttcgcaacaactaactaaccaacaacctaaaacaataagcaaactaatcataatcaaaggaataatagcaagatgattgataacgacaaacaatcaaaccatgatgaatactaagcaagataacgataacacgacaaaacaaccaactaacgaacaataacaaacgaaaccattaaaataacaactattagcaaaatagtgcctgaatgaaatcattacaaaacgaatcattcacaggatcatcattagcacgctatgccggacacatagcgagctaataataagccaactacaccccaacaatcataaccatcggtgatggttatttcttgttactgcgtagcttgcaataattgcaagcgtaatgacgcttacacttattgcgctggcttattattagcattatatgtaattaccaagatcataacattagcgcaataacaataatcattgtggtaattacaagatgaaatcattagcatggcaataattatgggggcaatgggaggatgattatcatcattccgatacattgcacactatgcacataatagaataaaaggcaatacttttgggggcgaaatgttaccgccacaggcgggaatgttgagcactaagagaagagcaaatatcatgggggcgaatactatcgctacgcgatatgttgagcatcttctcttaaacgtaaataaaatcagaataatcttgatttattttagtttttatgttaataaacgtttaaataataatcattctcatataaataatagtctgcttgtcatgagcgggatcagttgacaatgttccgtcatatgatgaagttgccaaaccattgataaataagtgtttgtgtgatttataatcaagtggcccaccttgtcgctatgttggcataagccttgcataagtcattgaatacgaatgataattattctcattcgcatgatatttgggaattgtcgctgcgtggacctgacggcccgaaaattcgcgttaagcacttcttacgtatgcgccatgatttttgccatatcatattgattctattagatattcttgccatgattgccatgaaacagggtgtcccgaaataatctctccccgtagatattttgggttactttttatacaagagtggggtgtcaaaaataatcggtatatatgggataattgataggaatcccctatgataattcgattgtaattccctaagattgatcgtatgatgttggtgattgatgattgccatgaaagatggctaacgatgagaggagattatcatgcaagagagtaaaaatgttccgttgagtagtttacgtctaatgaagttttacaaagcttggcttgctggtgaggtagaaggtcacacaacgagtggtttgtgcatatgtttgattaagtatgtagagggaacatatcctgatgaactgttacctcgtctacaacaggagatgaaatcacagtttattggtgcaggactggattacaatttcccgtttaatgaaggtggttatgaggaatacaccttcgaacataaaaaacatatttgccataaaaacaaacatcgtatacaatgggtgctagatagaattcaagattacgaaggagagaaaaatgacaaatagtattccgttgagcagtgcaacattgcttcgcttctataaagcatggattgccaactatcctgcaatgaatcgcacaacgagtggcttatgtggttgtctggtagattatgtaaacgattttgttggtgagacaactagagaagaagatagaagatggcgggatagtttgttggaccgtttgaaatatgaaatgaggaaacaatttacatgtgcagggttggactacaatcttccgttcaatgcagattgcatggattacctttcagagtgtataaacttggcgtgtcataccaacacgttacgtcttcaatgggtgaaagacagaattgaagatgcaaataatgcttgcattgaataaagatgtttgtataatggatgacataacagatagccaatgaggagatgaaatgaagaatttgaaaactgtcacaatgttcttgactgatcctacacgtgtgcaagcactggctaaagccagccgtgtagctgtagaattccaaaactgtaagccgtccgttgtgacaggcagtgaaacgtgtgttatcgatttcattaacgaatacttccgagggaatccggttagtcgttacttcattaagggtctgaaggatgcataacatgaaacgcatgaaaattcgtattgagaatgatggtggttataaaggattggcacatgcaaaatttccacttgtgttggaagccatggtggaatacagtgggcttgctcatgtgcgattctcgaagatgatggaagtgcaggaatggttttgggacgagatagatgcacgagaaggggaagattatgttttctttcctcacgaatataacattgtttattaaaggttgtgtgcaatgatcacaccacaacagaatgaagcagcaatggatcttcttgatagtttgtatttcgataattggtactctgaatgtgaatggatgaatatgcaaactctgaaagagaagacaaaagcgttgattacagtagatcaatttcttgcagagacggaaagaatgaattatgatatggcatctcgcgcacgacgcgtttccattttcaataaaatgttagcattatggggaggtagaaaatgagacaattcactatactggcagcttatgtgcaatgtgttcacgattatgttagtgctcatacaggtttgctggaagttaatagtaaaattgaaggcaatatgggtactgtctatgtgcaacatactttatccaatgtgccgtttaaagtgttcactgttgtagctgccgattacaatcgtgtagatgtgcgtttcttggatcataattttcgtaacgcactagataatatcgaagattatcttcccgtgaaacctttgtcatttccaccgagtcgtgcaaataatgtagtgacaaaccttaatgaaaggaatgtggctatgcacaaaaaagtccgtcaactgaaaacgctgatggaaatgcaagaagagattgaaaaagaactaaaagaagattttggtatgcttccaaaagacgctttgaaatggtatgatgaactaggaggagaaagttatgaataaaggaactactgtatatttagtaacaaagaataccccaggctggagccaatgcagcactgtcccttacaagatctgtgcaacattagaactagcacaacgtgcagaagcagaagtggatgccatgcaatacagctatggtgagatcattccttttactcttgaacaagaaggagcatacaatgtttaaagaaggtcatgtctaccgtttccaggatgaggattatatgcgactatattctacctttgataacagtattgctgctatcattggagagaattttttcgaggtgttgagcactgatgcaaatggtaatatcttgtcaattgttgtgatagggagagacggtattatcactgctagtgatggggatcgttacataatcaattctgctcatatagattattttgttgacggtggtattcgcggtggtcgtggaaaaccccaagaagaacctgttgatacaacaaaagaagagtggtatgttgtaatgactgatgacacctgtatttctggatttgaaagttatgaagaagctttgaaagaagcagcagagcataaaatggctaatcctacagaagaggttgaagtttataaacgtttggttgttgctaccatcggcgtatcttttgtttaaaaggggaatgttatgtttaaagttaatgctgtttactgtttcaaaactaaagctgcccgtgaagctttctctatgatctctgatgaaaatttcaaaatggcagctttgattgaagggtcttgtttccgcgtcgaagatattagtgaatcaggctctgtttgctcattgactttattggacagcggggatattattgaagctggacagtatccgttcagaagttgggggatattgttagctcgcggagagcgtaacttttttatgtgcgtgtctgcggaggaagttgtgaaagaaactaaggatgtttctgtttacaattctgaatttataagttatagtgagtatcaacatctggaaggcattgttggtcacttgttatctctgattaacgttgaatgtgacctgcctgaatcattgaaagaagagttgaaagcattagatctgttataatgtttcgcacaacgaaaggagaataagatgaatctgaccgaacagttacgccgtattgcaaaagaagcttccttcaacttccctgttgaagaagtgattgagacatgttttgctgaagcacgagcgggaaactcttcaagaaatttcacgccatctgattttggtctggataattcccctacccacccaggggagatctacaatcaggtgaagtggatggatgaagcagtagcaattcttcgtgagcgtgggcttattgtttataaagaaatggatctgaacggggcatacgagtggatcactgttgattggtccgaggtgaaatgatgaaaggtaacaagatgaaagttaatcaagtgccgagcgcatacactttatggcttgcgcgagcgttacaccagacgatcaaagaccctaagaagccaatgaagagtgggaagaagtttatgtctaagggcaaaacaacctttggcttcactcgtatgtctgtcaagatgaaaaggctggggtacaagccaaactacgctcgttacccttctgaatacaactggtttgactaaaaggagaaagactatggctacttttcaacaactgaaagatgtttcacgtttagtaagaaaaatccgagaagcagacgctgctgtgcggaatgcattaacgccagcagagcgtgaagatcttgaagaggaggtgaaaacagccgagaatgcttttgctgcgtatctttcaacactgtatacaggaggttaaatgtcagaagaacttaaagaattttatcaagcatatcataactggctgttagctggtgctccagataataatcctttctggcatgataaaggattatgtagttgcctctacctttggactggaggttatgatgatctaaattatgaaatgcaaatgcaattccgtgaggcaggattatctgaagaatatccgtttgatgacggagactggtttaaatatgattttgcacaaagaaacgggctattgcatttgaatgctgcccgtataaaatgggtaaaagatcatgctacacaggaggatgtgcaatgccaatagtgtttagtttcttagtaattgttatggttgttcttttcgcggcatggctttgggattttgacccaggagcagcgcagcaaagagctacagactggaaagaacaatgtattgtgctcaaacatgaacgaaatgcggagaaatttcttgacctagagtgtgatcgccttgtaagatacaagcaagataaataaccttgaggtgcaaaatggtaattgagattaaacttgaatatgctggggctgttgccctgatcgcacaaacgttgggagcaaagattgaagaagtgtgtatcaatgcctggagtgtagagattgatgttcctatggacaacattgctaatcgcttgctggtggcagagtgtgaacgcaccaacataatctacaaaggagcataatatgaaaattagagtttgtgatgtattgggttatgttggttttgagaatgttcagattccttttgttgttgaagcacatcttgttagcgatgacatgacaacattctttgttacgatagaagaaatgtccaaagttgagggatgggagtggtttgaagaagatgtttgggaaggttgtgattacgtatttttctctgatgaagtgaatgttctttcggagtaggtatgtcttgttttacaaaagcagtgtccatatgtaagaaacagtatgaaagtgattacggaatatttaatattccagtggatcatacaaagtattgttcatgtggtggcagaatgaagaaaacagtgatttatgcggatagtggagacgaacttgttccggttatggtttgcaaagcttgtcattctgttaaaacattaaaagcgtaaggagtcgggacacccgacgattggagctaaaaattttgcgtacaaccctttccgcccaacaggggcgcgtcgggtaaataaagaggagagtttatatgaaaaagatcatcgtaggtttattgttactcattgcatcactcggaacagcaaatgcgtctcaagtttatgagtgtgtgtcagatgtggttgttaaaaatctgaaaggtgaagtgatttctggtcctaagaaaatggcttctgttgtcattaataaagataactcctttatccttaaaaattcaggtggtgctttgatgagtggcattctgcaatacacaggagaaaaaagtaaagatggtagtgctatgtatggttcacaacagtttattggcactactgaagttgtgatgatgcgcacagagtatcgagacactttagcttggtttgcatttctaaaaaatgataaaacaataacgaatgttcttactctagaagctgattgtacgcaacgataagggggatttatgactaaaatgagacattacgctgtaaactgcaacgatgcttggcgtttgtgtcctgatgatccgacagaaggtacatttgtaagatatgaggattataaagagttatcggatgctgtaatcgcattgttaactgatatccgttcacgttatccaggacaagatttcacttgccctcacatcaaacttcttgcttgcctggtagaaggtgagaaagaagtggaagatggcttcaagcgtgtagagtatcaaggtgaaactttagatgttcctgaatttgttaattatattgcaacagattcaagtggcgagcgttatggttacactcataaaccggagattccagatttcgcttatgcgtggcgtattccttatgaagtttttaatgttgcagattgctggtatttaggagaaggaaacaaccttaattggcgtgattccttggttcaggtttaacaatatgaaagagacattgccagcagcataccgtttgaatgatgaacgtatttgggagtggaccgacgtttcttgtttttaccctgaaatagttcaatattggcgagcaaaagggtgtgttgtagttatcaacccatgtggaccagtggatgaagattgcttgtatctcgatggaaagtggcacagttattgtcgctggccttttgagtggatgtgtaaagaagatctcccagagggttgggagtatccaaaagcaaataggagataatatgtctgaagattttgttgaagtgtttgtcaaagacgaagaaactggtttaggcacaggtttcatttgtgaagaaacctttaaacgtgaacaagaaaaagctattcttatgcgaaactatgatcacgcattagaacaatggaaaaatgcagaacaaaaatgcaaaaacctttatgcagaaaatagaaaactacaagatcaaatggagttgttagctatcagtttacgatctctcattttggctgtagaagatggttttaaaaatccagatggttttcctgtgagcgatattgaacatgatttgtatcttgctcgtggtgcttacttctatgttaaacagaagtctgtagaaggagagaagtgatggaagaaaaactggaacgtattatcgagttagccatgtctattggctacgacgattgttttctccaaactattggagaaacagagaacgattacgactcttgggtgaaagagttggaagaacttaaaacttccttgattgctgactttgctgaagcagaggataaagcagatcgttacaactatctgtgtcgataagccttgacatttattttatgtatggtatacatacattatcaacgtgagcaaggtggtgtaatatgaataaagatcggtttctttctttagtcgcggaagctccttttgatgttcttggggtgagattatggaaagacagaaactatgggttagatgttcaaacatactctctttggttggttggggagcacagcttagatgaaagcttgtgcatgggtagggattctcgttccctctgtttaaagttcagaagcttagaacgcgcaaacaaagagcaagaaaaactaacgaggtggctaaatgaaaacaagcgcaaggttgatggagttttataaaatttatttagcatggattgatgttggtgctcctgatggtaaaccttttcggcgggattgcggtttgtgtgccaacttattcgactatgtgcacgcggatggctacaatccccttataacaaccttgtcagatgaaatgcacgcacagttttaccacaaagggttgagtcaagaattacccttcaatgagaactacgatgcatatgtcttagaatcagatgcagaggtatgtcacctgaatgtggatcgtgtgaactgggtaaaagaacgtgtagcagaagaaataattggttgacagagggatctgtctttgtcataatcatctcatcgaaacagagaggagagaatcatgaaaaagtttatttgcacccgttccactaacagtgatatccttgtaggtaaggttatcaaaggagaactcttccatgcaaacggtaagaaatatattctgctgaaagattctttcaacggggaatatccgcgctgcactttcttcaattacaacactccatttgctttagaaggagatgcttgggactgggctgaactcaatccttgttgtgaggaagaagaatctatgttcttaggtttaaacgtttaccgtgtagattacaccatgtgcggagcggaacattctgttcgcgtagaagccgaatccaagctacaagcacctttcaaggcgggattgactttgggtcattgtttggcaaacattgaagatgttgtgatccaaagagttgttttagagaaagaggctatttgacagaaaacggtgcaatatttaaaatataaagattaaccacaaaaggagagaaaatgcaagttgaagacctgatccagattctgaatagagccaaagagaagggtgctatcaaagactggaaacgtgaaacgagtgaagacctatctcactgttgccgagaattttacatcgaaggtattgctgacgatcattatactatcgaatggtatatcaacttaatgacccttaagcacggttcatttgagatttggtttgatgacattgatgtaaatggttttcatcctggctataaaatcgctatgcagttatcttatcgtagagaagttgtagcacatttgggtttacataactaaggagaaaagaatgcaagcagttgttaacgaagctattatgaacttatccttcttgttagctggtttaggaggtgttctcataggtttggctcttatctggtgtattcgtcgattaatcgggtaccgacaaaaaggtgtttcatgttttgtatcttacaattttacaactgcttacagcaatgaagttggatctggcaatgctcaagcatttttaccaacatatcctcctacggtggaagatattcgaaacttggaagtagaacttatgggactaagtgataactatacatctctagttattcaaaatatttttcgactaaaacaggaggcgtgaatgaaggtacattaccctcatccctttgatcctaaaaacaaagccgtaattcttcgtcagtggcaacgggtttgtcgtactaaatgtccaatcaatagcccacacaatgtagacaaggactatcttggtacatttgttgaatacacttacatagacaaaaacaagcgtaaacaacatgtcgaggaatactgcttaagagtagaatggctgtaaataataaataccttgacaagtgtttattcgttttgtaaagtgggaatacagcaatggtttaggagtggttatgaaaaagtttgttgtttacagtcgtctttctaaacagaaaaaaggtgaggcacaatatggtatggagagccaagagaatgatatccgttacttcttagactctgtgcctgatgcggaagttattggtcaattttctgaatactattcgggtaagggcgattggaagcaacgtaaggaactggttaaagcggttgaaatgtgtaaagctaccggagcaactttattggtagctaaagttgaccgcttgggtcgtaacaacgcctctgtagcaactcttctagagatgatcgatgttaagatagccatcatgccagacgcagataaaatggttatacagcttctgtctgttctggctgaacaagaagttagaggtattgctgatcgtattaaaaagggtcttgctgtagcaaaaagcaaaggtgttttattaggcagtgctaatcctaaaactgccgctgcacgtagaaaagggaaaatggaatacaactctgttaaagcagacgcttttgcagagacattccgtgaacgcttggagatccttagagatttaaatacaccttacaaaactattgctgaaaaattcaatagtaagaaaatagcaacagcacgtggtggtaaatgggatgctaaaactgtttctcgtttgtgtgccagactgaacattaaataggagaggatatgaaacaagaaaatgaatctgtagatcacttaatcatgctgtcagccctttttgccggatgggacgtattttttgaaaatttgttcaattcttctacagatggttccgattttatgcgccagtttaaacgacgaactgttgaggactatgctttctattcaggtcggattgaaaaaggttacgaagatacaaatacaacactcaccattaaagttttagatgtgatgtttagtgttatagatgctatcgacgaaagtcttccgatcctagacaattgtaatacgaaagcctatgtttacaaaatagctcgtgcttatgtgtctgcaaacagttgtcttctttccacccagattgccgtgaacaatcttgccaacttgtttgatgaaggagaaactttttatgacaatcgatttgaagtgtaagaggattcttttagatttctataataattggttagaacacctccgtctctttccaagagaaagtggttacgctgatgttggcttatgccgaggtctgcgtatgtatataagtgatgaatttcgggcagagcattctttagcatattctgtttatggtatgcaattagccagttttgaaaacgctggcttagatacaactttcccatttaacacagcaaaatcttttgatcaagagtgtaaggaaaaactttgcatgtttaatgaaaaacgtgtacagtgggttaaggatcgagttaaacaactggaacaagagttggatttcttctatgatgaggcagaataatggatagacaaaccttaaaaacaatggcagatgccactaattccccgtactttgaaaaagtaagtaaattggtagctcaagccgcagaggaaggatattataacataaacatccataacccaagtcttatactagaaatgccaagtgataagaagatacaagagagtatctgtgaaggtattgttagttactggcgcgagcgtgggtgtggtgcaaacatggctttagacagtgcaaacattgtaagatatataaatatttcttgggggtgattttatgattcaatgcactcatatccaaattacttggagagatgaactttaccatttgggacaatttactgtaggggaaacataccctgtcattaaacataatcctaacatcgcaaactttgataggatggttcttgttgaggacgatctgggtcaaacttattctttagatctaaaatatccgttttcttacggctacgattggatcgttacttttgaagacgtggaggaaaataaaacaatgaacgaaaaaaattcttggtattatcgttgtgaactgccgccagtaggtgaaaaggttatctttgttcctgatttggaaagatattcttgggacagttcttattctattcctaaagaaggcaccgaagttgaagttattgcacatcgcacaacttcgcatggtaacgatgtagcagttgttttctgggatgatgaaggcgctgcttgtgcaggtggctttgttgcaggtaattttgaacccctgccagatcctttgaaggaggcaattttaggcgtagcttcttttggactctcttacacatctgcacaagagatcgtagaaggtattttaaacggtaccgttccaaacgaaatttttaaacagattaaataatagttgcaccccgttctgcggggtgttattgtatatgtaaaggaggcgctaatgtattacactgaagactacatattgtataacttttttaaaggttggttgaaatgggcggaacaagctcctgtcggagattgtgtttttccttgggattctcgtcaaggcttgtgtcgttgtttggaagattggcttataaccacaaactacaattcagaaactaagaaatctacatcaaacagattaaaaatgttgtttgaagaagatggtttagatccaatttatcctttcggtgaggaaagtttccacaatggtcttttccttggcactcaacattatgataaagatcgtgtagattgggtaaaagaaaaggtagcacagtatgaatggggttaagaattatcaccgctggttagaaagctatcttaagaaatgtgaacttggtgttccaggttatacttacgacacggacgagatccttgatgaaatggaagtttggtttaaagagcctcgtgaactattggaaaacattctaatggcttgggatggtacggcacaaagcattgaaggaggtagaaatgagtaagaaattgtttaatattcgtgagaatcgtgatggatcgttctctgtagtcaatgagtttaatgtttcggttgggacttttattactaaacgtcaagcagaacaagtaagagatactttaaacaagtaaatttttaagggggacttatgttaggtaagatcaaagcttttttcaaacgtattgttgaaggaagtccaacagaaggtgcattaggaagatctctaacaggagaaccgcttgccataatttctatcagtcggtatggtggatattcaattaaacaaacacctttaggtatagaaggtagtatgctttcttggacaatatctcaagttggtgataacaggcttgcagctatagcattgcttcgtggggagtatgactattgtttatcagcgccttgtaaaaagcatctcatagagcacattagagacagagtagaaagagaaggcggatacttcttcgaaactaagagaaacgaacaaggaactcttgacttcactaaggtttactgggacaatcatactcgtcaaactgttgaacaacttctggaggaaagatgttaaaagcttttgctgtatactctactgtaggattcttttattggattatagttgttgttggatgttggttgggttcttctgttgtgatgggagaatggttaacatacaatgtatttgaatgggatgtagtttgtagatcattacttgttatatggactgctattgtttgttggataactgttagtctaacattagatctatattgattaatagatggtagatagatgatcatagtttatctaccttcacttacgtttcatacctcactatcgtgagtaacatgaaacattattatatagaaatctactactcgctatcgctcgtaaacatatgtttagggtaccatatttttttgaaaaagtcaatgctgattcacctatcaattatctgtttaagataaatcttacctatcaatctaactcttaactagtattgcacctatagtaagactattcctatagttattaaccctcttcttctgtagaatgtaattagatccttgacaaactcacaaagcttgtgttacattgtgtctcacaagtgaataatactgaacaggaggaagaatgagttccaattttctatacaaagcaaaagattcacgagatggagagaaccattggtggttgatcacagaagatggtgttatcatcctaccgtgggacggagagacgaaagttcaaatactagagaaagtaaaaggtgttagttttaatgttagtcatgatataacaactttcaaagcttttgctatgaatcctagtcttgttgctgaatggtaatccaggagaagatatgactaaaatgtatgcagccgttgataagctggatgggtctgattctgtttttattttgaataaaatgggtgtcttagtttatgcccgaacttctcaaaacatagagcaccaagtggaagcagcgcaaattttagagcaaataacccctccatacctatattcaaatgttgagcgttttaacgatgcacttggtctgacattaatagcggagtggtaataatggcgaaaatgttagcaattgatgatgttgtaacaattactacgtccataccttgtcctcctatgccttgcccctattgtggtggttcagggtatgttatggcggatgtaggtcaaatctacgagtgtaatccgtgcaaaaccacgggttatatccaaatagaatcagaggagaaacactatgagccaaaacgctaaagaaaaagaagtaatcacggtaatccgtcagatggaaggtgccgaaaacaatgcttttgttactaagattcttcttaatatctttgaagatgttattttaaacaatcctggtcataaagattatcagtatgatgttatgatgggtgctttgcttgagattaacaaaaacacttttgctgaatatgagcaacacatgcttttaccagaggaagatcaggattatttgttatctggtgctttaagtgcacaagaaaatttctaccacgttcttaatatggcttatgcagatgaacttgctgtctcccttgaagagcggattcaaatggttcgtgacgtaatgaatgaacaaatccaagaagttgaagatctggtagcagagcctttagcagaaattcgtgcagctattgaaaaacaaaaaggaactcaatcatgatgcaagtaggtgatgtggtttgtcttaaaggtgcaaacaaacaaatgacagtaatagaaagttatggtgaatcttgtaaagtaacttggtttgatgaaaacggcgagttgcaacacgctatattcgatcaaaaagctttgaggaaggttgaagaaaaagaatgagccatccgtcaatatttttctgttttgtagatcttgaaaacgagtctttaatcgttgatagtgagggttacttcacttattgggaatccgagcacgaaactataagtgtagtgaaagaaattatgcaaaccaatccaaacctaccagcacataagtacggtattgcaaaagtgtttgttactaaaacagagtacacaaaagagcgaagcactttgtaccataatattgaagtgattcactatttcaaagatgttatttaggaggttatatggaagagaagatttgggatggtaaagatcctttagaagttggacacgtagcacgtgtcaaaaaatctactacaggtcctggtttttctggtttgtatcatataccagaagaaggtcagcacgttacaattttggctcgtgacaaacaaaacggagcaacgcctgtgtggattgttcgctggtatgacaaagatcttaacatttgcttgtcacctattatggctcatttgctggaagccccttgctctgaagaagctctaatttttgtttcggcttttcagaaagccacaggtttaacattagatgcaaaagatgtgcaaaaagcatttgacattattcaggaagacaacgatactacatctaacgacgaactggttgaagttacaatcttatcttcagcagatatccgagagattgataattgtgattttccaatcacatttaaaatgtcgcagaaagacatgcagtcatctggaagttgttttggtatacctcgttggttttttgattctatcaaaaattctactacagagggatcagactatgatcaagatgacatgctttggttcttaaaaaaccgagagattgttctctcaccacttaaataaggagaaataatggtttcatttatcgtaggtgtagttgtaggctatctgattaacaaatatcaagacgttatcacggcaaaagtaaaagacattttagactcatctaaataatctatcaaagctgcatcttcaataggtgcagccttttaaaaggagatatggcatgactaaacgcactgattttaaatgtatgcattgtgggaaatcttttggggatcatcaagctcgcacattcaactgtccacgtaaaggtcgcggaaattttaaaggttttaatcccgcacatgtttattctccagattacgataagccagaagaagaaaaatttgttatttaataaggaggtcatatggaactcgttcaagaattgtataatgctttaggagcaaaaggaaaagattggcccgaacatgcgcttattgctataagagactccgatggtgagattaagttttcaagcgtaagtaaagagcacatcgtagaaacaaaactgggtatttacatgcgtggaacttattgcttattcaacaccagaatggtagaagctcctgttattgaaaatgggacaaaagattgccccacaatcgtaacaaaagctgaatatgagaagtttttctacgctaaggcttgacacaggaacaatactataggatagtgatcctatcgtagcaatagaacccgcttcggcgggttttttcatatctgtagcaataggaggtcgtgtgttaaataaaatcgaagaaggttgtatggcatttttggtagataacccgtttccctttatggttaaggtccatgtaggagagtatttaggttatgacgaatgggattgtagtatcaatagtgaaatgcaccactaccaaccaacaatacttaagacggatcaaatggcgcgtattacagtagaggatgaattgatcatcgagttatacgagagagcactgcacaagtaagctagaacccacctaaatcgaacagagacgctctaaaatagaaaaggcacccacttgggtgcctttgttttattcttcgttagattgcgtctcagacgcgttaaattcggtttcagtacaacttgctaggtaacttatattttgcatcactacaactacaggtgtttgaagtttatcttctagccccgcagccacttgagccaaggcattatcaatatttgatttcctaacgcctgttccatgtcctgttgccaagtaaagattaccttcccctttttgtgtagcattagcaaagtagtaaacgtaatgtgcaaggtagtaatcacggatttcttcagtcattttattctcctaataagaaaggggccgaagccccttgagtggtttatttgtttaagtggtcttcgaccattttaatgaaaccttcattgctgaaggctgttgcagctttttctcggtaaacaaaaactccacgatcttcatagagaagtgtttcttcgtaattaactccagggttaactacaaccatttttgtcccgatattaagagcaggaaaaagctcccagttaaaattgataacttgattagagcaacccactacaatcaccatatcttgagccgtcaagccgtctaagatgtggtacatatcgttatacaatggggcagtctccccaaagaacactacattgggcttcacatacttgtaatcatccacatcgatagcagcatagccaacatctttgatgattctattgtctacgatcacttcaggcaggaagccgtgaacatgtagaacatcttcatgaacaacacccgcttgttccagaagatcatctacgtttgtcgtgatgttgataacacgatcacagccgtactcttgaaaccattccgcgatctggtaatgcgcagcgttaggagacacactatccatctctacgcgacgtttattgtagaagtcatgagttttacggtagaggttgtatccctctgcatctaatccaccaacagcgccaggaacacactgttcttgctggtagccagcacggaaattgaaaatgtcacacacttcagaaaggtcgtattcatcccacaaagctttaccactttctgtgtcagtgcggaaagtacgaataccgctatcggcgcttaagccagcgccgctaatcactattaatcgtcttggcattcttcctcctcaaatggatcataagaatcgtactcgtaagtatcatcttctgaaaattctacttcgaaataaatatcaaactctgcaaacagacgtaggatgttagacatgctgtaataattatcgtaggcagattcagcttcatagtaaacataaagcaaatggttagccttatcatcttccaaatatttcccgtctgcatacgcatagtctgcatatgctttacctgcatcttccacaagagaacgatcaagcagagtaggaaatggtttctctttttcttttagtttgctcaccaaccaatgtgcaatatcattccattctgcatccataccactaaagcaacttgcttcttctccaaaagaagcttctcctaaatcgccactaatacgaacaacattagatgaactatagccacacgtttcacaatcagagtaactattatgcacattgacatttacttgaaacatattccctcctataaaagaaaagccccctgaaacaggaggctttgttcagatatcggcactataccagactttgaaggtatttgtcaagtgcttcttgatcaccttgacaaacatagcaacggaagtcttgagcagaaggttctttgtcctcgtcccaatcccaatagacagtacctttatagcgtgagcctgggaactcgaagtatgccacatgagtaatatggtgtgggccaccccaaaactctgtaaaagtaaattgaggatacgctgctttaactgtattttcaaaccaagttttacgatctaatgcttcgtttataaaataagcatggcgttccatttcatcccacgttttccagacacttctctcatcaggagaaaagacaagccattctggaaggtagagagtgtcatagtaatcatcatattcgatctcggagacgcacgaagctgactcctccagttttgagtaatcaaaagcagaatatacccaccaaccatcttccagtaacgctttgatagggacgaagcctttatcagcatattgatcgaattgtttgacacggtggcttgtgcagtcttcaaactcacattctaaacgatatgcaccttttcgacgagcctcaagaccgtgtgcactgaaaataacaacacttccttcaccatcattacgatctacttgataagcaactacttgttttgaatttgacattatttctccttatctagaagattgttagacaaaaacactgcacgagcaaaaccacgtgcggttaaggatctaagttgttttgtttttgcactagctccacctaagcttttccaaccccagaagcagcctatatgatctactggtttcttcactggttgaacaaaaccattgccgtgccaaatacaagttttctttgtatacccatcacgggtaggcattttaggatgaaagcttccttcctcttcaaacaaatacccaccatactcataaggatcaaagtaaaaatcgggtttacgccataaggttgaaagtttacctactgggttctcaatcatccaaggaacattatatttgttacccaaagcttccactacacgaatattagctaaagcttcatctagttcctctgtgctacgttcgtgtttgctaccactacctgctaacatagtgcaaggtggaaatccaaaaataatatcgggtttaggtatcccatgatcttcagggttgaatgtagaatctatccaggcattcacataggttatgtttgggtgctccatcctaacctcgtatttaccgtgatccccttcatcagcgtttacacaaaaacacttgtgacctgcttcggcataacgtaacaccataatcccagatccgtcaaacatagacaaaactgttttactcattacccctccattcaagacaagccataactttacgccaatcactttctgtaagaaaaatctcgtttgctttcttccacaaatctaaatcgtgaagggttggaatacgatatgttagttcacagaatctatgctcttcttctgtaatataaccaaaatgcagagccacatcgtgaaaccaacaccaaccatgcatctctcgaacaacatggtcatgctgagacattgttttatgccgtaaacctaaccaacaaggaacagatactttagtagtctttaatctgtgatcaacagtattagagtattcaataatagctgtcagtttcaatcgtgctttttctaaatcctcatgggtcactttgaaataactttctgaaagatatccacacatattaataacctccttcaaaaggcttaactacatgttgattagctttaaaacgttcaacatagtcgttttcgcccatgttttcatatagcttagtaacaacataaaagttttcccaagcatattccctaaaccaaccactagtgatggatgtgcagactttagataaagccattataaaactttgcttaggggttggacctccgatctcttcaccgaaaggaatttgtgaacgttccaaagccaaaacacacgcttcttcataaacacctaacaggcgcacatgttttggttgagcaaaaaacttttctttgctggtcataacttcacttccatctttcatataagatttatatgctggagcatccattaacgcgattgcttcatggatagaatcatgatcataaacatacggaacctcgtcacctttaaagaagtctttactttttacgtttaagttcggatgagagtaagtgtatgtttctttctcacgtaactcataaatactcttaagattttctgggatctttgcgcccagtgaccgcatgaaatgaatatctttcatagttttaaagaagtgaggactatcctttttaaaacgatgactcattttaagaaggtagagcacatctaaaggagcaacaacatgtccagcgtaagttcgacgaacatcatcagaatcttcacaataactaatcaaagcttctgtgctatctccttgagaagcaatatcatattccaaatgtgcaccagctatcattttgacgtggcctttgttccctttacgttctacaagttcaacaaactcgtcttgagagaacatttttgataattcttcccactcttgttctgtacacaggtaatctaaatctacacaagggcgatacaagtcttttcccatgtccatagcatgaatttgtaatgcacggctaccaattaacaccataatatttctcctctattggttgataggttaagtttatcaagcttccagattcctgtcaataaaaaacccgccgaagcgggttattatttactaacacattgaggaagaagagatccaaacacctcttgtggttaaaccattttcatccaactctacaccataatcttcacaaatgaaatcaatatagtgatctgcggctggcgttcctgtagggtaataagtttctccgttaccgtagtcacctatccaagcttgttcctgaaactgttcacagagttcttcaatttccttacgaaactttctttgtgcttgttccatctctttaactttcttttttatcagcagttcgccttcagactccacaatctctccttaacagctactactgtgccaaacgccttgagaattaacgacgaaaccatcatcaccttcaccataacaagaagaggattgccaatcttcaaaacagattgcgtcatcttctaagctaagaccaaaaccagcatcttcggcttcttttgtaagttcgtccactaaagccataatagcttgggctttttcagttaattcttcaatgttacgataactcattagtatttctcctctggttggaaaacggaacgacaggcccacatagaagcttctttcaacttagtctttgctattgaaatttggtcaaggcgggtggatatattggtagactcttccaaatcttcacaatcatccagttcagcccacaattcagacattagagcatcaaagattaatcctaatcgaacttcagcatctttaatagcattcactttaccaattttgtcatcggtatgcggtttataacctttgatatcttcgattcccactttacctcctattaacaacttaaagaagatggatgccaatttgttccagtattctcattttcatcttctggatcataataaccacccatcccatattcaggagagaaactgaaaccttcaccagtctcgtctgctaactgttctgcttccgctaaagcctcataagctgcttttacggcttcttctactgttttaaacttggtcgtcataaaatttctcctctcctaaagacatgttgacatgaaatgcgcggtatgtaaattcgttgtccgttgtgttagaataaaactcaaattgaacaacaccgtcttgagaagacaaatacatgccaatttgaactgttccttctggtaccaggtaagcatactctggacgtagtgttacattgtaaaaataaagttccccaacacccatttcatcccaagcttcccaagcggtaacgaagttactttcaaaacttgttactgatccgaactctgccataaaacctcctcaatcttgtagtttgactccatctccaacacatttccacgaacatctctccgaagaaaggcataagctttattaggtattgtagactcatatttaaccatatctggcacagcaaaagatactactactcctgctgggcttctgtcaagagccttattaatatttctaaggatatcgttagccaagatttctgccaattctccaagaacagtttcggttatatctttatatcccattaaatatttgttgatatctttcatctctgtattgttcagagtatagtctaaaggataaaaattcaaagaggagtcacttttatgtgtccacatgaaatgcacccgatccgagcagaatcgtaaccctctacgaagaatatcttctacaacagggagaatttcttttgtcacatcattaaccatgttgtaatctaagatttctgccaagtttgttctttgttcaccacgtttacgtctaggaatcacttgttattgccctcattaccaaaggtcgtagaaaatcgtaaatctcttgttttgttttcccacgaatgtttaaacaaggaacattattggctttagctatcttccaagccgtagctgttccaccttttgcatctccatgtttatcagtattagcacaagccaacaagaaacatgatggagcaggattctccaaatctctgcctaacacttgatgcacattacgttggtgcaattttctagcaccctgcttaagcttttcataagctgggtgaacatctttgatccattgcacagagatagcatagttcattgtatctggttttgcaagaacaataacatcacctggaatctgattacctttgaaattttcccaaggaacataaatttccttgttagtaggattttcagactcttggacacctgtttcaaaagcagaatcactaccctctgccttaccagaccgtaatttaaacccaaggtttgaaagccatttccctatgcctaccatcaaagcccactcttcttcagatatgtccctacttccaactcctgtatagaacagttctgccataatcacctcaacaagtaatttcaaaaggtgtatagggttccgtatttctcataatccaaggactgctaggattgctcggatcataaggaccaaaaggttttatggtaggttgtgtttctttcttctgaatctcttcaaaaatacgacgaagttcagaatattcttgatccaccataagattcggtgcatctgattctacagtttgcaggttatcttccttaagaacaatctcacgaacaagattaacatcttctgtttctaagataacttctttacggatattacctacactttgaataattgtaattttatacattaatcctcctcaagagttgaataaaattgaagaccaccatccatatcgaaataagcaaatgttaagttattattgaacacagatccagtatccatataaacacgattcgcattgataataggtgtttttacataagagtgtccatgaaacacataatccacacccatcacaacaggaagtttcattccctctttagcacagtctaccatatctctgtcccacataagtgcttcagcaaaacggttttcctgtgtttttgtcatcttcgaaatgtattctggaagatctgttacagggagatattccaaagaagatggatacccaccatgaataaacgcaagtttcatgcctctgtagttaacaatgagaacaacaggtaaatcttctgtcatcattgctaaggctgtagctccttcttcaccacattcttcaaataccgtatatcctccattttgataccaacactcgtagtagctacgatctccttccagcatacctttaatcatcatgtcttcatgattgccacgaatagcgtagcgattgtgtttacgagtaaattctaaaacacaacgaaagttttgctttccacgatcagtaagatctcctaaagatacaaccacatctgtatctcggatacctaactttgcctttcctttttcatacagattataacaaccatgtagatctccaattataaaaagatcttgatcgcttttaacagtaatttctctatgtatgatcacttatcctcctcaaaatctaagaaaataaaaatattcacctttccttcaatctcttgttctaaaacaagatcggcaaattctgcataagctttctcttcaactttttcaatatgctctgcggcatctttaaaaggcgtatccccatccacctttactaataagaaaagagatcgcatttctacgcttttactgttacgaggaaggaaatctacagcttcaacaattctccaacccaaatagccaggggttttatgaatctctcctaaatacttttctaagattttacgaccctcgtcgataagggcttgttctgtagtaatttccattccttcctcctcaaattattaacgaaaccgcatgactaaatcttggttcagatataacctctgctacagtaacatatgtatcgtgcagccaaaaagattctactctacaaacacaaataccgttgataatgaaatctacacaggctttattattttcgcacacttgttgactataaacaacccctaaagagtcataaagtgatctcactgttgctaccatttcatctgtttcgtcttcctgtgaaacaaagaaaacgaatacagacaagttattagcgaaagtattgctattctctacttcaaccgacttacaaggtaaaaaggagtaatatttaccattaggtatcaatttcgcctcaacctggttaagtatgctttgagatggttttgttacataaaaaagattttctgttgggttttcaacattactccttactatgcaacgagtggggttcgaaggatcaaaaacatgatcgaaatcgacacacacaggtaagttaacaactttaaactttttgctaagaatgcttactgctgtaaaaatcaaaccagcatttattttgccagtgaaagttgaacgcataactactcctcggatcattctaccaaagagaattccgcctcttccaggtagattacagaccttgttgcatgatatttaacgctccagaaattaccttcgcgccgtaaaagtatctcattcacatcaagattgcttagaaaaaccatataacttaaagcttgttgacgcgttgagaattgtttctctaaaagttcttctccgctctgcataatccctccttaaaatactccctccgaaaagggagtataagtatatcacgtagttgttatgttgtcttcttggattctagaatccacttctgcaaacatatcttctgcactgtaattatttccagtccagcgtgataaaaggatagcaccaatctcttttgcatgagattcggactccgcataaacgttagtcccagtgtcaccttttttcttttcatgtgcataaatgcagtaataattgtaagccattagtcttcccagtcattgccctcggtagagtgaaccaaagctcgcacgataccgccgtaatctactgcctgatttgcagcatgttcggcataaacttcaatggcttttttgaagaaaagagcagtagctgcttcaatattatccatttcgccatctacgtcagtagaaagtgaaaggttgaggctttcatctacttcatcaaaatcaatagccactgtcataattagtttacccatagttcacactccttaaacaaaataaaatggttgagagaggcccaaacgattctttgggtcgtatacataccaagcgtatgctgtcttatctgttccacctgcaacaaacgaaggccgttctgaaaggactataaggtttgttggtggattcttttgatggaactctcgtcgtttctttgactccaagaagcccaaccgaagaagataaatacaaacatccgcctcttttaagctcttttccaagaactccattgctaacttaaatggaggatttgtgattataatatcgggacgattttcccatttatgactaaaataatctttaccttcttcaagttcgcaatattctgaaccttcaggaaaatggcgataaatcgcttcagcttcacctctacaaggttctgcaaaaacccaaccttcttcctttagatttttgaaatctataacactaaacaaactattgattgctttttgcggtgtcggataataatcgctcgttgggcgatcataatctaatgccatctaaaatctcctcttttgtaatattatccaactctttaaaggatgaaatctcgtttaataatcctatttgatcagcctctagaggataagtgtttttatctgtttttctagacagaatatcttcaacaaacttatcaatagccaaagaagaatcataaaattttaaaagttggtaatccataggagatattttgtcatctcttagaaatatttctaacatgttttcagtagtatcgtggtttagtgtatgttcaccaaaaatattaacttcgtaaacatctttgccaaaccaacgtttcttcttttcaacagtataggtttttgccaccagaccatctaaacagtttcttgccctcttacatgtttgacggtaagagtggatagcgccttcaacaaacttagcaggaacttgtaacattattaatctcctatgtttaagaaatgcccccgaaggggcagtttgttaaatagcggttccttcgaaatccgccacatttacgagattaatattttcagatttagaagtcaagttgttttctgcaacagatttttcttcagtatccgcctcgttacctgccacgttacgaggttcttcttcaccgtagggattaccgaatttcaaaagattgatcaattcttctttggagaagttttctaaatcatcgtctgttaattcaataatctcgtcttgttcttcaataaatgtttcaccaccagaaaaagcatctcgctttttagctacttccatagcttgttctggtgttgcccctgcgtcaagagcagctaaagcaaagtctgacccacttcctactgcataatattcttcatcaatcggatatgcacgtgttgggttgttaccttcgtgcaagaaaatacgtccgtctggatgaacaacaagtgcaataaactcttcatcttctttatctggatcagagtgaatcatcaaaccagggacagcatcacgtgctgcttcgcactgtagattttgttcaaaccattgaaagaaagaaagcacggaggtcagacgaccagcaccacctacaaggtaatctccaatttttcggacctttttgaaattaatagaatctacacgtccaccaaaagttaccttaccgtcactcaaaatcttatttttggttgcaataattgtcgtcactattcttcctcctctgttaatgttttaagaaccgctttcccgccattcacatatttgcagatgtattctatcgcacgtagtgtctctttgtcaacaaaaatttgatcagacgttgcgagcgggttattaagaagatcactgcaatcacgaacaagcagtgctttcttattaaacaaattacttaagaacagtaacttcgcctcttcttctgttatgtgcagaaggctaggatcggagccagctattcctattatacaatcaaacaagctttctttactatcagaaagttcttgaaaatggtttaaaagccaatcttctcctagacaccaacatttaaacatttccagtttatctcggagggtcatattctctaaagtaagagcaatctctttttcaatatggtttacacaaatttgacgaaattcgttaggttttacgagtcccgtttgatagcactcatctataccgcttcttccgatagctattgttgctacacccatcaatcctccttataaatggcttccctgccatgtcattaaataaacacttcagtaatcagtttagacaaacgtccacgtttattatcgtccgttgtcagttcaacgtatccaataaaatctacaattggctcacgaacaccttcttcattttctggatataaaagttccaaaatttgatgcagaccattgctacgttttttaattgcatatgtctggcgaacatcgcctaatacaataacatgcgtattaatacctgcacgttcaataagaagtttaagtgtttctgttgacataagttgtgcttcgtcaataatgacgattgtattatccagggtggcccccaacaaatagttaggaatattcaattcgatcttacctgatccaatatcgttttccaatttgttggctgtcatgaattgctggaaaatacgttttgtagattcatagtgtgctgctagtttatctgttttatctccagacaagaaaccaatctggtcatctccgacttcagtagggttcttgataaaaagtagtttacggaagtctcctgaacgaagcatctgcaaagctttccataaagcaacagaggttttaccagtccctgccggagcatttacaacagtcagatcattccaaatcatgctttgaacaatcttattttggtccccttcaggcataaattcatctaaacggtaatcgtcattacctaccgcttttgctgcataacggctttcaatctttgctgaattagccagtttctgccgttgtgttttagctgcggttttatttcccatagtagcactccttttagaaggggccgaagcccctttattagttgtaagcatctaaagttccagaagtcagaactttaattactcgttcagcacggtttggcgtctggctataccatcggcttttacgcatgtttttacctgcttgagtataatatgcattgctgattaaagtcaagctattttgaaacccttcagcaccttttaaccccaactggaaaaccatgttgattattcccaatttacgagtatcactaaccttatcatagattggtgataagatagcactgttttttatgtctctcttcacttttgcaacatcgtcagcaaagatttgacgggcttctttttctgtgataactccattagtcttacgaccaagaagattatctaagatttgaatagcctttgctttatcttttattttagtcagaaggtgtcctatgccgactgtccaataaccaagatggtcttgataaacagtaagcttcagtccttcatcgactcgtagcatatcaaactcatctactactttagccatttacttcctattcgtcgtctcctactccgtgatccaactcgttaaacaacagatgttctggagaagtttcacgttttggtttcgttttctttatgttggacttcagctcatttgccaaagcacgagaaaagatcttacgtttctgtttacttttcataattgttactccgcaatttgagccatgagatcacgcagttcggtaaaaccgcctacgtatgttacctccccgttcacttcggacagaatttgtggaaatgtgcgtggaggaactccggtaagatcaacaactgttttagtcattgattctaaatcatagtcttgatcaagacttaaatattcaaactgtttattgcgcatggttaatagttgttttgacatttcacaaaattgacagttaggtttaccaaaaattacaaattccattacctctccttattaagtaatactgctaaagactgttcaatacctttatttaaatctgattttgtaagatagtgactggttactagttgtgacttcaccggacgtgctgctggagcattataggttgaagctgataccgccgatatcttaacaggttctggcatctgtgtcaagatcttttccgcaaactccgcccaagaaataagatggcttcctgcaaaatggtaagtcttaacagaccttgaccaacctgtttttaatacttcaaaaatagcttctgctaaatctggagcatatgttggacaagagaactgatcagcaacaataataaaatcacgttgtccatcattatagcgagacaacatggtttttagaaagttatttccaaattcgctatataccgaggctgttcgaataatatatgcatttgggttaactcctcgcaccattttttcaccaagttctttcgtatacccataattgtttattgggttaggtgtagtatcttcaaaaataggatgagaataattaaaaatatagtctgtagaaatatgcacaaaatcaattttaagtttgctgcacactgccgcaatatttgcaggtccatacgcattaacagccaaagcagtagcaaaatcatgttctgctttatctacagccgtataagcggcgcaattaataacaccatctacataatcttcaataatagcgtttcgcacagcttcaaaatttgtaatatctacacgttctttaggataaattaaagatacatttgaaggagccactttacgtaaagcttgtcccagttgtccattaccgcccaataccagatatgttagcatacaccctcgctacgtaactgttgaaaagatttagccattgcatcttttgttgatagaataggtttaaaaccttcgtcaaaaatcatatcgaagccccaatcgatccctatatcaggatcatcccaacgtaaactttgttcactagaagggtcgtatggagttgtgcatttgtattcaaagatagcatccatactcaaaactataaaaccatgagccaaaccaggcggaagccaaaactgcgtatggtgtcgtgcacgaagaacaacaccgtcccaagcaccgtaagttggactatctttacgtaaatctacagcgaaatccaatacttccccacttacacaacgaactagcttaccttgcgggttatttgtttgaaagtgcattcctcgcaaaacaccgaagtttgatttagacatgttatcttgaacgaaagtttgtctaccaataatatcttcgtatttttgttcattatatgtttctagaaagaaaccacgatcatctttataaacgtctggtttgataattaccgcaccttcaatttttgttttttctactttcattttctctccgctaatttgagtaggtattgcccgtactctgttttcttcagtgagtttccatgatacaccaaagtctctaaagaaatccacccttttttgaaagcaatttcttccaggcacgcaatcttcaatccttgacagttctcaatagtctgcacgaattgaccagcttccatcagactggcgtgtgttcctgtgtcaagccaagtaaatcctcgtccgagaacttccacttgtaacttcctgtcttctaggtagctgcgattgatatcagtgatctccagttctccacgcgcggaaggggttacttctaatgcacgttgaataacagagttatcatagaaatacaaacctgtgacagcataatctgatttaggattttcaggtttctcttcaatagaaatagcttgacgattactcccaaattcaaccacaccgaatcgttcaggatctttcaccaaatacccgaaaatacaagctccgccccaaacatctaccatctcactggcgttaatcagtagtttaccaaagctttgtccgaagaataggttgtcacctaaaataagagcaacagagtcttctccgataaaatctttacctatgatgaaagcttccgcaagacctcgtggctcggattggattgcgtaagtgagttttatcccaaacatagacccatctccgagaagatactcaaagtcttcctgatcacctggtgtggtgatgattaaaatatccttaatgtcagccaacatcaataccgataaagggtagtagatcatgggtttgtcatacacagggagcaattgcttgctcacactgcgtgttaccggatgaaggcgggttccacttcctcccgccaaaataatacctttcataaccctccttaaattttctcactccaccattgagggttgtttaagtaccattcaatcgttgagtagagatcttgttcaaatgtagagtttgcactccagcccagttcagactctatcttagaaggattgatttcataacgcaagtcatgtcctttacgatcttcaacaaaagttatcaagttggaagaagggtaggttactgcttctggatgtacagtatccatatagtcacaaaccatatagatgatctccatattggttttgggattacgtgttccaacattatacgtttgacctggttctccacctgttgtcacttgaagaatagctcgcgcatgatcctcaacaaaaagccagtctcgcacctggtcgcctttaccatacaccggaatctctttattcgtcaagatacttgtgatgatttttgggatcagcttttctggatgttgataaggcccaaagttattggagcagttggttatcacaacaggcaaatcgtaggtgcggtgccaagctttcacaagatggtcagatgctgccttagacgcactgtacgggcttgaaggggcataagctgtctcttcggtaaagggaacgccagagtctgccatatcgccgtacacttcgtctgtggagacgtgtacgaacatcttcagtttattttttgggaggagccttgcagcttccaataaattgtatgtaccgataatattggagtcgatgaaaactcgtggattcttgatagaattatccacatgactttctgccgctaagtgaatgatgaagtcaggattgcactctactactaaacttttgacctgggtttcgtttgccaaatctgtcatgcttagtttaacgtgagtgatatcgcctacattctcaatatctgctgcatagcccatcttatcaacgacaaaaacttcgttattaggatcttgacaaagagagcgcaccacggcactcccaataaaaccaagaccacctgttaccagatagcgcatcagttctccttaccagacatgttgagaaataatagtttccgttttaatgttatatttttcaagtagctttgcataggcttcttttgcattctcattcaattgctcaagatctacagctatgcttccctctccgccttctaaatcaaggccatatatgcaataagactcatccgcatcgtagaaaggagagatgcggcttaagtccagaccttcttgtaagaaccagttaaaatctccatcaaattcttcttcaattctaggatcttctcctacagcctcttcccatttattaaaaggtgcaccctgtaacatacgccattcgatatcaatacccatttttcatctcctcctcttcttgagcagctttaataattgcttcataaatatcgtaagcaatgcctccacaacatctagcttcgaaagctattgcttctgcaatgtgatctgttaattctcgtggaatgcggacatattctttttcactctccatcttctacctccaacccttctttttcaaagattactactcgtccctcaccatgacaattcaggcaaggaaatgttaccataatttccacttccatctgtccagtcccaccgcacacaggacaaaaaataagtttttcagccattattcctccttaattatttcaaacttggcaacaccatttacaataatatgaccacaagacataactcctagccaaggatcgccgtttttcttcaggcgtttaccgaatacatcacaaaaaccattcttcatttcggaggcttcataagaagcccctttgtcaaaaacgtctttgaatgtgtcgattataccaacacatctcaaaatcattagaagtcaagctcctcatcatcagagagatctttgttagctgaattcaatttgtaattagttaactgaatctcttgggctgctgactgaatcaaatcaggattcaaccatttttccatccaagctaaaggactatgtttaggtgctttaaacttggctttcattttcaatcgacgataaataggagcagcattgaaataaacccactgtttagacaattcagcgttaagacctacaataaaacgaccttcactaaacaggtagtcacaccactgttcctcttgttcaacaacagtgtcgaggatcaaagtcaactcttcaatattgtcttcgtaaattttacgccaaattgggtcatgcatcaatgcatcaattacagcataatccatcttaacatgcaagatttcatctagcataattttctggatcagtttacaagccccaacaaacagttgttgttctgccatagcaaaagtagcagagaaggaagatataaactgaataccttctaatccaatcagggctaccatccctttaagaatcagcagtcgaagttcatcgttagcttcaatcaatcctagagcatacttatgaccagcttcttccaactgacccatgatatcagcaatgatacccatacgattgaaaattttatcattaatcataatctgattgatgacttcaattggatctggagtacattgacggattatttcagaatacgttaacgcatggagaacttccatttcactctgcttcatcatcatagcacaggcttcattgttactcaagaatggagagaacaaagtgatgattgattttgcaagagaatcattttcccattggaacgataagtttttaatcataacatcatagttgtttttagaacaagctacgaaatctttacgtgtctgatccagattaacttcgttttcatcccaatcttgtgctttttgaagtttgtagagtttgtgcatttcagggtaagtcacgttgatagaatcaaaaatccccaactgttcccccatgaaaactggatatttacctgttttgtaagtctcgttatgtaaattaattgctgccatttaaatcctccactatttcacaaaaacctcttaagcttaaaatatcttcttcctcaaaatcattgctccggtagaaagcttccagtgcttcccatacgcttctaccaagtataacagtcactgtttcttcacttcttgcccttgttattgcgtaagccgtggcttctggataaaaagattcccaaatctgcatgttagctatttcaagaccgccaagataatggtgacaccaagtaggggtaaaatcttcagggcgaatcaacagaggcttaaacccaggtcggtagattggggttactccaggtaaaactataagtgtgctcataatcctcctcaataaaaaggggctgaagcccctagtttcatcacattttgcaagcttcacaaccaccatcagaatcttcttgtgctaaagagtctgctgattttgttctactgttaaggtaatacaatgacttgccacccagtctagcaaaattcagaataaactgcatctcagctttcactgataaacgtccacctaccaatttagaataatctagccaagaatcacaagaaattccttggtccgtaaacttggtaaagataccatacatttctgcaagatctttagccggagtgtcccaggcagactggtagaacattttcagtttttcatagtctggaacaataaataatacactacctttctgactttgtttatacataatagtatcacgaacaggatacagagagttagtagtattgcttaccaaactgctggactcattaggtgcaatagcagccaagacactgttacggataccaccttgttcaatgatttcagcacgtaagccttcccagtccattttaagatcaaaattaccgatactatctactgttttagcataagtgtcaattggtagccaaccttgaggccatttggtcttatcgatccattctgcattacctttttccttagccagacgcagagaggcttttgccaaccaaaagtaatgacgttctgcaagttcatgcattaattttttagcataagcgtctgaataatttacaaaattacttgccaaataatgcgctaagtttgtaatgcctacaccaatagatctacgtgctttagcagttatttcgttatgtttaaatggataatccattgtttcaataacgttgtcaattgtcaatacagtgtagtatgcaacatcctcatattcttcaggtaagacacgaccagcaacaatagaagataagaagcataaagccaattcttgattttctgtattctcaccagtaaagagatccggcatactgtggaaagctttagttggtaagaagatctcttgacacaggtttgattgatacaccgtatccaggaaaggtgtatggttgttaacgttgtcagcaaagaacatgtaaatacgtcctgtttctgcacgttgaacaataatctctgtcagaagatcacgagccttaacaaattttttcttaatgcgacgacggcttactttgtcataaactgcatcaaactcttcttcacttttatacaaagcttcataaagttcaggagcatcatcacaactaactaacatccaatcttcgttttttgctgctcgacgcaagaacgaacggttaacaacaatagaataatccagtttgtctactcgtttatctataggtgttgttggattcttcagtcgaatcagatcgtcgaagtctggttcaagtatggtaaaggtaactgtagcactacctccacggcttgcttgcttcgaagctccaacactatcttccatccatttcagatacggaagaagaccaccatgaataatacgattattcttaacaccttgacctgtggcacgagtttgaagattaacaccaatacctgcgttattcaacgtatactcatgagctaagtaattagcaatggctaaagactctgccgtatcgtctgcacggaacaaacaacaagacgcacttcctttgattggagttcgtagagttgtcagatacggcgatggcagattaatcttaagatcgctaacataagtataaagttttttaatatcttctatacggcgttcttttggttggatctccataaccttcattgcgataccaatgaaaagaaactgtggagactcatgcaccacatcgtttactgcatctcgaataagatatttatctaccatctgacgtaaaacagaataaccataagttagatttttattatgctttacaatcttaccgatttctttgatctcttcatcagtataatccattttagcccaatgtccacgttctaccatatcatgataaaaggtattcagtgaagggatactgtggtatcccccatgagcctgtttgtaaatcatacccagaagaagtcttcctgccatatcactgtaagcttgtgttttcttgtcaatacacgctgcaatcattgctttatgcagatcacgtgtagacacaccgtcataacaccgcttcacagcttctaattcaatttcagaccagtttagtttacctgctgcaaattcagaccacttgcgaagtttttctggattaaactcctctgtcttaccgttagatttagttacaaaacgaatcaacttctcctccctattattaatgcatattcaaaacatctacatcataaccgaacttcatttcattaaaaagtccattagcatatagaaaaccttcaaaatgagttatgtcatcaaacccttttgcttttgctcgacggtctgcttcttgtcttttaggagataaacgttttgaagtgtctagaattacagttacattacaaccaacagtttcatcaaaatagacttcgatttcacagccttcatatttattatcagtcattgtccctctcattgattagtatcatctgctttcgcaggatcataagagttaccgaaatcatccatcttaatatgtgacgcaccccaacctgtaaattcttcatcaccaaaatgaaaaatatcattttcttgatagattcgtttaaaaccacaattaggtgaaacagggaaagtgaaaagcgttgtatttgaaaacactactcgcttatcgttattgcttcggatattcacattacactcaacagaatagtgtgaatcttcagccatacccagcattacaagcgacgctctaataacagcattttgtttctcgtgtgggatattgccattgtgtttatttgattctagtttccagataggggtagacattacagtagacatgcttacggtagcccaagttgtagtatttactaatgacatattttctccttcattttgaatgggaggactcacctcctcccagtattgtgctatattatactaaaactaatactaaagtcaataactatttaaacagatcaccatttagtatgatttgttaaaagttgacgatgttgaatccagcctttgaaattgccagaccaaaacttaccattacgatctacatgggtaatacctggttcccaagagttaaaatcccaaggagcattgataaacaaatcttcaaaacagttctctccatattgttcgcatgtttcttgaattggagtggcttgatgttcaaacggagaagcatgaaccttgcgcccagtcagcaaacgaccatagatatctaaagctttatctttagttgcatttaaacgacgatagctaacctgtgcacaacacgaagctgaaatagctttggcttcttccaaagtaagcacaacaacttctccagattcatcttgaacatagtatccaccaaaaacaaaatgatcgtcaccttctgtaccaatattatcatagaaatggtctacataaggtgtgtgccattgccctggtttcagcacttctggtgtagatccttcatactctttgtgcatctctttagccaaagcttcgatagtaggatcggcttctttgtcatcacgtagccaccagaaattttcatattctgttgctgtcagaactgttttaattcgttggaaaggttccagaagacggtttgcaacttgtttgtggtaccctgccaaagagaattcttctgcgaaacgtgctgcactaagcgcggcaagattccaccactcttgagcagtataacctgcatcaataagagcgtcatgatcaacacctttatcctgcataccaggttggttagccccaaaacgataaggacgagcaggttgatttcgcaccatttcaatcagtgttttaacaggtatagcacggctagaagcagcattacgactgaacagtcggtgagtcatcaattctgaatgaataatacgtggatattctagttcaaaagttacaatctcttttccgtcttcagtgatggaatgcgcaataatactagccgaaatctgtcttgtcattttttctccttagtttttaaaattgtttaaagtgttaaaaacatccaaacatgttagccactgatcttctaaacctgtgatcacaacatttggttttttctttagttcttctaaatggttatctttataaggcgtattaaaatatattttaaccacttcatctggaaaatatagtaggttatcagccctgtcatctattgctatatcacaaggcaataagtatttttctttcgtagcaaaaaagccgttaccagatcctttgctaaaatcaatcgtatctaatgttcttaaaacatgtttatgtttagaacttaagtgaccaccttttgtcacacttgcgatcaaaagattgctacctttccttgaaacatactttaagaaatctggcatacctggaacaaaacccattgtatcatagagatgaggattatccagaaatccgtaaggatctatattgaactcctccctgaaaccaggaaagtagttggtaagatcgtagtctgcattttttgtgaatgtgtctatcttaacaccaagtccactaatcttattcaaccattctaaccaagcaacatctaatggagccacaactaaatcccaatcacatactatctgcataaaacctcctctctcttttagtatagttatcttatactaactttcaatttcctgcaataggattttgactatttgtttacggcgttttgctactgtgctttcaggttctattttacgcttcttcagccacgctttatctttcttagctctacacaaagctatcgcttctttttcagcttttgcttcttcaaaagatatgccttgcttgtctgcataagcaagaatagagttgcacaatttacaaaccattcgcaaatcttcttctttcacatagatcaaacggaaaacaaaaaggggaatatcctcaaaacattgaagttgttttgctgcgtgaatatgatccacttggaagtctttcattcctcctctgtgtccacatatttcgcactcacaattccaaacttgttttggttttccagttttcttgtctatcatcacattgccgtctttatctacacgatcaactttaaaacgccttgcattgataaccttaattttattagggtgtctcatccatgcttttctaaaacatcccctaagataagtataaaattcagcttgtgttttccagggtgttccttcaccccacattatttttggttcacctgccaatattgctcacctttttagctgtatattcccctggtgggatattatgtttaaaaaacaaaaggcggtctaaccccgccttgcacattgtttctggaatagtcaaagttagtaaaagtttatcaccttttcggttgaatattttataaacttctcctgctccatattgtttagtattgctcgccactaatacgttccttaagttgtttaatagcttcgattgcatctacataagaagagttatacatgtgtttcagtgctactcgtattaaaggatcttttgtgaagaaatcaataagaagcatagcttgatcatgtttagctgcatttgtcatagatggataattttcacgaaccatatacgtgctattttgcataagggttctttctagttcaatacaatgaatagctttatctaggttaatctgacgttcacctttaatacgtgttgcgtattttgccaatttgcaaaaacaaggtgtgccaccaaccaaataagctagttcaataggttgcattaccatttttgtgtagtgatcaccgtcaacctgattatcaaaagcattagacataattttcctcctgaattcctactgcaccttcttctgggtagtctgcataataagctaccctaccttgatagataatatcaccatcgtcattataaattgctgtaccttcttggattgttatttcaacgtcaagtaaatctgggtctttctcgatggtatagttcaaacctaacatttcaaacagttcgaaaatttcgttacctgttaatgtaatgctcatatttcctccttttattgtggttagcagagtatacactaatataaaatttttgtcaataaaaaagggagcaataagctccctgattattagattccaatgatagttgctgctcgtttatccttggatctggtgtttgctctactacgtgacaaacctccacaagattcacaacgaatgatatcgaaagaacttaccgcagtgtggtattgtttaccagtaacaacgtgaacgtgatcactgccacaacgagaacaacggaccttctcatctgggtaataagcggataagttaggatgctgtggaatccacggaaggattttcatatacaaatcacggagcgaaacaacatcaccatcattgtaaatctgcatacgttcaaaagcatcacgatcaccttcacaacatgctttccataaagggaacccctcgttatccagtttttcactttctgtttcgaaatatgctcccatttctttaagggagttggaaggaagtgcaaattgtttcttagctgccttcaatgtatcaacaactacataattagaaggaggagccatatcgtgatatgcaaatcgttggttaatgtatgcacggtcaaacttatacccgttgtgtgccacaactacatctgcctcattcagaaggttccaaagatcttggcaaagctcccaatcatctgtatgatcaatatcaaaaagaggataagaagacaagttcttaccttccacttcaccagtatacaggtcagcagaagagtaagataacaaataacccctacgaattacttgatctggagaaatgaaggctttgaatcgacggaaagtatatgcaatctctggtgcagtttcaacatcaataattttaataacgggttgtttctttttaactggctcttgtttacttgctccaaatcgtgcaaggaaatcgttcactgtgctttttcttgttggactacctaaaacaattgctgcaatattacgagaagacataccctctgcactcatactaaggatatctgctttctgctcttctgttaatctgctcactctgcctcctgttgtgagatgtatgactgaagcatactctcaaatgttgtatcgtcattatcccagcgtttcatgtataccaactggaaaattgtttctatccattcatctgttgtcatatggacttcttctccatcccaagaagtaaaattaacaccatctgggaaccatgagtagtaagtatctttaactgtttggaaaagttctgcttgagttttacaagctgaaagaagattaaaacaagtaatatctccgaacttaatatcaaaatcttgataaggtcggatactatctgttttatctcccattagcatctgatatgctaaccagtaactgccccaacctttaacttctttctttttacctttatctacgatccatatatcgccaatagactcgtcaataagaattatatctggatttttaaatactccatcctctttgtagaaattaaaaaggatactaggagtatgtaaactatctttatctatagatactacgatataagaaaatttacccgtccttttataatctttatagccttggaaaccatacttctctaactcatcatcagcttctattacagtaacaacatcaccattgtggaactccacaagataatctttggtttctgaaagctgaaggggtttgatatctaatcgttcagatttatattctacaggcattttgaaggcgtgtctgaaagtttttcctacgccaataactccgcaatatttttctaaacgtagatgttttagaatacctaagacttttgttttagctgcttggaaggtgtgtccgatatcttctggcgggtattgcttatcaatgatttcgaactcttcctttgtgaagggacgtttgtttttggaggctctttctgcatttgtatctcctagccaacctccaattttagtcttgcttttaccccaaaactctgtcttatttttaaattccttttgagcacctgaagggatgtgcttcgcaatgattgttcttttctctaatgcagatgctgcttggaaagcgatctgatcataatcaattgcagctattgtttcttcgttgacatataaatgaagatcttcaggtttaattaaaatataaccgctaatatttccccctaattattcatcgtcatcctctgttgagaatgttttagtatacggacattgacgacttttcgggattgctataacttcatcttggttagcgttagaatagtagcaatattttgtattgccattaacttcagaatcagacaagattaaagtaatttgacctgctgctactgtgaaactaaaagctaaaagaacgactgtcagaatctttttcataacgcctcctaaaaagcctacctcattaagtaggtaggcataatatcataactaatcccgcaagtcaagaacttatttaaggattgttgctttggttaaatcttccatcagacctcgaatctcattgaagcacagaaggaccgaagcttcaatactaccttcttcgtctgcaaaatatttcggaaaacgtagtttagaaagtttaaactctttatccactacaaaatctacaacaccgtcatattcaagaccgattgcaacaacatctttaccatcttcttttagttcgacagctttagactcgtatagggattctttactccaaacaacaacgccctcgctatcctccattttgatataatttccgagagtaatacgatctgcttcgtgattctccagcaattcaccaaaacctttcacaatagcttcttcatgcacactaaaacctaccgaagggaaagtccccagaacggaacggaggaaagaagtaatctcttctgcaacctttttacttccattaagaacataaagaagattcgtagttttatccaagacaacatagttaaagaaatcttcaggttctgtttcaggcaatagtgcaaattcaatatcttccttcattgctttgactacttctttatcgacataaaactctttaccttcgctctccatgtcctgacgcatttcttctagacgttcattcaaaatacgtttaactttctttttatctaccttcttcacagattgacctacattaagcagttcaagatctgaaaactcttttacaaatttagagtcatcttcgaaacgaacaagaccgatagtgtgtgactgggagccttctgctgttacaaattccagaggaatatctgtaatgctgttaatggatgctacagaagcattgtcaccaacaaccataggcagagcggatttaaaagattttacaaacatgtttcctcctatttaatacatctcacattaccgcccgtaaagggcggcttacaacattacttgttaataatacctgcaatattaggtttgacaaaggtcgatggtttcatgatcttacctttatcatcaaagaacacatacactttctgtttttcattataaacagcatgaacaccagtgtatgccccttctggacgattggcatttcgttcttcaattgcagcgcattcttgtgcaatggctgaatcgatatccgaagttttccaagttttcagcaactgttgtttagttggatacttggaatcattacttttcaatacctctttaataactttcttttctggatattttgaacggattagagtgtcacgagacatacgcataataccagcagccattagtgccatttgaactggctctgtaaatgtttgttccaaagcatcaaaatcagtatacacagttggagtaaaaacatcgcctacagcatagtccaagaaattcatcgtatgttcttcaccaaagaacatgtaagtcagataactggatactacaaaaatatccgctgctgcatccaagagttctacatgatcgtttactttcgcggctgtttcatactctttaagctcttcacgaacgaacccgatttgggacataaataactcttgagtgaattcaggttgttcaccacctcgtgctttggcattccaatcaattacgtgctttgctgcatttttgaaaaattcagtatcgaatttaatatctttaaaaaaattctcgatcattataactccttatttaaaatagctttctagaaagttgctaatatttactacagtctcacccatgtaaatccctgcgaaaccgaaaacaagcatacgtggaatattgaaataccatttatctgccggaaaagatgccagaattacaatagcaattgctatcaacatcataagaattgttgctaaaattatcataaaaatgcctccaggtattttgcacaatgataagctaagaacatttttcctccttattctgctggttcccaagtgcctgggatcatttctcgaatacgaacaccaacaggttttgttggaataccttcatctgaaaattcttcatactctatttcaacgaactgattaatcaaggtagaagcattctctgctttacgataattgatagtctcatgagcatctttacgcattaagaattcgactactttaccattttccatctcacctgtcaacactccatcgccatttttatcactttttgaatttattactttaacttcaagcgtatgacgaggcttacgtttaataacatcataagaacgtttatcaaattcgtaaactccgtgagtattacgatatactacaccttcagctttctcaagtaaagctttttcatagaaagcatcaaactgttcttggttttcaatatactctgtatgaaccacacaaataagctcatcaagaccataatcctccactactgccttaagagcagtaagaacatcaacacgtttttcaaacggtagatctggaactggaatatcgtatacgtaatagttcagcaaaggtgtatttgcattatgcttcttccaggcactgttaatttgttgtagactaaggacacctaacccagcaaacacttcaccatcaagaggatgaccaacaacttcactaataaagtttggaatacctttccaatgaggtggcaggttgtacacttccccagcttttgataaacactcccctttcatgttaatcatagaacgtaacccgttcagtttgtattgtgcataaccagggaacacaaccctttcaggataatctttataatcctggcatttcattggtgtagaaggaacatggttttcagcttcttcttttgttttataatagccattctttaactgttttgtccatttggcaaaagcttcaagttcagcttgttcttccggtgttgtttcattggaacgaccaatgtttttcgcttctgctgtataagatttttctgtgatttttccacctacccttccatgagctacagtaacaactgcaccatctgtatacactgtccactgtttaagttttccttttgaatctttaccatacagcgtttgatttgtttgttgcattagtcctcccatttaaaaactgaaattttcaatctgttacacacttcatccaaatctgcgtcgagtaacgttgtagatgttgccaacatataatcaatgcttgtgaaaccttgccctttggcatagtcaagcatatcttcatacatatcttcaagatcaccgtcatcaaaagtagctagaaaatcctcgtccccgctacgaacataaaatgcagtactcattcatcttcatcccaagattcaaaagcacaacaatcatcggtttctataataccgacacgtccacaggtattgcaagtgattttatccccgtagaataaataatttttatcaccctctgtgtttacagttatgtcattactaccacaagggcaagtcagccaaccaacaacaacgatatcttttttcataatccctccttaagcattcagttcgttgttgagttcgtaaatctcttcttgaagagaatcgatctcttcctccaaacgggagatctcttcttttagatataccatttcagattctttctctcctaactcattttcaaattttactttattcgcctcattttcataatggagttcagcgtaatcatcgcgcatttgttcaataagatgaatcagagacaagatgtaattatctcccgtttcatcacgccactcttcaccgtggcggagaacggtaattcgtccagtatcttcatctaaaattgtctcatatttacgatcatctgtataaatctgcattatttctccttattgaagtttaagtgaaccacgaagacgcttctcttgctgatcacgaatatattgtggaacctcgtgaattgaatcattaccgtgcctattttcaacaactaaagagataacttgataaccaaactcttcagcaagagctagataaggtttaagttctttctctgtggttgaagtgttagaaacaataatcttgttaagattagatgccatagcatcacgaacaatactctgacaccatgcgtgtgctttacctacattttctggcttccaatcgtaaacaccactttctgtgtaatgatattgatctgcctcacagataggccaataaccttcagaaataatttctgctactgtagatttaccagcacctgaaacgccacgtaaaatgataagttgtttcatttatcctccaaagaagttttcgattttttcacgtcgctcttgctgatttaaagcagcccattgagtcttcgtaaaattatttcgaatccattctaacaaagcgtaatattcttcgtcaacaatttgtttggcattttttggattatcccaaatcagatcccactttttatctccaccgcgcataagaaacttcttagtaagatagtatggtgacttaatctttaagagtaagttaaacggatagtttgtttcacgaactacaaacccttcgtgtttacaatctttagacatttcaacaacatctgaaaacttaaccatcggatgaacttcaggacgcttaaatttggtgacagaagcaattccatcaagagcaccttcaggtaacataaaacttgtcccatcagggttttgaattctggcaccaattaagtatgcacctggttcttcttcgacaatatgcggatcagaaggatcacagatttcaaaaaggaaagttgcttttgcactttctgtccatttgatgaagtgttctatgtcatcacactctgaaacaatatgattctttgcaatacttgcaaaatctgattcaaggcttcctgttgtcgatacgataagttgacctttatatacacctacagaggccataaaaccatttactttacgaacaacatctacaaattcatccgctggtagatctgtgccattctcaaaacgattaaaaatcttagtgaaaggccaaataacaacattgtcatcagcgtcaacaacgattccgcgacattctagaagacgagaatcaatgttccataggttatcccagaaaactttgttcttatacttaagaacagatagaccagaatactctccttctttatatgttttcttatgaactaaacctttttcaactaaatcgtcgcaattaaatttagccacattactctcctttgattattttgtgatggtctacagttacgatatctcgtttactcatcatagaaattatctcatcaaaatgtaagatttttccgtgtgcatcccaacccacatctaacattttaccataagcttcatcagggaaagatccgtgggaatgcccgtgtagcatgattgatccacgaccttgcttattccaggaggccatagggtaatggcttaagacgaagaacagcttctgatatttcacttcgtcataatacaccacttctccatactctgcaagcacttctcggtgtttgctgtaatcatggttcccaacacaataagtgatatccccttggaggcgggaagcaatcttacgggtatcttcttcagttccgaaacagaagtcacccaaatgccacatcttgacacctggactcgtagcgcatttattccatgcttcgatcagtgcttctgtcatgtggtccatatcttcccacggtcgatattcaggagcaaactctcgtatacgtttgtgcataaaatgcaaatcacttgtaataaacattagtataatccctcgctaaatagttcatggtcgtgaccattacgctcatggtcgatctggtcagcattttccgcgatgatataagcatccgcacgactccaccaattgtaatactgatcgataaagccttgattatctggtgtgcacaaagttttgttgattacacctgcttctttcaacacgtttaactgtgcatatagtacaggatttgcatgtcgaacacaaggaataattaactcttcaccattattcaaaatatacttatttgcagcacagacgataacacgttgcgcataatgaccctcaccaatccaggtaagaggttggtaacaaatattgttttcaataccactcattgtttcctaaccctcctctcttaagttatcctcgaaaaaactagtatctggaagtaaaagatcattacttgtgtcgggccaatcctcttcttctcggtagataaagtaaccttcgtcctcttcttgttccgaccaaaccgaatgatgcatgttctctccttaatagtgcacacgaatcattttaataccataacgcagcatggattcttttgcaagcatgaatttatccccagcggcgggattagaagtatgcacgaaaatggtaggtgaaccaaagcaaggtttaccaaacgccagaagttcttccaggtacaggaaaacatcatacccatcttggtctgactccatacctaaatcattgtcaaaagaccactcggttactcttcgatacagtttagcaggatcattgagaaaagccatagcttcttgtgacgttttaaaccaaattgcatcttcctgtccatagtcggctgggttacgcatatcatctatccaaactttcatataacctcctctaagctggcatgattaaaaaagaactctccacttcaaaatgccaatcctccacaagacctgattcccaatccttctcttcatggaaagagcaaatccaacggtacatacctggcggtgtattctcaacatcttctggcaacccgtaatccaaagctgtcaaaccgttctctgtaaaactaggatggagattaggagctttcaatacagaaaccctgcctccaacatctacagccacaatccactctgtcatgtatgggctgtcatattgaggctcatcagaacctacctcaacagcctctgtgcgtaagatgataagaggctgctctgtgattggggctttgacaatatacccgtgatcctcaaaaagatcgataacctcgaactcatcgccgttttcgacaccataactcttattcaaagagataaacttcgggttatcatcgtaagctttatttactttaattctcatttttcctccttcactttaacctcaaattctacaggcttaccctcaatgtaaaaacactgatactctgccttatcatcctcatcacgaggccaagttaccaaggagttatagcaatcttctggtgctttgaagatggttttagtctccacagtaacattcccattaagtgttgccaataccacccacccagctacagggatcatagtgcctccactttccacgttttacccttatcaaccaaggtctttgctacagcatactccttcccattaacaaggaaataataaacgataaaagatttcccgattgttactgtcttagtaacctctacacgtttaacaccttgcatgtattttgccttaccggaatagagtaaaatcattttgcattcctcttgttgttgataacatccatagcagtatatggtttattagtgccatgatactccagaatcattggagagccttcttgcactacttcaaagataccataaacagaactttcagcaaataccatttgcttcgtgccttcatcgtttacaacgagagaaaacttcttgcctgtcccgttgaggatctcgtatttcttgccagcagtgaataatccagagtaccactcattatctgttgcttttacacacttcaggaaagtcttgatcatttctttttgctcctctttttagatttctcatacaaacctaacacagccgcttcttttgcacaagtaggaactgaagtcatccctcttctttttgcttctggtagttgcaaagtccatattccccaccaataaatttggtctgccgtgagtggttcagccattggatctgcctcctgctcctcaagacgttgcaacgcttcttcaatcttctcgattggtgtgtcaaagacgaatgcctccgtatcaaatttatctttcttaggaactgatttggctactttgagaacctcgtttttcggtttcttagtaacgttctttggctttgataacttcttcggtgttttcgccacttactacctccatacgatctaaaaagtcattcacaaatctccagtaacgttgacctgttctaagatcttcatagataaccacaggatcaaacactttagatattccggcaggttttggaaattccactactgtatataaaccaccttttgctacacaagaataggttacgcctgtaattggatagttgctcatttctttacgtactccatgattggggtatggtcgccagtaagcgtaacacggctgtaggacacatcttgtgtcttcaatgtatcaatccactctaagaagtgttctttcgcttctgtgtagttctgtgtgcctttaacaacgtgtataccatctagtgttacacggaataccatttgaataacgtctttcatttcttacctcctttgttgtcaaagtagcttaccagaacatcgtgaaccacacacatagcaaaaatcagaacaattgttgccaggattgggttctcactaattagtgctatcatctttaaccacctccaattgcctttcgagtttgactttgtttgagaactgataatgacacaacttacattgcatgtcaacaatctgatcgtgatttaaccctacaattttaacttcctttgcaccatcccactccaaatactcaaagccatccaaatgattactcttgtccaacaggaatgctatctgcttccattcaatctgaatatcatttaaatgatatgctgcacagaagatatcctcatagtaaaagacgatcattgtcattgcttcgtcaagtacaactacctcttgtcttgtaaatctcattctagcctcctaaacgcgtctctgacgcactttttatatataagatgataaatcaccttacctagtaagtaaacttgctctacagcctcttatgaagcttatgttataggctatactattgctacctgtttaagcaaggtttttgcacacagaaaataatttttaataaaactcttgacttttgtgttcgaagtatgctaccctagaaatctattaacgagcgcagcgagttaaggttttaggttggtgatgtagtactctgtactcaagtactgtactccgtactagattaataattattaaatattaataataaataattattagatctaacaaacaggtacagtgtatcagaactggtacgtacctgtctcttatacacatctccgagcccacgagactaaggcgaatctcgtatgccgtcttctgcttgaaaaaaaaaaaaaacacaactaccaaaggttagagcacggggaaaggctagaggaggatagaagggacgtatggatacaaggtttaaatccctgataaatatgagttcaggttaatatggtattatcaacgaagacaataaagccaaaatccgaatcattgatatggtttttttttaatgatacggcgaccaccgaaatctacactctctccgtcgtcggcagcgtcagatgtgtataagagacagaaataatacttgatctatagattagtatgaagtacagtacgaaacatcttaacaagaatggaggtgtgcaatgattagtgagaatccgtgcaaatggcatcatgtgcctattaaagattgtatgtcttgtaatccacgttctatttataacattgcatcttatgatgatgacaatgtgttagacgatgatgaaggctgggaggatttagattggactggttatgaaaccaaaaaggataaaattattcctagttgacttaagatatccttcgtgctaaactagaagtgaggagatgccgatcactccccatttggggttcgaaggatatatgcaaaatagcttttattttaggtgccgtgcttgtaataggcatttgacaaaccactccagacgtgataaaaatggagtcatcaaggaatcagacctctgttctatttgcacaggtttggcttttgatgatagtcccgaaagggtttatcagcatcaatgtataacagacgttctcgtgtcaaacttggtagaggacgaacaactaacagattaggaggaacaatgtctctattagaaaaacacgtgtttgaagatggtaacggcaatgcagtttttcttttccatccagaaaaatacacatctgaaaacaatggtacaacttctattgtaatcactaaagatgttaaagttattgatttcttggctctgatgcgagagatggatcttgaaattaatacttttaacgcagaagctttggttgttgctcttctggaaaagaaagatagtgaagaagtagcagaatatgcttaaataactattgacaaacgtatccttcatatgttaggatacgttcatcaagtgtggtaacagggtcgttgacttttgttaagaggggcttgcactgcggtagtgttagagactacttcttcagaggttagctaccaaagaggaaaaggaatagtctcggctcaagaacttttacgctgaaagttgggcttggtcttagagaatgtagcggttctctacaatcgtcagcgtctctgttaccacatttatggccctgtagctcaatgggagagctgtcggctcataaccgataggtagctggatcgaaaccagccagggccaccaacgtctttatggtgtaatggatagcacaggagtcttctaaactcttagtcaaggttcgattccttgtaaagacaccagaacattttaacatgaattagctcaagtgatttgaacccactactgatcatggtggcagagaatgaggcaagtatgtcagacattataaacaaaggccacggttatattagaagacataaatgctcgaagagcaccgttcgtggagaacggggttggtggagtcaccattcatggtaaaatgttttaaaaaactattgacaactaacattattttatgttagattataagtatggaagggcaaatcgacgtggcgacgaaaacggtcttgaaaaccgccgagcttgaaagagccttgggagttcgactctccctccttccgccagattaggtagattggtgaaatggtagccacgacagtttgctaaactgtagtcggaaacggcgtgtaggttcgagtcctacatctaccgccaagttctttttaatatagcttactttagcagagtaaatcttcggcaagtggcggtaaccactttaccgataactcatagttagtggtgtgaacactggctattttaaaaagaatttaaatattagtatttaggtgagttaattccgtaggggtagcggggcagactgtaaatctgttatcattgcgattcgggtggttcgactccatcactcaccaccaaattaagatgagttggctgaatggtttaagcggcggactgttaatccgtgttcgaaagaacgatataggttcaaatcctatactcatcgccagaattatggacttgtagagttaaggtaaacccccagtcgccaagaggcttctggaattgcaggtatcgaatcctgccgagtcccagctttgctcctatagtataatggctattacaacggttttgtaatccgtggatctctgttcgattcagagtgggagcaccaacacaacattaagggcactgtgattgatcgtcgtatcctgtgcacaaggtctgttcgaaagacagtgttcttagtattgtgttgatcacacaaaaagagttacctgaaacttgaccggagtagggttggatggggcaaaagaagaagcggctctcccatcgacagcaacgaagaataatatttgactttggttttgtattattttaagttagcttaccgaacgtagggctagtcacccaacgggatactcgtcactgtcccactcaataaaactattgacaaccaatagtaaaatgtagtatagtaaagatgtagggcgttcttggtgtagcggtagcattccgtccttccaagtcggcggcacgagttcgatcctcgtagaacgctccaaattatttaataaagggttgccagaaaactttctcttttactcatggttttctccttctctcacacctcttctggttgcccttcattaaatgatttattggtttgtagtgtagtccggtagcacacgacactttgactgtcgtaggtttggttcaaatccagacagaccagccatataacaaaggtgagtcactacctcaagtgtgaagttaaaaacgaggagccgccgaacactttcttttgcggtgtacctttagaatgttatgacggaatttagctcagtttggtagagtgtacgctttgggagcgtattgtcgcaggttcgaatcctgcaattccgaccaattaaatgtttcgtagttcaatggtagaacccacgactgataatcgtgagatacaagttcgattcttgtcgaaacaaccagtttcccgttagacttacaggataagagttccacaatttattgtgacgctggttcgaatccagcacgggatacataatagcgggatagaggagtctggtcgtcctcgccagtttcatatgctggagatcattggttcaaatccaattcccgcctccaaatatcgcttgccagcggtatctttgaagaccttgcctggttccttctaagatggaggggtgcgactccttaacgcacaattataataaagcatttcaacttaacagtatttattagcctccttattggaggctttttgctatctattgaataaaacttgacttattattttttatatgttaagataaagtttaggaggattttattatgcctaaactaaaacgtggtcgtggaagaccaacagccgaaatgcaacagatttacgcaatggatgcggcgcaagcaagtgtaaaagaattatttgcagagcattatttagaagctatgcggtatattgttgaacttgttaatgataaggatgcagcaaaacctctccgcttccaagcagctaaagctattaaagagcaagtagaagaatggttagaagaacattatgaagctatggaagaagaaacccctgccgtgcagaatacagatgacgttcctaaaaagatcgtaatctaatccctctcctctcttggggctttgcccctcctccttgttatttttaacacccctctccgaaaggttaggggcttttttatttttaatgcttgcaattatatatcattttgtgataagatcagatatgaggaggataaaatatgcgcaattttgtagttaaaaatgattttaaccgttcttcttatcataaagataaaaagaatgattacacacgggcttggaacttggaggaagaactttatgatgacagagaagacttgggaagagatcctagcggaggctcaaccaatggaagtgaagaagatagttaacaacgccccttctcttcctaaaataaaattttatgaggaagtagaagataatgaatctaaagactaaaactgtattaagttttgttttaattgttgttcttattcttgccggaatgtttgcttataacaagatacgtgagtctggctacaaagatggtgttgcctatcaaacgcaagtatatcaagcagcccaagcaaaagcaaaacaagattttgatgttcttcaaaaaagagcagatgaagaaagagcattattaaatactcaaataaacaacttgtctaaaaacaatgcacaattaaaagcagatttagagaagaagaaacaaacgatcaatgaggatacaacgaattatgcaaaaactaattctggcagtatgtcttgctttgcccctaatgatgacgggttgttcatcatcaacaaaagtttccccagttcttattgatgagtgtaaggctgtagccatagaaaaggttaaaggtccagattcggacttgatggataaagtatcgacacctgtgccatacactaaaaatcaaattgcaaaaggggttagtagatctgaagttgttaacaaccaaactcaaaacaatgctctttgggagcaagatagacgaaaggttctaggtttacaaacatatattaaaacactgcaagaaaaaggtattattgctgaataaggagggaatgtggcaaagaaaaaggcagcaggtagtttagctggagtagatattgaagtaaaggctcaaccaggtaaacagactcttgcaatggatttaatgccagaagttatgatttatggtggtgccgctggatgtgtttctgctgaaacggaatatcttacaaaagatggttggaggcagattagtgaatattcgggagaggatatttaccaatacaatcctaagaataagcgtttagaattggtaacaccttattttgtagaatatgatttaaatggagataacctatacagaataacaaatggtgtaggattgttccaagaacttagtatggaacaccgttttgtattctataagaaaaagaaatcaaagaaacatttcgagattcttgtaggagatcttattgcattacagcaaataggaaaacccctgcaaggttatgtagaaaatccattcggtaaacgtgttccttttaacatacctggtaaaaagagcacttacttaaaaatacacgaggttatttcaacagatgataagaaatattgttttgagactccaagcagctatattgtctttagacgtggcgatcactgcttcgttactgggaatagcggcaagtctcgtctgctattgctgaaagctttaaaatacgcctacaaagaccctttgtttggtggaatacttttccgtaagaacaccactgctcaccgtaaaccaggtggtctgtttacagaagcaaaacgtttgtatcttcctttacaaccacacgtaaaagaaagtacaatggatatcatttttgaagccactggtggtggaaccctcaaatttgaccatttggaaaatgataacgtaacagcagaaacaaaccatcagggtacacagtattcaatggtaggttttgacgagttaacccacttcacacaatatgaaatgctctatcttctgggacgtatgcgttcagagtcagaaacaagtttcatgttgtgcacatgtaaccctgacgcagatagttgggttttgaattgggtgttaccttatcttgatgagggtggttatcctagagaagatatgtgtggtaaacaaaaatatttcatcattgttaacgatgaacctgtttttgctgacacacctgaagaactgaaagaaaaatatccagaaaactgtttcatggaaaaccctaatacaggggagacagttgttattgaaccacaaactttcgtatttattggtgggacaatatttgataacccagaactcattaggcttaaccctaattacttagcacagcttaaatcacaaacagcgattaaaagagcacagcttctggacggttgttggtttgcacgtattcagaaagaatctttctttcaacgtgaatggttacataaaatatcttataaagatgttcctaacaatcttaaactaatgcgagcatgggataaagctgtttcagttcctacagaaacttaccgttatccagactatacaacatctgtcaaaatgggtaaagaccaagatggtaatatctacatctttggcgactatgattatgatgctgtggatgagaaaagtaaaattttcggaaggtttcgaagactacctggggaaagggataacctgattctaaatcaatgtaagattgatggaccagaagttacagtagttcttcctaaagacccatctggtgctgggacaatagaatatacagagtctgcaaagaaacttattctagagggttttgttgttaaaccagatgctatgccaggcaacaagaaaaagcttcagcgttttatgccttttagtagtgcgtgtcaaaacggttttgtttatattgttgaagattctttccctaatgtggaaactttaacccacttttataaagaattggaatctttcaatggtgaaagatctacagccactattaaagatgacattcccgatgctgctgcctcttgttttaatactctgtcaaaagagaatactttcaaggcagtagctatccctacaacaacaaatgctcctacaggatacagtagaatgaacagcggatttcaccaaccgtatagtgtccgtaaaagataattgttgacaaaagtcactttaaagtgtattataactagataggtgaggttgtatataatacagccttgccttaacgattttatacctgactggaggaacaagtgtcaacaggaaaaagaacgtacactaaaaagtcagaatactgggacaaaggtgctgcaaataaagctgctctctctccaacaaaagaagcagagaaagagaaaacgttactcctgtcacctgaaataggaacgatcggattaaactcaatcaaagcatttacgaatttcatgcaaccctatgagactcgtttcccagaatgtattcgcacttttaaagagatgggtgaagaccctgatgtagctactgctcttgacgctacatatatctttgtagatagagcattctttgatttcaagataaaatacaatgtaaactcggcaaagtcaagaaaagctgctaagtttattgattacatgttacgcaatatgcaagcccctctacgtcaatatgttagatcacttttgacatataagcaatacgggtttgcattcgcagagaaagtttatgagttggatgaagatcctaaaagtccttactttgggtattggcgattgaccaaattggcttttagaccacaagacactcttcacatggctcaaccttttacatattcggcagacggacgttctattctatctgttaaccagaatatcaccaatacgatgttagctccaggtaatacaactttagaaacgggtattaaagaaattcctttcagtaaagttttatttgttggtagcaacattacagagaataacccattaggagttagtccgctgttagctgtatatcgtagctggcgtgaaaaatctcttattcaggaatttgaggttattggggtatctaaagatttaggcggtatgccagttcttaaggttccaagtgacattctaaacagggcatctttagatcctgcgggggatgaagcacaatctcttcgagttctccaagccaacatcgctaacctgcactctggtgagcaagcctacatggtgttgccttcagacgtttatgaaggcacagtgatgcgtcaatacgatcttgtattccaaggtgttgatggcacgggtaaacagtttgacactcaagcactaatcaaacaacgtaaactggatatttataaccgctttggtgcgggtgtgttgattatgggtgatggtgatgcaggaagttttgcgctttctgacaacaaacaaacactattgtctcattttattgagcgagatgtagatattgttgtagaagctataaactctcaactgatccctcaaacactacgactaaacaatatcttcctttctgatgaagatatgcctaagtttgtcagtggtgaaatgggtgatcctgatattgaagtaaatgctaaagctattcagcagttggtagcctctggtgcgatacctttaaccccagaagttattaacgagtttcttgaaaaaattggttttgaatatcgcatccctgatgatattgttgccaataaagagaaattctttgaattcatggataactatatgcctgacaaaacttcacgatcaggagatggtttagctacagcgggaactggaacgtctgatactgtttctgctctagatccttcagcacaaaacctgtcgaattaaaaatatttaatattttttaatttttctattgacaaaacaacaaatatcctgtagactaagatttatgggatatctgtttttaagaggtttcaaatggaactcaataaagatacactgtgggaactcttcaaaaccttcgctggttttaaagagaattctgaatcccaacaagattctataccatctcaaaaacctgaaactctagtcaaacaaaataaatttgatgaagaaaagatgcaggttattgaggtcttgtattgtccacctgaagaagacgatctccacggagagcgcatgtctgatttggaaatcaggaagatggttgacaacttcaatgagaatattaccaacattagtggtaatcttggtcacatgaagaacaccgataagttttctccaattaaagcttgggtaaatgaagtcgattgttacattggtgacgaactcgttgtggaaggaactcccctcgttaaaatccaattcaacgaccctgaattatatcaagctcgtaaagacggcgttcttaaaggtttgagtataggcgcaatgggcgttaaagtcaagaaggactaatcgtggcaaatacatatttaactaacgtagacttttctggaaaagctacggaagagtcactaggtgctcatattgcttacacttttgattttcaaggtggagcggcatctggttataataccccccttttatttaagtcagacggatctccagacataacttttgaaaagttagaagctctcactaaaatgggagaagatgttacagagttacgtaaaagctatattcaacaagtgatggatcgcatttctgaaaaagtgcgtgaaaaatttgaagctggttgggattgggtttacgttattgatgctgacttcgatgcgaacgttgcaattttctgttcagataacggtatgttctctgttggctttaaagttgacggactgaatgttgaagttgaagaggttgctaaacctgttgttcgtgttactgattatcaagttgttgatggtgatgtaatgatctccattgatttctttgaggacgttttagacgatgctttgagtaatctcgttaagagttccttgaaacaaagtcaagttaaagattatttagtgaaagctcacgctaaagctaatacaaactctgtggatgcagaggctaaccccgcaggtgataaatctgcaaacacaactggaatcaataaaggagaaacccctttggaaaatatcaacaaagaagaattcctgaaatctgctgaattccaagaactgatgaaagcacagatcgctgaagctgtagaaaaagcagccgcagatgcacgtgcagccgcagaacttgaagcacaggaaaaaatcgctaaggcagaacaggaagcagaagaacttcgtaaagctgaacaagctcgtatcgaagaagaatatacaactgttgttaaatcctattctttcgtagaagaagacaaagttgaagctctcgttaaatatctggtagacaataaagatatcgctgaaactatcgtcaaagcattcgaaaaagcacgtgcagaagtggacgcagttaagaaagaatttggaacagaacgtggtgttgacgtgatcaatactcaacctgtagctaaatcttcttctgaactgattagtcagaaagctgctgaacttaaaaaagcccagaaacaataatcttaggagattaaattaaatggctaaaggaattactttatctaactctcgccaggaattcggacacctggttctgggtggagtgtttagctctgaccttggacactgtgtacgtgaagttaacctggttaaaacagcaaccatgaaaattggttctatcctgaaagctgacaacactgaagctgctaaagctgaagctgccgatgctgctaaagttctgatttggactgatgctctgttcggtattgacgatgtagcagtaggtgacactttcaccgcagttgttggcgtacgtgatcttactctgaaccgctttgcagtatactacaaagatggctccctggtagatgacgctggcgtagcagcactggaaacacatgatctgaaactgaccgaaaaagtcgttttcacttcttaattttaataggagattaatataatgccagcagtaattttagatcaggttgtagatttcagccctatgatcgaacttcaggattcccctgatacactgattgccagcctgaatctgttcagtgttgactatcattcaactaccgctattgaaatcggtaaagaaaaagctgaagatgctctgatctccgctcgtgagcgtggtggtgagcgtaacttcctgaccatgaaaaatccagaactgaaagcgttccgcattccgttcttccctctggataaaaacatcaaagctcaagatattcaatctttccgtagctttgcaatggcaggaatcaatgactctctgcgcacagacgctgaagttgttaaccgctatatgtcccagattctgcgtgacgtagcaaaaaccaaagaaaaaatctttgcagaagcagttatgggtcgtgcctataacggcgtaggtggtgcagctaactctgcatacaactggtataccgaatggggtgctacccagaaatctgttgctgtagactttgcttctaccactgtttctccagcagccactatcgaacaagaagctcgtgcttacatcatcgatactaaacaagatggctctaccgctacccgtatcgtagctctgtgttctcgtgagtttttcgcatctctggttaactctccatttgttcgccaggcatatcagtatttccagggaactcctaaccttctgcgtgaccgccttagcggtaacatggatgttcaggtgttcgaatggaacggtgtaacttacattgaagatatccacggtaacatccctgctggtgaagcatatgttctgcctatgggtatcgaaggtatgttccaggcgcactacgctcctgcggatactccagaactggctaacacccaggctcgtgaactgtataccttcatgatcagccagcaccgcactattcagcttcagtctgaattctcgctgctcgcagttaacacccgtccagaactggtagttaaactgactacggcttaatagaactctgttaatattagaggctcgtccgtgatgggcgagccttttctgtttacaataagagtttacaatgaggagattgatatgtcaaacccagaattgaaacgttactttagttatcacgaaatgattcgtgatttcgaatcgctttcaccactgatcgatgctgataaaacattagtatctgcgccaccaatgtctttctatctgaaagatggtcgtattgcattaggtggaaacttcattcacttcctcacgcgtttgagagaagaaacaggtattcttgtgcatccttttgcaagtgaagaacacatgggttactatcttgtaagttacgaagactattcgcctgtaaaaatcaaagaagaagttttaaaagtagaagcggtagacactccagctaaaaaacgttcccttcgtaaaaaataaggtgggcttatgctgaatgcggtagagttggcaccactgatccgaattcttgtttataacccttctcaagaagtattgccagatgcgatgctgattcagatcatccaaacttggattgatattatagggaatgaagataaggataagtgtgcagtattgtggaacagcttgatttctgttttagagtatttatggaacaacgatgttcttaacaacagtactcaaacaggaggagctatgtcccgcagagaaaagatgggtgaagtcgaagttgaagttaaatttaacaacggtcaagtcacttataaatctccgtgggaagatatctatcataactatttaaatggtcttatggtgatccctgggtgcacggcaggacgaggagcaaccagcaaagttcttattggcggtgtggatgctcgtgagattgatcgagtaaacagcgatcctaactctgtaaatggtcttggtaatgttgcaagtgttgatcgtaatacacgcaacgttaattatttgcgaaattacggacctgtttctttttatcgtagggacaaataatggaaagtgagatcttaccaggtgacgatacagattgggaaaccattatcaaaaagatgatggaccttgaacaagttcaaatcgaggctggttttttaacaaacaaaaggcatcctgaatcagatctcactattcctgcaatagcagctattcaacaatatggtaatgaaacaaataacatacctgctcgcccttttataacagatggtgctgttatctcacagaacaatatcgctaaaaagatgaagcaggtgtttgcaaattacttactgaataatgtcgggttagctgtttttgagcctatagcgagagcctctaaagaaggaatagctcaagcgattgcaatgcaacgttatcgtcctttatctcctgtgacaattaagatacgacaagataaaggcaactattctaatcatatcttaatagatacggcacacatgataaatgcaatcgaaacaaaaatcacaaaaagcaagtctaaaaaataacttgcataaactttgtttttgatgtatactaaaaaggagatacaagtgttactagatcaatttactctccttgatctaactgaataccaaggtcgtagacgagtctacaaagaggcagttggttcagttattgctaacttagaaagtagtgtagaatatgaaccatttaccattgaagcggcaagcttacaaccgatatctggtaaaacactgaatgcactacctgaaggttacagatctaaggctcaatatagtttctggactaaaacagaaatgaaggggttacaacaaggaacagaacagttatcagatcaaatactgatagatggtaaatggtattctgtttattcccttaaagattggaccagaacatctttcttagtccatcatcactgtgttgcaatattagacgatcaaaacaactcctggtcttatggaacagaaggaggaaactttggctaatatttaccaacaaatagaagcatacgaaaatgccatctacttaaatataggtggcttccttcaagaattagtggggttgccagtctatgttatggataagccattcattaaaccggatactccttacctagcactacgtattatcacttccagcgattctggaggttggtcttaccgaagctctattcaaaatgatatgtattcctacgagatggataatacctacgagattgaacttgtagcctatcgtggaagacctaccactttgatgagctatgttctggctgctctccgtggtgcagaggaattaaaatacaaacatctctattctaaaggtcttggttttttaggagcctctaatatagctcaagccaatacaattgtagacggagataagactgaattaagagcgcgtatggttatgacgttcaacactcgtatgagtattgaagatattgctactacaccaatagaagcaatcaacatgcacatccgttcattcagagatagttacaatgatcctatccctttagatttaattttaaacagggtttatgcaattactttggttccaggcgaatactcgtcagtcaatcaaaatggatcattatttaacaaccctaccgaataaactcattggaattaagtttctaacaggagcataaatggcaacttttcgtgaaaaggtagcaaccgtaactttactgtatggtgctacatcaattcgtgaaacccagttcgatattcccctgatccttacaggtcagaacgtaactggcgaagcgattcaatattactcttcttccgatgcacttttggaagcaggttatggattaaatgatccagcgtatattatggcagtcaaactgtttaacggtttgttcccaccagatcaagttatggttggtaagcgtgaagttacaaactttactctaactccaatcgtagaagatagtgcaacttacacaattaccatcaaaaatggtaccaagaaaaaagaatttaaattcattgctgatgatactgcaactgcacaagagattgtagttggtctgactgaaatgatcaatgcagatcttgtttatggcccactgtttacagtagctaacaacggcgctgcaatgactttcactccagtagaaggtaagtttggttctattgacagcacaggtttcactcaagaaactgtctatgctaatgctattacggaagatattgctgctctgcatgatattgatagtagctggttctggaccctttcagattcccatgaaacagaagatgttctagctttggctgcatgggtagaagagaatgataaagtttacttcttctctagttctgaacctggaattaaaacgaaagcagaagataacgttctggaacgactgaatgacctcggttataataacacttgctttgctttgtggatgaccgatgcagattctgtattcccagaagcagcagttgttggtgcaatctgttctcgtcaacctggtttaactactcttcacggtaaaacactggtaggtgtagagatcgagaaactggatcagacttcggaaaacaatattgttcaacagaacggtaacatctatcgtaaagagcatggaactctgttctatcgtgacggattgatggttagcggtttctttgttgactatgttgttcatgctttgtggtttaaagctcgcacagaagaatcactgtttacactgtttaaacaacagtctatgctgggtggtggtgttcgtgctacttcaaacggtctggctttgattcgacaagctgttctggctaacccgatccaagtaggtatcctcaacggttccatcgctaatgaagttgttacttctgaagagactggtttgcgtgtcgatctgaaacctattgtttatattccttctcgtgccgatatgactgatgcgcaaatcaatgctcgtctggttgatgggatgaagattgaatatgtttacgctggcttcttccattacgttaaagttcaggtcaacgtcctgactaaccgtactgcaaactaatacggcgggggttaagcccccgttatcaaaataaagaggatctataatggataaaatgcttactggcgtaatggcctacgacccatctcaagttatcctttcattaggtggttgggaaccgtggggttttgcggctgatactaaaatcgttattgctaaatctaacgatattatcaacccttattcagggactgatggcgacgtttcactggctttgagtcgtaaccgtttgggaacactcacaatgtctttgcaacgcacatctccagctaacgaagtacttgcaacatatgcacaaacaatgtattctactcgtcaagtagcattcagtgtttacttggaagacccacgtggctattacattagcacgattggatggattcaaagtcagcctgaagatactattggcgaaatgattacagagaaccaatgggttattggtcttaaagatgcaagccttctgcgtaatgaagttggtgtaggtttgagcacccttaactcaatctctgctctgacaattcaataataaataaagggcagaaatgccctttttatcattagagaggaaaatatgtcacaagaacaagataacacaattcaaaaatatgctcgaccagaagaagtagttgagattccgttagatggaaacagatctgttactttccgtattatgaagtggagtccatctaaagtgtttgacaggattccagaattgggtagtgttctggttgttcctatgactatgtatagcacagcaacaatgtccgcagacgaagaccttgagtcacgtattgctatggcactgatccaactttttgcaggtttggaagaaaagaatttaactgtctttttgcgtaaaattttagatgaggtttatactcaagacggttataacgttgcagaaaattttgatgaattatttatggctcacccagaactagtgttagatcttacggctaaagttctggaggtaaactacggcccttttttcaaacgaggtttcggaaaactgttcacacagcttcaggcgatgacgagtttagcagcaaattaacacctgcgattgaacatgctatcgacacagcaacgaaaacccttactttgaagtggtatgaggttattctttgcaaagtcgttaaagatacctcggaaacactgaaaacattggataactacggtgtagattatcttttaaaactatatgagtatttaacatacgaagagtatgttgaagccatgtatgttaaagacacttcaataaagagaaaacatcaaaaccagacaaataaaatgtcagatttgtttaagaaacttgtttaatccaacacgaggaacatactttgttagaaattaacgcctccaaaattagtaacgtggttacgtttaaggtggacaagaacagtctcaaggaagcaaaagatgccgtgttgagtgttcagaagtttgcaaataaaatgcaacccactatgaacatgaccaagtttagacaacaaatgaaagagattgagcgtgaacttaagaaagctcaaactcaaagtcaaaaacctatgcgagcacctactcccgctggagcgggtgctcctgtaggcggatctggtagacctagaactcctaaaaccccgcaaggaagagaagaagaaaaagctcgtaaagctgctgaacgcgaagctaaagcagcagcacgtagggaagatttaggtaatcttcgtttgcagaactttaactacagagcaagagcatttagtaaagccagtcctggcgctatgcaagaagctagagacgttatgggtaaagctgtagagcaatacaaaaagggtgaaataactcttcaacgtatgaaccaagctcttgctcaccagttagatgccttacgcagatctcatcgtgaaaagaatgctgaaatagaagacgaggttcgcggtcgtcgccgtattcgtagagagctagaagcagaagctaaaatgcgtatacgtatgcgaaatcgtgaacttagagatatagaacgcaaccgtaagcgtgaattagctcaacaaaaacgtgatcgtgatcgtcgatatggacaattaaaagaaggtgcagcaggtcttaatccacgcatgattgcatcctctttaataggtgctgggctgtttgcaggtggttctgtagttggtaacacgttgatgaatactaacgaaagaattaaacttgtaagtcgtggtgctgaaaacgttcagacaaacgccaacgctattttggcaatgacagcttggggtgaacagaacggtgtagactctgcaaatattattaagtcaatagataatattaaagacgttcgtgaacgtcttggtaatacagttttagcctcaaaatggaatgagaaagaagggaagtggaaaggcggtgataatggcataaatgacattatgaacttgtttggatggaatccagaacagcttaaacctttacagaacgatcctttagcttttattcaggctactgttaatgaaggtgagcgtcgaggtatgaactctgctcaaatcgggcgacttcttgaaaaccttggtgatgaccttatgcactaccaacgtatgtttagtaaaaacggcgaagggtataatgaagtattgaaaatgcttcaaagaacaggtgcaacattaactcaagaacaaatagatgcttctaaagagtttactcgttttgctgcaacagttcagcttgtaggtcaaggtatgcagaaccacttcttagagggttttgtgaaagccttacctaaagatgattcttggttggataatgttaaagtgctagatcagtttgccaaagatttaggtgaagaactcggtaagacaacagttcaattaggaggttttgctaaagaattgggagatggtttcggatcttttaccaattggcttaaagaaacattcccagatacattcggagataacacagatcctaataaatctatggcacaaaaagcatacgaggcaacgcaaagtggagacagcaatcctgtagcagattggttgtacaatttaacaggtattgatacacaagatattggtcgtatgtggagaggagaacaaacaaggacacgtgcttttggatttggtaatcctcttgaagatttacgtgaatcagcctatacacctaacgtaagtttagctcgtaatcaacctgttgttgagaatacggtagcaataccaagtgatcttatcaaagttacgatcagcccttcttcagagtttggaaatattcttgatgcaagaattcaaaatagcggaaatagcattttccaacgtttgtctctttcaactctaagtggacaatctaacactggtggttaataaaatacctcgcttcggcggggttttttcgtttcccttgacacgaagtttctatatgtgttacaataatcaatatgggaagatcttgcatcttccttttggcattatcattactacgaggttatcatggcagcaatgactccacaacagtcggtgagagccgtctataaggcagaacaggaaatcaactctaccgagaataaaaatacctcggcatctactgtaaagggtgataatggtttctgcattttagcaagtgtttataatagttcaagtgatcaatacattcaaaactttaaagcaattactttcgattcggtccctgaagtaggtgtaactcgtgaggcagatgttacaagttttccagtagaatcaggatcggatgtaagtgaccacgttcaaataaaaaacaacagatttaaactttcaggtataattaccgaaacaccaattcggcttatgcgagatcaattatacagtgcaggtgtaaatggggcaaggatttctcaagcaatagaatatctagatcaaatatttgagtcaagacaaccaatagttcttttgacagaacacaggacttttgaaaatgttattctcaaaggctactcttatgattataaatctgaatttgctatgcaatttgatttagagtttgaacaaatccgtctcgtttctaaggccactactaatgctattgctgtaaaaacagcaccaaataaatcgactggtggtgatgtgaaaggtcaagttgcttcgaatggtcctaagtcagatattacagtaagaactgctgaagctactaataccccaacaaacaacggaggttaatagtgacaacttattctaaaacaacaaggtctacaagtaatacaggctacagtgcagtttatctagaggaccattctacttattttgcatggtatctgaaaactgaagagtatcctgatcaaacatatacagttacattggatggagttgattatgacattcgtttaaggtggaacactagggacgagtcttggcaatgtcagattggattatctggagatgatccaagtataagtttcaaagttacaaatggtttagatcttcttaaaccttataaatatcttgaaagtgtgccagatggtcaattgtatatagtagatacagttaagattaatggtcgtcctgggtatacaactacaggtcgagataaacgttttgtattggtttatattgataacaaacctaatcaggcgtaaggagataatatggcagaaagagagtatacaaaagctcctgcccctaatttaaacagggcatacaaattattaattggttctgccacaaacacaatacagaagagaactaagaactcggcatttaaatctaccgtagatttggataccaagttaggaacaacagaaaaatcctcttctaatttgtatttgttgcaagaccatcaaataaccttcagtattaagaaagataataacaaagatcctaaccaagcagagattgtagtttataacctttcggatgatactgttaactatataaaccgtggtatccgaaataacttggctgttgctttagcggtaggatacgaaggtgaagagttggttatggtcttcaaaggaactatccagtgggttagtgatacttttgactcggtagacaggaaaaccactttacattgtttagatggcggtattaacattgcagaagcaagaacaagccgcagttatccaaaaggaactaaaatcaaacgtgttgtgacagatttggtaaaggatttaggaactacagaaggtaatatacacgtagataatgatcaaaccttatcctcagcaacagctatgtgtggaaacacttcacattacctagaacatatttgtaaaagtattgatcacaatgtgtcaatacaagatggatctgtttatgtcactcctcgttcacaaatgtctagtgcacgtagcgcctacattagccctgaaactggtctgataggaagtccagaaccattccacaacgatataaaacctactaaaaaagttaccaagtcatctaagaaggcaaagaaacctacagatggtgttaaattcaaatgccaaatgaatggtgcaatattaccagaaaaaacaatctggttaaaaagccgagattatgatggtccatttaaagttgtttctgtttctcacaatggtgataaagagggtaaagagtgggttactgaagtggagtgtgtatccgtgtctgaaataatgactaaggagaaataatggatgcattaaattttgtcacagcaatgcgtggcttaatgacagaacaattagcagaagtccatacagccctgccagtccgtgtgactggcgttaattatggtgctaaaactgtcactttagaatctattgttaaaaacacacgatctagtgaagatgaaatagattaccctacttttgaagatgttccttttatggttaatgggggtgggacaggaagaatctcattccctattaaagctggcgatttaggaactgttatattttctgaaagagatccttctaatgcactgcaaactagtggagaaacctcttcatcatccacttttatgcagccttgtggattataccctatttgttttattcccaaaatagctacaggaacagattcaacagaagctgtagattctgaaaaggtagttatttctaataacaaaaacacgtacgcttctttcgaccctacaggtaatatttcaatatggaatagtcaagggatgaaaatagatattactacctccggtattactattacagatggcacagggactttggatctaaaaggtggtaatttaactttcaaaggcggcgtggcagatatcaatggtcttaaaatagatcagaacggtttgatgacagatggtaatggcatcggattccatactcacacgcacacggttcgtaacattcagagcggtagctcaagtgccgagtccttaaaaccaacaggagcctaacatgggaatcccttttgacttaaagcttggaccaaacaacgacctcatcatggatgatggggatttggtcctcactacaaccagaacagaaattgcagcacaaactcttgggataactctgaacacgtatcgtggggagtggtttttaaatactaacttcggtgttccttacttacaagagattattggtgttgccagaaagaaagatattgtagacagaatatttttagcagagattgccaaaaacgtttacatagatacaataaacagttataaatctgcttatgatatggatcaacgttattactcaatgacagttatggtcacagttggagcagatacagtaacatctatattcaatactcaaccttctgaagagtttatttaccctgaagctggtgaagacaatgcagcgatcatttgtgaagcttacagtattgttgagaattcgaatagactttatcgctttatcaactttgttggtttgccacgtgatacctactctacttggtggaatgaatggtctacagagtcagcagtggaaagaatcatggttaacgaaaaaggtgatgcattagctacaaacaataatttcggtataacagctatgacaggagtagaagagtaatggcagatttaactacgatcaaaatttctgatcttacacaaacaacctctgtgtctgatacagatttctttgtaacagatcaggctggaataacaaagaaaacttctttgaaagtgctgttgagtggtgcaggggtaactagaaaccgtttaaatgcacgtggaacagtaactagcaccttggcattagatattagttcggcagaatatttttcagcaactttatcttctgcaacgtgcacaattagttttactaatattccagtagcaacaaatgcagttttaaactttactttagctttgcgtcaaggaagtggtgcaaataaagtcgtatggccttcttctgtaaaatggagttttggtcgttccccagttttgagttatcgtcaaggtgcaacagacacttttgagtttatcagttatgataatggagcaacttggacaggtagcttagttttagcaggagttatttaatgtcaagagttaagcacaatattgacaacacgtttcagttgattgaagggttggttcagtttttggaaagaaatactgggcttaccatagatcctacggttcagcattacattatcaacccacaaaacgtattggcgaacaacagacactttattaactggacagcgcaggaagggcaaccaaacggtgacgctactaccgaaggtcaatctgtgcttatcactggttttgcttatgcatatttggctacaggggataaaaaatatcttgaatctgccgagaagtattggcaagcctacatagatcacttcttcgggggccaacctattcctgatcctccggctaaatatcgtcccaactggatcatcaatggtaaagaaccacgtttagcacattaccctctcacagatgatgggtatcctacgcacggtgggttcaaaggtagcatgatgacttggattaacggaaggactgttattcctaaaggtgcgccacactggggagaatacttagataaagcttggtttgctttcaatggtaatcttggttggaactctgttaacgcaacagtgtatgcaactaacccagacggttcaaccaactggaaagaatatggagatcagtgggacgttgaatggattatagaccgtctaggacgtaaagttgattgggatggtaacattttatctattggtcatagctttgcagaatatggaacagtacaacttaaaaatgcttctgtgaacggggactataaattcaactacgctacatgcaatcctgtagaacacggtggatatctgcttaagcgtaatgagatgtggcataaccgtcctgtaaacgttccggtagagttaggctatcaagataatgcttccgatgctgaaacgtggtggtgtgatgcaaactacttgatgtatcagatcacaggagagagaaaatactggctttgctggcaatcttctttattgttgtgtcaagactactcaaacatcgatatgtttgataaattcttccgtagatctacgacagcaataattccttttacagatggtatctcgtatgattactcatacccatctacagcaatacctaaatattctcgtgacgaattaggatacacagtaattcgccaagatgtttcagcacaaacaactctagaacaacaggcagtttggttcagagtggatcagaattcaaaacttcgtattgagtttcaaggtgtagatgatgcaggggaaggtgttcttttccgtccagagttagaattaagcaaaactaagagtgaaacagatacagttacatatcgttgtggcttacctcttggtgcagctaatatgactaagatggatatacctttatccagttttatgcgcactgaacctcctggaggcggtgtatatattattgctgaacctagaatcattgttgactggggaagcaatactgtgatacaatataaatatgcaactggtattgctgggacaaatagtgatcagatagtttctgctaatatggattcagatggtggttttactgttgggttttggttaacaccaactaaaacagccaatttaaaatctattacatatcgttcatacgcagatgattttaacatcactattacggattccgcaggttggagatggtgggccatgttagaaaaaacaaattctacatgggttactaaagctttaagtcctgctgatttcaaattaagcacttggcaacccaatcataacgacacagagacaaaaccttcgtcaataaacctgactgctgttgatcagatcaacattgcattggattctgaacctgcaaatggcttgacaggggcaatcgatttttattgtgttaacgatatcccatctttgtattcttcagccgctggtgatgattacacaatgtatttcagggttacagtttcatctgaaaatccttatacagcaaaacttggagattgtacaatactggactacaaacttgacagtttgaattatactccaggaatcattccattttccaatattagtgatcctaacacagcattatatgacggttggcgtggtattccttacccaggttatcaatacccatccttatattgttttaaagggagagatattgactgggttcgtatgaacaacagtatagactttttatatgattcacaaatgtggttttataataagtttgcccctgtaatgcctgggccaatggcacaagcttatgtttgggatcgttgggatgctcataaatatggaaacaaaaatgagttcacaatgtatcattggaacgataaagcttgggatggttatgaagcacgagcattcttctgtgcgtgtcatacggtatacgaactaaagcgacaaggagccgaagttcctgaaaaacttttaacagtttgtaaaaactggatcaactacctgaagtggttccaagataacaacgaaggaagaacaccaacaatattttatcccaacggagaagtggctgcgcctgtagatgactttacaagtcacatgtctgcgctctttatggcgggatgtgctataatggggatggctggatatgattcagaaatccctaacattaaaatagtagcagaccgctgttttgaacttattcaggaaaactatattgttcttggtcctaatcacgttatgaatggttgttggagtgctgctcctagaccagacagtgataacggagtcttctttggcttccacgctggagagttgttacgtggttttgggttgtatgctttatacaaaaaacttaatccccaaaatgcattacctgttttggattcgagcaatattcctgcacttactgttttgacaatggcaaacattagtgtggacgttaccgagtaaggggtaaaatgaaacaagctatatttactgtcacgcgagacaagagagtaaatgcgagttcatttaactacacgactgttgacggaacagcagtcgctggtagagattatattgcaaaatcgggaacacttgtgttccctgatgatgctgattctgctactattgtggttgaagtatttgaacgaccaaagaactcaatagatcttaacttctccctccaagtttcagggattagtcaaaataacatgatggttgaaacaaccatcaattgtattataactactatccaagaaaatactactccaataacttggactacaaaagacgttaaaatgttctctcctatgtattggacaatagattctcaagcaacggaaagttgttctattgtatctcatggagactcttttactgcaagatttgtaaacagaacaacagcaggtttggcaggggttatctggagtacagttgacaaatatgaccataaaggtgttgggtatttgcctcacacagatttaagttcagagaaactttggtttaaaatggaaattagtcaaaacatgccaggttttaaagaagaacctttggtgccgactttgactgtaactctcctggataaaagtgttcattatgtcagtttaggattctacgcttcagatatttcagaagatggtaaaacagcaacaataaagttagattttggtaatatcttttctggccctaataatgatattcctttggatatgagtgctgtagataatattttcttctctttgattacagcaaggtatgaagaaatagaagaggttgtacctattggcagtcaagaggcttggtttactttcactcttcttgaacctacctctggttatagtatgatgaaagtcagcaaccttgtccagcctgaacatgatattcgcatgtgcacatcttatgatgatatgtataacctgactccagagagagttatttataatacatatgcactaggttatcgtggaatgattaaccattacaacggaatgtctcactattatgagttctcatggaacggaacatcttgggctttaaatagatctgtcttcctgaatccagctacagaagcttggctaaatagtttccattctatagcgaacgagaagggttacacaataatgaactctttaagttttgagttgatgagcacagtttgtcctgttgaatgggtccagcatgattggaacgatgctcttgcagcaacagggtataagcctcctagttacgtgttgtctccaactattgacgaaggcatggaatatttgcaaaatgttattaacaaaatagcatctatttctcaagctaacaatattccagtcgtcattcaaattggtgaaccttggtggtggtataatacagcaagtaaaatgccttgcatatacgattacactaccaaactggcattcaacacagaaactggcttatttgcacaagatgcaggaacaatagataattataaaacaggaacgccgtttgacgaatattatgcgtttttgtctcgtaaactaggattaagagttacaaagtttgcaacagatactagagcatcttacccaggagctaaagtaacattgcttccgttcttaccatcgattatcggcaacggtttgatggagaaagttaactttccgtctgattactacattcctgaagcttttgatttttactgttcagagtgttacgactggcttctggaaggtaagatgatgaaagcatttgatgcaattaccataccacatgaaaaattaggttttgaatattctgatattcactatctttcaggttttgttccagatgctactcttgcgcctttgtatggcttcgatcctgaatcaaactaccgcacgtatctttggaaaatgattataggtaatatagtgttgaacgccaacaagtttaacggacttacacaatatatatgggcctatcctcaaataatgcacgattccattacggtagttaactctcaatcccaagttttctatatgggtaatgtgcctttgaattgttatttgcaagatatcaatcttaaacaagcaaatgttgagattgctaccataagtggaattacattagctactaaatctggagaagatttagtaacaacacaaaaattttatatataggagtaaaaatgtcaactacaattactaatttacccgaaacatcaaaagttaatgattctgattacctggttttagaccaacctgataagactgttaaaagcacagtttccaactttcttactgacactggggtggttttagccacccagttgaaagatacagatggtgctaccaagtatccagaacttcaaatgtcacgttggagagatgaaggtgatcctagaggatggggagcagtaggtgacggagcaacagacgatactaatgccataacacagcttcttgctgctatgcctgatggatggattgttgatgggcgtaatctcactttcaaggttacaacactaccagatataagcaagtttaaaaacgccgcttttgtttacgagcgtattgttggacaaccccttacttacgtatctgcgggtttcttcgatggaaatctgacaaaaattacggatacaccattttacaatgcttggacgcaagataagacgtttgtttatgacaatgttatatatgcaccatttatggctggcgaacgtcatggtgtacaaaacctccatgtagcgtgggttaaatcaggagatgatggacaaacttggtctatgccagaatggttaactccaattcatcctgattataatgcctcttcagcaaacaaagttaactatcattgtatgagtatgggtgtatgtggtaatcgcttatatgcagtgatcgaaacccgttacttatctaacatgcgattgaagaaagcagaactttggtcacgtccaatgccttattatagaaggccaactggaggcataacaattagttctgggtctactacagcgacaattgttttagaaaagcatggtcttaaagttggagatgctgttaacttttccaattcaggtgcaactggcgtatctggaaatatgactgttgcatctgtaattaacaaggatacatttactgttacattagcgagtgctgccacatctaatatagataatacaggaactacttggcattttggaacacgtttctgggatagcccttgggaaattacagaattaccagatgttgcctattctactaatgcagatttatgtgttacagaaacccatagttttacagttatagatgatgataattacacttttgctgttggttatcacaatggtgatgtttccccaagaagattaggtattttgtatttcaataatgcttactctgacccaagttcttttactcgtagaacaattagtcaagaatatgctgacaatgcagcagaaccctgcattaaatattatgatggaattttatatttaactactaggggtacttcaacttctgctgctggttctacattagcaatgagtaccgaccttggagaaaactggaattacttaagattccctaacaacgttcatcatacaaacttaccatttgcaaaagttggtaactacctttatatctttggtacagaacgttcattcggagaatgggaaggagaagaactagataatagatataaaggcacgtatcctcgaacgtttatgtgcaagattaatgtatcttcatggcctacatctttatccgatgttcaatggtttaatatcactgatcagatgtatcaagggcatattgttaattctgcatgtggtgttggttcggtatgtgttaaagatggttggttatattatatctttggaggcgaagatttcttatctccttggtctattggagataatagtaaaaaattatggtacaagcatgatggtcatccagccgatttatatagttatagactaaagattaccgaacatgattttgtatcacgtgatttcaaatatggagctacgccaaaccgtacgttgcctgtatctatgggtacagatggggtaaggcatgtctcagcccctgtaacttttgataatgatgtacaagtatactctttaacagttactggccttgagcatgatgggacgcaacaatctgccgttagaataaaattagacggtgattatggggttgttgcaaaaaatgtcccaataaaaaatccttctgaacagcgactaatcctatgtggaggagaaactccttacgttacggatggatcgctattacaactatatggttcaaaccatacgtatccaaacagagcagttttatatgccccaggaggagcatatacccaaaataatttcatgccgtatttagatggacaagttgcattaggcggtgcgtctaacagatggtcagaagtgtacgcatctacaggaaccattaatacttcggatggaacattaaaaactaaacctacagagattgaagatattttactgaaagcatgggaagatattcatgtaatctcttaccaatggcttagtgctgtcgcggagaaaggagattctgcgcgtattcattttggtgttatagctcaagatgtaagagatattctgattaattatggtttaatggatgaaaatagcactgattgtaagtatgcttttctgtgttatgatgaataccctgctatgtacgatagtgttgttacgggacaaaaagaaatccctttatttgatgatgaagggaatgttgtaattgatgaagaaggtaatccagtaacaatcgtagaagatgttgtagaaactatcgaaataattccagcaggatcgcgatggggtatccgcgctgaccaaatgttttttattgagatggcttatcaacgtaaaaagttaaaagctcttgaagaaagacttgcaaccctggaaagtaaataatacagcttaggtggtatttcaatctttatatctcacttagaggtactcatggctaaagagaaaaacggttttaaaaaatttattcgcggaatgttctgcacttaccccggcaacggggtaagctctacgaaagtctggaacgctgtaggcatgtctgttatgacaggcatgtttatctttttaggaatagaaaaagaaattcctgaatggatgggttgggcttttgttttcatgataaccccttctcgcctcatgaaaaatcttattgatttacgttggggcagatcacaatctactaaagaggatgactaatggacgaatatggtttgacagatgcgggatttgtaatcccgacttttgacgatgttttaaacaactacatgacagcagtaaaaaacacatttggtgcagatgcagccacttcggaagatactgtgatcgggcaactgtttagaataattgcatacacagattacacattgtgggaaggtatgcaaggtgtttataatactcaaacactggatggtgcagaaggtatttatcttgacgaaatcttttctaaacgcggtttctatcgagcaggggcagcagcaagtacaggttatgcatatgttaagagcaataacaaagcagcttggacttatgagctaggcacggatatttacttcaactctgacagtgatatgaactactatgttagcacaccaactatgttgaatgctaagattgcagcttatcaaatctctcgtgctaatgcaactgctacaggtgttccaaatattactttttatgcacaaagtgcggtggatggaggactaaacagtaaaacacttgcacctggttcttctacatttataacagatcttgaaacttttatcaaggcgaatttaacagaagctgatcgtagtcttgtattttctgattcaggtaacttatcaattggttttacttctttaaccagtgatactccagtggggctggtaactcctattaaattttatgctagtgttccggttggaaccaagtggagtgagattccggtagttgcagcagagaaaggatacaatcctgttggtgtggagtctattacagggatatcttctacctttacaggttatcttgacagtggtaacttctattcattttctcctggtcgggatgttgagacagacgcagaattccgctctcgtttcaatgacaacgttgatgaagctaacgcagggacacgagcagctattgtgaaagctctgctacttacagatggtgttactaaggtgaagatttatgataaccctacattacatgatcaagaacatgctccagctatgactttccagactatagtttatggtggcagtgcagaagaaattgcaaatgttatctataaaaccaaaccaatcaacactttgacacacggaacaactaacataacagttacaacagaagacggaggacaagaaattattcgcttctctcctggtgcttctgctatgtattccgtaaaacttgtttatcaaactgtcaacggaacaactttaagtggaacagaaaaacaaaacatcgtagaagctctacaaaacctgcaagcttactttgagttaggttcttcagtaacgaacgatcaaatcaaaggtgttatttatgcagcacttgcttttggacgcttgacttctcttcgtgtttatgttaaacttaatactgaggatgacagtaaatatacagagaataatatagttcctgcttataatgttgtcccttcttttgaccttgataacatttcttacgagtatggagtgtaaaaatggcagtgagtgttgaccatgtaacaacttgggccagtatcaatgaagatgttaaaaaccttctgattgaagattttaaatcttctcctaacattgtcaagctcctctacatcgtatccagtgaaaagcaaaagatagatcaggcaatgatctatcttgctaaacaccgcttgatctccacagccacaggcaaatacctagatatcttaggagaagaaatggggatcgaacgtaatggctctgatgatgaagagtatagaacaatattaaaaatcagggcttaccgcgtagcctcatcggggactcgtggtgacataattgatatcttcgcccgtttcacaggaacagagcgtgaaacgcttaatacttacgtaggtttgaataaaacctttgatgtgtttttctacaacctgtgtcttcaatctgatcaagctttagagcagttgctaagtgttttccctattattagtagctaccgtcttggagcaaaagcaggatcagcttttggttttagttcttattatgctaccaaaccgcctcatggtattggtggtttaggttccctgtacatggaatctactggggatgaaacaggacgcatgtgtacgcttctcaagcaaatagattaaggagtttaaatggcgaagccaatatattatcctgactgggctacacaaactgtaacgctcccaggaactttaaacacaaacaaaatcagacctaaagaaaccatccgcacagttggtatggattatggtcaaatcatgacttgcgaagaaatgaactggattcttaataatatcggtttatggattcgctatttggtggatgactttcttccaactttacctgatacttacttgcctttagttggaactaagattacaatggcaggtgatgctactggtgaggctacttggaatggtaataaagaagttactttatctatccaagttcaagataacagtcataatcacttgtcggcaaacattacagatgctactagttcaacagtaacaccaaacgtgttggtaaaacgtgatgcgggtggtgctatttatggtggtgatgtttatgttaacggtacttccacaacagatcctgcgacactgtttttcaaaaactttgcaggacaaactaatggtgagatttctgccgaataccaaagtggaggtcagctttatatttatcgtagaaatcctagcacaggtagtgtatcagcaggtgttcgtttatatgatgcaggttatgttctaatagacagtccaagatcaaacagtggacaagatacttctaacggaaatgctttagttcgcttagattatctgaattctcgtttgacttctcttcagaacacattgcagacgaatattaacactgttcaaaacaacctgaatagtgttaacagcaacctctcttcccgtataaacaatgtagaaagtaatcatcaaagtcagattacaaacaactacaactatgctaacggaacctttgtaagagatattcgttacactagccaaggcgtgtattatccaccagggaacgaagtttcttggacttatatctgttcttctggttatgttctttctggtattattgtccaggaaacagggcgtagttctgcggataacatcggtggggtttatttcaaacgcctccagcgcaacgttaacggaaactggtacgatatcggaggctaaatgatatttacaaattttaaaagatatattcccgaagatcccgaactaaaagaattggtagaagtagagaacattctttttcttcgttgcgatcaaggttacgattggtatgatttacgtagcacagaattcaataacgataaaatgaaagtcgtttttgacgatcaaaatcgtattgtgttttggaacactgatcctacattactttgccctgaagatctttctatagcacaagtggactttaatatagacacttttgaggatattagaaacaaggttctggatttagaaactttgactcttaaggataaagagtattcccgcgaagagttgatgacacaagctagtgcaaaaattcgctctttacaagaaacagcggtagcacttataacacctttacagtatgctaaagatttagaaatggctactgaagatgaattagcttatcttaaaaatcttcaagtttatgtggttaaactaaaccgtgttccgcttcaaaaagactatccttacactatagattggcctacattaccaacggaataagggatcattatggaatttcaagaagcatggggacttgcaaaggatgcaataatccctttaatcggagtcatctggttctttttcaaacaaaaaatggataaattcggctctgatcttgatgaaatggaggagaaaagtcgagagctagagaagaagttggtctttgttgaatcaacttatgcaactaaagccgaacttacccagatgctaaatcaaattaactctacattaatggcaaataataacactcttgagcaaaaaattgaaaagattatggacctcaagaatgcgactatccaaatgatgctagatgacatagttaaacgtacacagaataaggggtaattaatggcaacattcccaacgtatccagcaacgtctcttgaacagggcgtagatctggttattttctcgtccaatcaacttcatgatgttattaatggaagtgcgacagaaagtattgagacagaatcagggttgataccaaccctgagaaaagcccttgttgataactttttctttaaaagcccattggattgggcgcaaggcacaaatgaaacggtttttaaccaactacgttattttcagaatggggtattgagcggttattattatgctcctaatgctacattggtaaacccaatccctatgcaaggtactccagtaggagataacaactgggtattgtggggattgaagacagaacaattggcaacagaagtcacaccttgggtatattctggtgcaactggttatgaaacagtaatcagtcctccttacatctttgatagtgctattgttacgatcaatggtgttattcaggttctgggggaagctttccgtatagaagatagtaagatcatcttatctgaacctttgggacacgatcctgcaacaggactgccaaacaagcttttcgcttatattggtaaaatcgtagcttcagcagatacagatcctaatctagagaaccgtcttgttagtttagaaacaaaaacggaagaactaacagaaagcatggataaagtccctctgcaaactattgctcgtaaatatggtttgttagatgatgaggtggcttacgcaacagcaggtcaatcgttaacagggattaaagctctgtatgatccggtagcacagtcttcctacacattacctcctaacatcacaggaactttaacatctttgtctgtttctggagtaatgacttattctggagggtctgtagatctttctgcactagctgttgaacgtggacagtttgtccatttgcctacaagctttggtaataatgtaactctgacagctaaaaatcagacgattggacgtggtgctggtcgttatcgttgggctggaagtttaccaaaaagtattttggcctctgacacattagagacaagcggtggattaggtccaaacgcatgggttctaactaatacggaaggactgttaacccctcgtggtggaacatacaacgatttattcgatgttgtctacttgtcagaatttgctaacaatacaactacctataccacaccagaagcagctttccaggcggcactgttagcagcaaaagcttcgaaaagtaagattctcgatgcttacggttgcgatatgactttcacgacaagctcttttgatattcaaggtatcactttgcgcggtggtgtgttccgtggtcaacgcgactatcgtgtgcagaatgctacagtagaaggcacaactttccgtaactctcgtgttatgtattggggtggtgctgtgcgcatgttcgattgtttgtgggacggtgctcctcgcgcaggtcaagttggtagcttggtattccaaggcaacccaatatcaggtacttttgaaattgataattgtacttttaaaaacgggttatatggcatccttcaacaagggacaggggaaccagtaacacgcggtgtcttccgtaaccttaccttcatggacatgcaaggtgatgcgatagaactgaacgtcatcaataaacattatgatgatggttgtgtgattgagaatatttacctgtctaatatcgatgggactaacgctcctattcctctgtccaactggggtatcggtatcggtgtagctggtaaaggaccatatggttacggaatccctgatgatcaatattgcaagaatattacaattcgtaacgtttttgcaaaacgttgccgtcagattgtccacgtagaagttggtcgtaatatctctatcgaaaacattcatggcgatccagaccagaccgtatctgttgggacaggtttggcaactggcgcagttgtaatgtatggaagtaaagattttacgattgacggtgtttatggagagcctaaaacagacggtagcacacttgcaagtaatatccgtatgatttatttggagtggggaactaacgcagttctggacgaagagggtaatccggtagttccggcacagggtagaccttcaaacccatgctttaactattctgttcgtaacattcacaccaaaactgggcgtgtttttgcgggagtttccgctgggccaggttatgaaaacagagttagctttgaaaatattcgttgcgctgcattgcagttgttcggtatagcttcttggctttcaatgtctaacatcacctgtaatatcttcgattgtgttggtcaacctgaatctggtccagggacattttatgatggattcttccgtagagaaaaatctgttcttgaaatggttaacgtaaactgttacccagatggcaagacgatggttactggtcgtccacagtggagccgttgccgttactcggatattcatcgtgtcaactgtaatgttgaagctaatatgtataccaatatcgcaggtggtattggagctattgtagggacaacgggcaaagtttattacttagagcctaatcctagtcgaaacattgatggaatgcatttcccaacagggaaagagtttgacaaaggtgatatgatagtcaaggcggataatacgttcttccttgtaacaacaagtggggcatatattccagatatcccagctttcggtattcgagctacacaagcaggagataccttcctgacacagaacttgactcctaacgggacagcaacaaatgcttcttggttgtatcattaccctctgtcagcagggacacgtatccgtattcctggtgctggcgtaggtggagcagatttggacacagttattactcgtgcaccttatcaagataatgatacgtggactaacccagttaaaatagacattgcagatcccattgtaacgcctacaagtgctggagttagaattaaaaccatacctaatgattccagtaatgtttctgtaggtaatactgcggttattcgcccaacgccagtagtagatgtgccaacaacctaatggaatagagggggaatccccctcttcttccaatagaatggtctaatgataggagagataaatgaatttaacaagacctaatagtgcgatagccgatctggtagaagctacttatcgaaaacgtcgcagctttgaggcaggttttacattacgtaattcccgtgaagttttgctgttagcagcagaagggaattattaccaatggaaaggaacttttcctaaagtagttccagcaaactctacgccagccaccacaggtggtatttcttcccttgcatggcaaagtgttgggaccgctgatgatatagcaattatcaatgccaagtttacggcaatgcagcaacaaattgatgatctgtcggaaacaatacctgaagctggtaaatcggcttatcagatcgcacttgataatggttttgttggaacagaagcacaatggcttgcctctttgaaaggggatactggtgctcaacttaatattaaaggatcgttagcaagcactagtgaactaccatccacaggtaacgttgcaggggatggttatatcgtaggtgatgtaatctacgcttgggatggttctgtttggaaacttatttcttctcttgggccagaaggtaaatcagcttacgaggtatggttggcagatggtaatacaggatctgtttatgattttcttacctctataaaaggtgataaaggtgatgttggtcctacagggccacagggagcacctggtgttaacgccaacggttttgattatcgtggggatttgccttctacaagtaacttaccacaacctaactctgaaaacgtaagccaagcttattctatcaatggtaatctttatgtctctaacgggacagcttgggtcaacatgggtaatattgttggtcctcaaggtccacaaggtgaggcaggtaaagacggtcttgatggaacagatggagatgaagggaaatctgcatatcaaagttggctggatgctggtaatgaagggacagaagtagattttattgcctcacttaaaggtccaaaaggagacaagggtgatcaaggagagcgaggtccacaaggtgaactaggtccacaaggaccagtgggtgcaacaggatcaggcttagagattatcggggttctgaacagtgaagctgaacttcctcctactggagaagtaggcgatgcatataaaattaataatgatttgtatgtttgggttcaagatgctacggaatggatgaatgttggcagtcttggaggaatatcaattacagctaaaggtcatgttccgaacagtgaagctctccctgtttacaataactatggtgatgcttacttaactgaagacactagtaatctttacatctatacttacgatcaagacaccaattccgcatcttttgttgacatgggaagtattaaaggtgacaaaggtgaaaaaggggctaaaggagataagggtgatcctggaacaaacggaaccaacggtactgatggggccaacggtaaggacggcgcacagtggtttgtagcaacaactaatccagtcgcaggagacggtgttatcaatgattacgccttcaatactaacactggagcagtgtttaagaaaacagattcttctacgtggacacttataggaactcttcctagtataccagaagcccctcaagatggtttgacgtatggtcgttctgatggaaactggatcgaaatatcaggatcagatcctacagaagctataacaccgactagagttacagcaggtttcatggaacttgaaacaactactgccaactctggagcatcttggactccttctggaacttccaatatgtatgttgttacagtaactgacgctctgacagttggagcatggcctggtgtcactggctctacaaaacctaaagcgttttcagcaatgatttatttgattcaagatacaacgggacacacggttacactagatgcgtcttatggagcactaaatgatacagaaatagcaactactgctaacgcagtaacaattttgcaattaacgtatcctggtgtgggtgatatcgtggacatggttgttgtaacacgataacagaagccccgaaaggggctttctttttatggagggtttaaatgtttccaattccaatatttactattatgaccagcactggtgtcgttcctctgccagcaggtattgttaaaaaagtaatcactttagattacccagataatgctggtaattctaacagcagtttagcaattttgcttaatgatggtagattgtttactcaaggcgcaaacctttttggtgagattgcagatggaactcgtagtgcacgattcaataatttccacttagcttctactgtagtagcggatgtgtttaccgcagatcgttgttttgttattaaaactaacagtgggggatggcaatattcaggattgacagcaggattggtaggatctatagcagcaggtggtacggacgcatgtgtaactacttggaccagctttccatctgtaataacagggactatctctttagccaatcttaaagaggttaagggaggatataacaacactctctggttaatgaatagtggtgttctttatggatcaggtcaaaacacagtaggcagtttaggtgcaagtactactaacgaagtttctactcctcgtcagataacaagtgcagcagttgcttttgatgcaggttacaaccaatgctcttatgtcaacaatgtgggaaccttgcgtgtttgtggagctagtaaaggtttagcaggtaataataacacaacaacagcttttgtcaatgctaagatatccgctactgaaacagtgtatgtcaaagattacatcaatacagtttcccagacaatagttgtaggagatacctccggtggcacgggtacagtaaactacttatatgttagatctaatacagaaacaacctacactaaactggatacctttgcagcaggtttctcaacatggaagtttccaccaagccgccactcttttttcgttgggatcaataattccttgtgggctattggtaagaactacactgcaaacttaggtttggggtatgattctgcgagcggagatccactccaagtgggaaaaccagttaaacctgaaggagtgggttcttgggatataaacaagctcacaagcgttcatacgctgaatatggatgttactaaccaattaggttatcaaggaacttttttcgtttataatggggatatgtattattccggtatttggaaagatgggaaagcctcgtatctgttcaatagtggtctaaactataataaattcacaccaatagcaagctccgtgattacgggtgatattctggcaactggcttaactacagattctttaggaatttgtattgtaggtggaactaaacagttgacacattctgttagcccagaaggaggtaaacttttcaatattaaatacacttcttctgcccctgcaaacatgacaatatcatctactggtttaatgactttccatgcagaaggtggttttgatgcaggtatgacagccttaaacgctgaaggaacaaccttatcagatacctctggaggatatgcttcaacattgagcgtttacactcctagcttatctgcgatggatgtaggaacaacacaaacaatggtagcagaaataacgccaacaggggcagcaagcttacctggtatggttgttgagtatacaactacagatcctaatgttgctacagtagatcctacaactggtgtaataactggtgttggtgatggtggttgtagaattggttgcacagctacatatcaaggtgttgttaccgcttctgatagttcttatttaacggtgaatgctgttgcgggaaaggagttagctccatctccgagtagtagcttaacggttctaaacggatatttcaaccactcggcagatggggcaattacgttcccaattttatcgggtactgtcacaccagctaactttgtagttaaggtggatgacgttgtaataccttcaaataaagtaatatttagaaataaagctttctctacagtggatagttatccagcaggagaatatagactggctattgaatttgcaagtgcttcagtagtgaatagtgttgatgtgtctatggaagcaaatccaaatcttttagaattatggggcggcaacagaattggttattctacaagcccagcctcacaattcttaaaaggttgtgctaacttaagacgaataacttctgattgttttagtaacacatcttacaccggaacatctataagtggtatcttctctggctgtacaagtttgacagctatccctgaaggattattcagtgatgctttatttccttcactgacaacaatgtcaagcacgtttgaaggttgtacatctttaacatctattccttcagatttatttaagaatctatcaaaagttacaagatattcttacacctttaaagattgcacctctcttgcagaagttccagcaggaatgtttgataatattccaacgaaagtgacctctttaacagctacattccaaggttgtttagcacttacggattttaataaaatctttaatgacaacccagggttaactgtttgtggtaaacgtggagcattatcttctttctttagtggatgcacaaatcttacaggaacaggaacaacattaacaaatacattaggcggagtagctaatagttacctattcaggtattgcacaaaactttctgattataacaacattccttccaattataaataagaaaaggagccatttggctcctttcttttataaaaactctttataaatcaataagatcagaacggaatatcatcatcgaagtccattggaggttcttcttgattacttggagttggttctggttgtggttcaggtttcttaacttctttcttctcttctttcttaggctgttctgcggaaccacgaatggcagcagcaactttatcagacagagccagaactttacgagcagaatcaatcagatcttctacagatacagtcttaatagtatggtctttacaagcattgaggatagcgtgaccaacagatgccccaagatcataatcattaatatcaacgccacgagattcagcaatttccgatttcagcgtgacagttgcagattgaacaaccccagcgatatcgaaagcatcgcctttaacaccattacgaatcagttccagtgcaccatttactgcgtgaccagtttccagacctacagtatcacgttttttataggattgcttaggagcagcatcgttggaacctttattgccagaagatttgttagacttctgaacaccatcggtagacaatactgtaatacgagattttttagtattgtagtaagttttaccgcctttattatcaacgcgatcaatatcaatacttacttctacacctttttcaatagtgatccaattatcgccttctttgacttgcaggttttcataaccttctttcagttcaatgtcaccaagagaaatccaaacacctttctcatctggtttagcacctttctctttcagaacaagagaagctcggtgagttgaaacaatcgtttttccttcccaatggaaggttttaggttcagcgaatttatccagtttaacgtagtctacgataccagttgcataagttacggttttgcctttacgatcagtttcagtattaattacggacattattatctcctctacattacattaattttgcacagaaagagcggagtctttccatatcatcttgctctaacaggtatttacctttacctattccaactccaatttcaccattaggaaaatgaactatttgcactgggaaacctccgagtttaattgtggcagctttgccttcttcgtctataacgtttcggattgtatcttgcagtgaaatgaattctttgtttgtaacagtggtttcaattatttcagatgtttcgacacgagcagttagcttcttgtttccaccttgaataaccaaaatttgaaaataaaaagagttgtcaagacctacaacatttttctcaactagtgtcaaactggtatagtttccataaacagtttcaacagctatcttagaacgttcaatcattgaatgctatcctatcataaaatgtttaatattgtcaagctttaattaccaaggaatatcatcttcttccaatctggtatctacttgaggtggacgtggaaccttaacctctttcacaaaacgaagatatgggaaacgtgtagcaattttaataacatgtttggcatcttctctaacatctttgtgcaagaagcagatccctgtttccaaggttgtttcaaaatctttagaataataacagtccttcccatcaaatgcagcctggcagatggacagatcgaactcatttagaaaggttgtcattacgcttggttccataatcataaggttgcaaagctgaccatcacgttcaaactcaaaaacgtgtttaagaccagtaacaccttcataattgtcagaagcctctttgttccctagtttacgaatattggttcccattaaagcagatgcaattaatccttgtatttgttcttcagtccgatgtgcaggaagggatgtatagaaatccagatcacgtccagcaatatcaagaatacgccaatcacgaacagcaccgccagccaagacagaattaggatcagcgatctttaatatggtaagaatttctttggcaatattgatttgttttgatttagtcattgatacgctccacagttacttttacaacatcgtccatattaatctcatcccctaagacctcaataacaccttcctcataaagtcgagcacattcttcccacacttcagcttccgtcattccacctgcaatcttatttgcaagacctttaataacatcttcattttgttcatcaacaagaattgaaacattaaagctcactaatttacgcattgttttctccttatacttctaaacggaaagtttctttagatacaaaatcgtatccacctttttcaagccagtcattgtaaacctcatcggcttgagactctatcataaaataccgagtggtaacttcgtctccgacaatacgcacaattttatagcaaatcatgataccatttcccattaatcttcctccagatcaatttcattataacaatgtatgcagaaaccatcattgtgcatatgttgttcataagacatatctttaccacaagaccaacaacggatatccccatcgtcccattcacgttcttcttcaccttcgaattcatctggtaggtaaggcataccaagacaatctaaatcgtaatgcatatctcctcctataaaggggcagaagccccttataaaacaatatgttagatcagtgacaggacgcccaagaattacccacatcatatccggcagtaagctgaacattaagattgtaaaattctccagccttagtaacagctaaggcagcaagttcacctgcccgactataggctgtaaaccatccacctttaggagattcatgaatgttagcccaaatttgccctgtctctttttccttattatgcttccattcttcgactttagcaaggcattctttatcaattttcttttgttcttcaggatcgtctactttcttccaacctaatgattcaggtgaaaaccatttaaattctacaaggttacgagaaacttcaagctgggcttcatcgtgatatgcaatcatttgttgcacgaaatctttattcttccagtcatctttaaagaagtcaacacttagtccttcttcttcgatcatgtcgtcataaataaccattgcacgtttagcacagataaccccaccactttggaacagagagttaagaatcgcgtgagcagaacgagtaggaaccttacgaccgtcaatacccaaaacatattgtttaccagtcttaacccaaaaatcgtttaaacgttctttaagacgcgccaatgggaatgcagcttcccagaaagcatcaaacaccaattgacctgtaaacttatcgctaccaattgttttagcaaccttgtcggcttgtgcaccataggtaataccatacttaacagatttagcaggactacgttcaaatttacgtccgatagtttcagtgatacgttttgccatcattgtgtgaacatcattaggtttctctaataacagagcgttacaatattcgtgtggctccggctcgtaccgccaacagtagtgtgattcaatttttgcttccaaagagtcgaagtcgtagccgatctggaagtatttaggaacctctacaccaaacaagttacgcatctcccatccaaacaaagatgtgacacgaggaatattagctacagatctatgcttcatacgagaggttgcagcatcacatgtagcggctggggtaggaatacgcccatccgcccttactgcggctaagaaacctttatcgtattcttgatcttcttcatcttcttcccaatcagcaccgccacctaaaatagagttcctacgatgcttatacgttaagtattctacaatctgtgtagcataaggaaacttctcacccaaagcttgcaggttaggacaaatttctttttcctgacctttggtaaaacatgggttagtcaatactttaagaccgcgacctttaccttttgctatacgctcttgaatcttcctttccagggtttccggtgtgcactccagatgatcacaacgatcctgacaaaaattagaagatagagtttgctcaacgtaagctcgaatacctttctgaagttcttcctcgctctttttaatcttggtgccagatttaagagtcaagtctttatctttatattcagacggtacccaacctaatcctacaagccagtttttaatatgggttgtatcgttcaatgttgcagggatgttaggatcacacagaggctcatctgctgcaactggcagtttccactctttccccaacataactaaccaccaatcgccatccctctcttccaaatgaccatcatgtttcttagcaaaattgatcatatggttagttggctctaagttctttttaatttgcaacttaggtggaataaaagctttaagataaccttttgttgctggtttaggtggcaaaataggctcaacgagtaaacgaagacgctccatttctgcatccaaaaaagcaaggttctcttctgcttgtttcatgttaaaagcaaacccacggtgttcctggcgtgtaataatgtctgctacacgttgttcaagttcaaatggaccttcccatttatcataatcaccccattcttccataaggtaattatatacgctcgtattggctttgttgtcatagatacagtaataaagcatatccgcagcaaaagtcttaaatcgatcttcttctggaatctctttacggaaatctattttcacatcaccacctgcttttcgagaaagtgctgccaagctatgtcctgatttgccctcaatctttcgatctgggtttaacactttactcaaaatcaaggagtcaataagttttaccttatttttgccccacgtattatatttaacactgtaatctaatccataaaacagttttgtagccaaccagtcgtagttgataccgttgtgagccacagccatttcaaccagatattcaggcttgtctttaaaataaccttcatgattaataaaatctgggaaatcttttagttgaaaatgtgtgtaatcttgcgccacatactctttaagaacatatgtgtatttaccatctgactcttcataaggacgcccatcaaagatgtatttagggccatcgtggaaagctactatttctcctgtttcatggttctctaagacaatacagtgcatttgaaatgtgtctttgagacgataaggactagctaaataatcaatagtgtcattattcaacaatccgtttgcttcaatatcccatgtaaacttactcactattcctcctttctaatgttctccagaacccactgaagttcttttaaacttaaacttcttactcccgcagttttactagcttcagctttaagtaacgggtaagcctcaatgatacgcgttttaagatcagaagtcaaggcttttaaaaaataggtagatgcttcagataaagaatcctcttctgataacactttacctgcacttgctcccgctctcctaacggctatgtcgtagtctttactgttgcctaatacgaatagtcgattttctcctaaaacaacaggagaacgcttctcgttgcgtttaatccatatctggaatacacaaggaacatcccaaggttctccatgaagaataaaagatccttttggacattcttcttcgtaaagaagatgcatgtggggatttagtttgtgtgcaaaaaagattttttgaaatgtgcgaggcaagataaaacaaataccaccttcgttatccaacatttcagcacaatggttaaagaacttaatggcaagactagcattttttccaaacggaggattaccgacaaaagcagttacactaccaacagactcaacagattgagctaaaaaatctgcctcaatacaatcttcaaacttagggtcaatatcaaaagaagttatgtttttaaaacaagaagagaaagccccttctcccgcagatggttctacgtagttagcttcctctccaaaaatttctttgatcttatcacataagaaccccgcataagcggggttagtgtaatattgatcaagtgtgttcaacttgctcaatagtcctccttagttgttagcgaactcaatagtgaggtcaactttaccatcgtcagaaataaccatgtttttggtatttttaaagatgatatctactttaccttcacttacacgacagaatgcaacaccatctgcaactttatcgatataatatttgtaagaaagaatacccactttactacgaccagcaccttttgtgaaagaagggcttacatcgaaacggaaacctttagaagaaacaacacggtaagaacgtccagttggaagatgttcaataacagagacattattctcaacaacttttacagcaaactcttcaggatgatcctcaacaatcatatgtgggatggcaaatgccaacgcttgtttgtgtttaataacaccagcacccagagcaccagcagctttaacttttgcattcagatcgattgtcatacgcatttttacttctcctcttgtttggttgatgagacaagtataagtctcttccgtaaagttgtcaacaggtatttttaataaaagggccgaagcccttaatagttgctatccgtaggcaaattagcaggattgttgaaatactgctctttgtcatgcagagttgcagttctaatgtcatagtaaaactgccctgccggaccagtttctgagaactcacggttttttaggataaagcaatgagtcgtattgcgttctacagggtcttcagcggctttatctcgttccaaagccaaggtaataccagcacctttagccaagaaactactacccattgcatcgtcctctgttaagtgttcattgccaccattagccgatttcttaacgtgtgagatgacaataatagttatagcatactctttcatgatgcgcttcaaccatgttgctaactcttcctgggcttgaacatccataccagaaagcaaatcagaataagggtcgataacaagaattgttactccaaaatagatgatcatctccaaaactttttctttgatagactccacatctgctccacgatcatcacacacataaaaacgtggtgatccatcttctctttcgtaaaaatctaggattttttctttattctcttccaagatttgaaatttctcttccggtgttttcctgtgtagaggaatatgcaggaacgaggacaacaggttacgagaatatttcttataagttgcttccaaggacagaatacctagggtatgttctgggtgcgcaacaataatatgtttggtgatctcgttcaccatcaaagttttaccgatactggtctttgccaggataactgtaatctcttcctctactaaaccaccacccagcatgtttgcagctacacgcataaaaggaggcaaggtaatcatcttggattccaagcattctaatgcagcttcatacaagacattagaagcataaacacctgctggggtgtatagacgagcactccaaaaagcttttacgaaatcttttgcacgaccttcttccagatactgattggcatccttaagatccatctgcatacggtagactttgttacgaggcagcaccttaacaatattttcaaatgcctcattacctgctttgtcattatccatgcaaacaataatcttcttaaatttttcaaagaaaggatattgtgcctgaacttgtttatacatactggtttcaccagttgtgccactaactactgctggaagctcatatttgttgtccaagttttcagacagcatttgataagctgccagagcatcgtgttcaccacctgtaattaccacagtgtgagaacggtctgcaaaacgaatttgtccaaaaagatctacatctttacctacttgaccaataggtttactgaaatctttaggatgaatacgacgcttaaaaccaaccaattctttaccgatggtagtcggatataaacaactttctactaccatctgatccccttcctgacggtattcataacgaacaccatagaaagatgaaactttttctttaatgcctcgataaccacgtgggttggttgatgtttcttgaacaattttacgatgaatctgtttattaaattccgaacccacaatctcctcctcttcttctaaaacttcaccattttctcgtaaccattctacgctaggaatagtgtattcacacgcaaagcacttagcacccttatgctctccattagaatctaatccataaaccatcaggttattacgagagcgatccttgccatttttcatgcagcgcggacaacctgtatgcccttccttgctaagatcaacatcaaatccatatttagttataatgtgcgacactttgttctcctgttaaaatggttcgttagtctccatcatatattctgcttctagttcttccatgtgctttctaaattggaaagcaatttctgctacagttacatttaaatctttttcaaaaacttctgtagagccttcataaaaacgaataccgtcaattaaaagccctccgtggtaatcccaatcactttcacgagaaagcgggttaggctcttcataatagtaatccacctccacgactaaggctttcccgttacgagtggtgtattcaaaatcaaaagtgttaatcattatagctcctcaaataaaagtctacgacgctcattcaacacatcaatgtgataatgagtcctgacatacttagctaatgctaatcctttctccatgcaaacatcgggagcacttaataagtattccgtaatatctttccactcggaaggtgtttcagcaaagaataacaaatctttaaactcttgtgtatgataattctcacgaggagaacagatcaaaggtaaacccttagcacctgcctcaagaattttaagattgctttttgcattattaaacacgttatcaagcaatggcgcaagactgatttgatgaccatcgtaagattccatgtagttggcatatggtcttacaccttcataaacacaagttggtgctacattttctctgatcacagaccattcacgactacttaaaacttcagaatccctacgaaaaccacatattgtaagatctttaccaaaatcgggcaagatagccaaatcttgtttatgtgtttcacttccagcccagactaatggagttttggagtagcgatcacgggtcaacacaaattgaccttcatcgtaaggaagaccattagggattatgtgcacattatcattgtattgtgaaagttcaacttgcaaagcaggtgtcgtagttgtaacaagatcgctgtgctctaaaaaccattttaaatgttcacgaatacctgattcaaaaataccttctaacatgtgtccttttggaataactaaagagtcatccaaatccataaccattttaaagcctaggtttttaagggctaaaaagccctctttaccttttgttggcactccgttaaaaacgaaaacgttgtgtttaggttgtgaagagaactgccttgagtaaggcagcactaccctatggaaatcgcagacactataattgattccgttacgattgtcaagaattatttgtcccatacttcacctacaaactttcaataacctggcgtcgcaactcgtttgcatctgccagattataatgtgttcgaacatgttcagccaagaacaagccacgatcttcccgatagtttggattgcgaagaagcttaacaatttcgtaatgccattctgctttattctctgcgtaagcaacagcgcgagcatctacagggttaaaataaggtaataccttagaacaaacaattggaataccttttgctccagcttccaggattttgagattacttttacaattattaaaatcattatctaccaaaggagctatagcaatagcatgactttcgtaaacactcatgtaattatctaaatcttttacagcggctttatatttggcatttggtaaatttctgcgaatcttaatccactcttgtcccgtgatgctttgtgatgcttcatatcccgcaatagtaagaagttcatcatcgaaagtattagagactagtcgtaagtctggttcgtgactagcaccgccagcccatacaacaggggtaccggatgaacgatcatttgacaaagtgaattgtccgctatcaaaaggaagtgcatttcggatcacaacaacattcctatttaagtgacggatcttatatgccaaatattccgtagtcacaattaccacatcagcaagcttaaccatagctacaatagcatgagtgtttgactcgtatagacttgctaaataatgttctggattaagttggtaaaaatcatctaagtctacaacaaccttaacaccttgacgtttcaaagataaaacgtattctgcacctttagagtggatacggttaaacacaacaacatctttcttaggttgaatattattgttgttaaatggtataacaatacgatgatagtcacaaccgctgtgaggttttgcatcaatttttagtttagaccattttttatttgacatgtgctagtgcctcctcataggaaattcggattttcccatttttaatatcctctaaagatgctttatattcttcccagttaatcccaatagcagcctctttctcttcttttgtcaggttagcaaaaggcataggattgtttccaaaaacatcgtctgggtggatataagccatgatacgaagtggacaaggtgttgcctgaataccatgattcaaaccagcagcttgcaaacggtgtccccattcagcatcttcaaaaccataaccgtgagtgtaaggacggaaataacccatcttctcaacaacggcacgagaatacattgcaaattgacacattgcaagttcccagagaataacttctcctttgcttccaacaactttatctttgaaatactccggcataccaaagaaatcccatcctccagagacagcttgatctacaaagtatgtttcccatccctccatgactgggtagcaatcatcgtcaaaaataaaccaataatcataaccttcttcataaaactggtgcataagttcattcctggcataagctacacctttacgatctggatcgttgaatactcgaaaatctgcacgtggatctgttacaaggtagtctttaagtggacggacacctacagtgataacacccactccgattttaatattttccattttctctcctaaatagttttactgtgatcatgacagtgtaataaatgatgtatagaccgttgaggatctgtttgacctaatctgtaaatgtgaaacagatacattccccgcatcaatcctaacctctttcctttttcatgtaaagtgcgagagaaaattaagtcgaattggatagatttttcttcgaaaggaatttcattccacaatgattttctaaaaagcaaaaagaaacctgccagaggtgttccgaaaggaacttcttcaacatttactttatgatattctcttgcaatcttagcatattctatatggtttagaatatctggatcatcgttaatttggttagagaaaagttgataaccactgcctaacctgttacaagttgcacctattacatcaaaaggcgggtttgacataacaagctcttcaagcatagatggttgatcaggtaggaggaacattgtatcggtatctcttaaacacacccaactatcatctggaagaacggcaatggcttcattgatagccttgccgatatttcctgtcagatagggagtaatataataaatcattctcccctccgttatattaactgtcagctacaatcccacgtttaatcatttcttgttggatttggatcacacgatctcgtgcttccatatattctttaaaagattcttggagatggtcacgggctacgtcccgtagtttaatcagtttgtcgtttgtcacttcttgaagagagatctcgccagtttcattggtcccaagcgttttcatttacaacctccttaatagctactgcacagttcttacaaatacattgacctttgttcttagaaatttcaatgtaaggttcattttcgttttctccgcgtcgtgagtcgtatattactgtattgaagcagacaacgcaaatgtttttaataacgacatatttttgcactttctgtttagtgcgaaaattgacttcaatgacttctcccatcagtgaatctcccctaaaatgttgttttgagacattactgcggagcattctacagcatcatgagtccttgcaaaacgctcccacaacacagcatctactttaagaaccatacaaggataaatactgtcgttgatcatgtcaatgctatatttatctacatccttttcatctcccataaacaaagtagcgtatgcttctaaatgcttacgggtgtagtatacatcctcttcagtaagaccgacaaccaggtaacttgctacaacaacagtattatcttcttgcattttaactcccctttggtagatagaaaccatgcactttatctcgataaacaagacgcatatcacgttcccagtgtgttcttatattccgtttcttgaagtatagagcacctttagtaacatctaaaacagaccgcaattcaggaaaatgtttctctaaataaagtaaacgctccgctattgcttttgcttcctgccacttatctttctctgttacgttaaaagttttcgcatatgagaattgccctttctggaacaagactcctctgactgtgttagggaagtaggtatcatttcttctgttgattaccacattcccaacggcattcattccttttttacccagaccgcgaccttctgcgtaaattgcacaagctaatagaattttatcattatattgctttgtacatttgtgaactactttagcggtttttacgtttgcagcttcggctttcgccacaacaggtgtaaatgtaaaagcagttaaggatagtaacgcaactgttacaaagttttttatcagcaaattttgcctcctttttaagttaacgaatttctagtataacacgatagaggctttattgcaagagggggatttctccccctcaaaatcatttgttaattattacggacattcataccattcttttttaccaccgaaggccatcaccacatcacaaatatccagaccagctttacctacaccatatgctttcagcttccattccccatcttcacgaaccaaggaagccacgtggcagattgtgttgccagctacttcaggagccaggaagtcaaaatccagaatttccacattgcgctcggagtcgaagattttaagcataccttcagaagcatgaccaaaacgtttcagacctgtatcatcatcaatggtcagaacaaaggcaatctcttgtgcatcaggagagattttagccagagtaatatcaatctgctccatgctgccagttccatcacgaacatcgtcaccagcgaaggtagaacgttcaggatcaaacttgttagcatagcaaaccagatgacgtgcagacagcatttcaggattgccagcggcattgtgacgacaaaccagtgcacttacatccagatctagtttagaatcagatttccaagagaattccaggcgcagttctttcagagccggagcaactttcttcagggaaattttttcgctagagccttttttcagggaaattttatcagtcatcttttgtctcctctattatttaagtgtaataccagttacagtcaattctacttccaaaagcttagatgtgttttggattgatactaattgtgcatgatggtttagttctacagcagaataatcattttccccatcatctacttttaaataaacaatgatttcactaaggtctaaaccattttcgtcaaatgcattttcatagacgaaagtatctcctacatccaaatctttaatggtaaggcatcgtttatttactttttgctcatcaatttcgaagtttaacacttcttcctcctaatgttatctccggtttgtatatacgaagaattatagcattttcattttctttgtcaacccattcttcataatcaggccatacatgaatctctactctacttacaatatcttccattcgcacagtcccaatgaaatactctttgagactgcgcataatgaaagcttctctctcgcgccaataattttctatgacttgagaggcaagctcgtcgatcattttttagcacctactttaacaacccactctccgaactcttcagataagagtttgtcataaagctctgaatctgtcaagtctaaatctttaatgccaataaaaccaacattatcataagcatttgccagttctttcaggaagccaaacttctcattaccaacgccaaccatgaaccaataaataggtttattcttattctcttcgataagacgacgaacagcactaggatcaccattctcaccatccgtctggaagaatacaacaccaggggtaacgtcagcacctggttcagatacagctacaactttttcacgctctacagacactgtttcagttttaccaagcagacgattaaagaagcctttctttggagcctcctcttgtaccacttgtttagtggtaatatatttagtaacagtgccaaaatactcatcgtagatatccgccattacaggggcgtaatttgttccacctccgatacgaacattacgcatacatttaccaacataatcatcgtaaacatctgctgttgctggagtaagctcttgggaactcgtattgaaggcccacatatcaatttgttgattatcgtcgaacagcataccaaaaggaagcagtttacctacaaaatcactcactaccccactagaatatagaccatgcatactaccagaaatatctagagcacatgctacacgaagaacaatcttaccttcgttcaggttcttattctttttcagagagaaagcaaggttttcttgacgttttttcaggctgattttctcggacatattatttctccttcttaagtgtaatattggtaacttctaaatctacttccaccatatttgtatctggtgggatgcaatgagtatagcctcgttgtgctagtgatccattaatacagatcgcactgtttgtggaatttttaatgaacaccaagttacggtaggtatccaaccctgcgtcttcataggcatcataatacatgaatgtggcccctacgtcaagatcttcgaaagcaataggtaaatcctgacttttttcttcttgaatattgaatctaaacacgcatacctcctctaccaattttgaagcccaaatcgtaagcttccttagtgatcttttgtaactcacttataggaagtgttacaagaggatcatcttcttcaatttccatcttgtcatcttctgtttcaatgagagtattatgcactttgtgataagggttgtcaacacgtttaaacttattcttttctgtgctgaaaaaacaatctggatcttcttcaccatcaccccaaccttggttaggatctccgtcagattgttctgtagggatttcacctgtaaagtactcttccagcaccatagcgataccgtcccttggatttgaggaatgcatcaaatcacaaaccttaccccaatccatagcccattcgaaccgttcacgaacgccgttttcatcctcctttccagagaaaacacaaccataactatcatagttgccatacatctcttcaataacaacaccgtccttcaaaagaaagaggtagcaaggtgatccgtcgaaagaagtagaaagggcagctttgcccgattctttgcacaaaaagctaaaacaacccattacaaaccctccttcagattatcaagagctacagtggtttcacaagagtctccataagttttatgatgttccagaaaagcttcgggtccaccccagtcattatcttgtgtattccagccatcaataaaagcatcttcaatgattgtgatcagttcctgtcgagtcaacgtaatggtatcaggtttctgcgtagtttccacacggaaccctggttcttcataaaaacctttagttacaatggattctaactcttctgcatcacagaggaagtagccacaaagataacacccaccgtcatcatctttcattacttcataaacttcaccacttgttaacttgatgaaaagagtagggtctgttactgtaagttttaaaagaatacctgttggattatacatcttcttcctcctctaaaatatggaacccgtaattacaataatcctgaaaggtttcgtgtgcaagatcttctatatcctcttgagacatatcatcttcaatttcgatatccacaacctcattgcatccacaccaagcagtttcaatattcactcgtaatattttcattactcctcctcctcattgaagtcaatatctgcaaggagttcgaatttacggaagttacgacaaccttcataaatataacaatcacgacaaactgctagaacacttgggggatatatgcctcccatcggtgcgaatcgtttttcgtcatcataacggacaccaatgtcttcatcaattatatagatacggattctcatttaccaagccctcgtttcacagcagctaccatcccgtcttccagagattgaacttcattaatataatcaacacgagcagcacgggcttccgtattgatgcggttagtttcttccaacatcttaaccaagttttcctgatcgtgacgcagagtttcaatatccaacacttgacggttagccagtgctgctgcttcgatctgattctgtgtggcaagatcgctacccagtttaattgccaggttaaattcatcaagaacgttattctgcgtctctgctgctttcatttgacgtaagctctctatatacattgagaagttagcagagtaagcaggaataacattatttactatgttacgcgcagatcgcattaagcttgcagaaactttttgcataccttgtacacgcggtcccatttggacacacagtaggcgcaatgcttttaaatctgcaatacgaatctccagaagatccaaagtatctcggatcacttgtcgctgttctactgcatcttctggaagagcagccaaagcttgttcttctttttcataggttgctgttagaagctgcatatctcggttcaaacttgcagcatattgtccaatagcttgatgtagcttttcaagatataccaaggaatcttcttctttgcgaatatccatttgaaggttctttaccaactcttcaatacggttattaacattatcaaactccccaaacaggtcttctttcatacccataacttttttaatgagtttagtaatacccttgctttgtttaatagagtttggatcaagttgttttgcctgtttaatcaaagctgtgagtcgttcactcatctgatcgccttgattactacgttgatgttttaatacctcggcattcaaggaacgcaaggttgttcctgcctctgccccaatctcttcgatctcttgtcgggtcatagaaggcaaaactggaacttcttgcggtgccgctggtgcataaacaggactggcatctaacacgcttggagcgaatacagatttacttgcatctgttgttgcagcaaatacgctcatttcaggcttcttctgaccaccagtagctgcttttaaaaatggacttgtcattcttcattctcctcttctgcatctcttatatatggtgaaacaccgtactctttagctactttaacccaatcgtcccatttatacaaccataattttccttcggtcccttctttatctgatttcaaccacatattaggttgcttacctgggtacatgcgattaggtttacgattataacctctaacacatcttgtcgcaaacctatctaccagaacaagaacatatttatattcgtggttcaacggctctttggaagtggctttaggattagcccctaattctgctgccagtttttgccaatgagcaccgtgcctactaaacttacccatacaaccatcaatagcatgagcaatttcgtgcttcattgtatccacgatcatatctcttgtggagttcttatgcaagtgccaatttacaacaacaattttatctcggtagttgcaccaaccgaaagagttattcactttgtttctaacacaagctttatatcctgcttcacgtaacatgttgtagtaaacaggaaaatcttcttttatttcctgcatcacttcccaccacaagagttgcaagtctctctcggtatgcataacttacaccttaaaagcgaaatgcgtggtcgtggcttcaaaatcagggccagataaacttgcactgaaatctgaaatatttgtaattaaaaagcttttatgcatacctaacacagctacgctttcaatatcttctactaacatttcaatcatgttagaaacatggctgaacgtagagttttgttttttgatggtgtagaaagaaagattcccacctgctgtataagatacctcttcaaaatctttaatcgtatattgtgtgccatcagtaaagaaaatggtagctttattagtagcacgtttcttgttttttggtccttttttacgtttactgcgagtaggcaaaccgtttgggaacaccatagctacaaattcttcagcagaaacctccttaccgaaatcataaccataagaaacagcgtctataaactcgtcatcttcatttttaaaataatggaaatagggccaatttgaaagattatcaagcatcttatgctcgtccacagcagagaatgtatccctcaaagcgcgtgtgatttgcaaagcattaggcaaccttttaacacctacgatggaagtacgaatagaaattgtcattgtttttctccttattaacgtcgcttgctacgagatgaactctttttacttaaagggctattgtaagatttacgagttgtatagctactatttgttttaaaagtttgtctcggcttttcataagtttttatctcttgtttaggcttaccataaaaattagttttcggtttaggtgtattataatgcttattaataatcgttctgttatcgttataatccccactgctacgattactaccgccactcatcatatgacctaacaacatacctgtagcaaactcaccaacaccgctactactagaaccgccaccattgttgataatagttgtatctccgtcagatccttgttgagcgtattgttgaggaggttgttggtattgtgcaggatttgtttcatcctcgcaagctgttaaaaagatacaaccaattaaaatcagggctagttttttcatatttgctttcctcattttgactattaatacatctgtgtttgaaatctccagagaagcaataaagttgctctccatctcggtataaactcactttactgccgttgattacgcttgtcaatacaaaaattacaacaaacaaccctattgcaaaacaaatattttcaaacacaaccaacaagtatttcattttaaaaatacctcatcatcagtttcattatcccagaagaacaaatcccaaccattcggatcattccatttggctgctggagaagtccatatttgttcgatatcaatattcaaaacttcaccgtttcgttttgaaacagctttagttaattcccaacgagatacaggctctacttcccctgaaccactcccacaacaagctaccacgttaggaggcaaattaattggatctttggtcacgatcataacgcttaccccagggtaaacttttgaaagataatctaaaacgtaatccacatcaccagataaatcccaaacaagttcttgaatttcatcaaaattattcataagtctctcctataaaatagcctcccgaaggaggctcatctattaaacagcagcttcttctttttcagggaagataaagcttgcaataacaccaagagctaatgtgcctagaacaatcatcagacttacgttaggggaaatatcatgcgggaggaatgaccacttggcatgaagtgtttcaccgaacgggtgatacataagtttagcaccaacaaacaccagaaccacagcaacagctttctctaagtgaaccagatatttcacagctacacttaacacaaagaaaagtgcacgtaaaccaagaacagccatcagcattgcagaataaactagcagaggttcttgtgtcacaccgatcacagccggaactgaatcaaaagagaagacaatatctgtaagctcaataacaaacacacaaagaagagcaggagttgcatatttaataccattcttaatggtaatgaacttttcaccatccagtgcattgtgcacaggcagaactttacctactaaacgaacagcccaatgcttagagtaatcaatatcctcttcttcgtcaccacctttgatgatagccacggcagaccaagctacaatcaaaccgaacaacacttggaccgaccaatgaaggttaaacaaagcggtccctgctgcaacaaaaatacctcggaagacaatggctcctgcaatcccccaaagtaaaatcttatgttggagatgtgtgctcttaattccaaagcttgcaaaaattgccatgaacaccatcaggttatctacagaaagactcttttccaacacataaccacttaggaaaagcgcggcaaactctttaccatgttctacccaaatgaatgcgtaatatcctaaagctaaagcaatccaaaaaacagaccaaagcaaagcagatttaattccaatttctttattctctttatgaccaaagaaatcgataccaatagacaatgctaaaataccaaccaaaacaactacatcaataatggggaaaccaagttgcattattttctcctttctctttgcggggaaccactccccgcctcatgtgatacatcttactctattctaaaactttgtcaacacttattttgaagaacttgaggaaaagatcccacgtagtacagccatgataaatgccacacacaccacagtccagaaggtgacaggaacagtgatatctgtgtgacccatcatttcaacaacgtagttataagccagcagcagaagccatgctggaatcatactaatcagaaaagcaataacaaacacaataatcactgcaagaatacctgctaaaacgcccataatatttctcctcttaaagtttataaatagtcacatcgtgacctgtttttactaaagtttcttcaatcatcacttggatgatagcccaattacctccagcatgtccagcgccaatcataggtaagccgatcttacatttttggtcacggagaagcaaatcgttagccatagctattagtgcatcgtaaagtgcatcatagtccaactgacgacctttagcattgtatccgtaacggtattgcccgtatagattatataccaaagggtctgattgttcgtctggcacccctaaactaaaacaacctagtttactttgatcaccagccattgtgtctaagtctgctgcatatgcgtaaggaaatgctcgtttgatttgtggggcaatacctgcccccatattacacatacagttgcaacaatgagcaataacagttacttcacctgctttagcggcatcaataagattacctgttttcattttaagcatttttagctccttattacagaatgtgttgttttgtgtaacgatccaagaattcaaagttttcagcatactttgaaattcggttgtaaccttctcccaagcatccaaagaaaagttgctctacatagtaatgtggcaattggctaagaatgattttgaagtcttcatgattttggccaataagatacttaataggacgaacaagacactgtgcatcacgttcttcattaatcattttaacaaacgcttctggtgtattaatgtagttaaaattcagtttagcttcggtatctgcttgattacctccgtattttgcaaaatacaagaagtaaacatcatttttaacttgattttcatcaaggatctcaatcagtttgtcttcatgcgttccagtgatatttacatcatcaatgaatacaagcttcttatcaccccagaattctttgttgcagtagaatgtatccccatcaataagtttcttacgactagctttatccaagaaaccataatcgttgatatagctaactttacgatgaataatgtccagttctgctgaacgaccttgatcatattgtgattgcaacatattaaaataattaataaaatgatctgtcatcattgttgcagcattatgcacatggttataaggagaaggaatgataacaaattgttccccaatatgtttcattgccacttgagcaaaaaactgaagtgccaattctttacccatacgacgcgcagcttggttactaccaaatttcaattttgaataatcttggatatcaaaagtagcagtttccaggtcatcaaatttatttgcaaaaatttgagtttgattacgcatttacaatttctcctcttttaagtttctctagtaagtcgttagggttcttaatatgacagaagttaaatcctaagtcaacacattttccatcatattcttcactatcgcctacgtgcaacacttcgtgccctaacagagggatcggagaatacgtgagcgtgcgagcaaagaatcgcggatctggtttacaaagtaaagcttcatccgagaaatgggtgaactcaaaacaattccaactatcaaacttacaagcacgacgcaggatatcccctgatatgaagttggtattgctcttaatactcaaatcataacgccccgaaagatacagcaagtacatcggtagatccacagctacatgaggtggaaacttaaggaaccattgttcacactcgaaacgaagctttgcagacttcaaaggtgttatcccaagttcgtaaccaagtctttcccaggcatatgctgcacactcggctgttccctgaagtgcagcattgtccagttccttcttgatcttattgtaagctgctctcgcttctacttccgtaatatctccatattttgcgatagtccaggctcgcatgtctgcgtaattggagtttgctgtgatcagtgtgttccatacatcaaaagagatatgtttaatagtcatattaagcccaccatgcgtctaagttaagattactatccactaccacttgttctatgtggtagccttttatctgtatcccactgttcaagagcatatcatacgcttcattgaaacgcaacttatcttctgcggaatataagcgagcattataaaatcggtaatcaacttcttcagcattagaagaaatacggaagaagtttgtttctacttcgggatcatttgctgaagtcttaatgtgaacttctccgtaattttctttacttagatccatgaaaagaacacaggcaacatgtttaaacattcgttccagtttgtaacgaacaacattgaaacctgcattctcaagtttttctacacactgcaacattaaagtagtgtcgagatcgctttgatattttgttaacatacgatcacgttgagactttgtatcccgatgtaaatcaattgttgtgcatttggcaccaataatcttagctgctttcatcaactcttcagaactaacgttagataaagtaagatgaaaatgggctttccacacttttttagcagggacaccaaaagatttatccccactattcggcatgttgactactacactatgttgcattacttatctcctcacttaaaatggaagtctttgaagttcatctcctccgatatcaagtaatttagcaacatctcgatcagaaagcaactcttttctttgtaaaatatccacaagggttgcaagaatgtccttaacgtcccgatcactgttcttcaaaagttctcctgccgtccctactctatctcctacagcaaaatatgtaaccatgaaacctcctaagttaatctgattgccaaccacttgccgttttggtccataatctttgattatctgaccctctgaaaggttttgtagttggattgtttatttcatactttccgtctacaataatgtcaacaagatttttaatatacaaaggcacttcctcaaaagtatatcctgtatacaccattatatctttgcttgacccataaacgtctctaaccttttctataaggtttttaacattgtaaatattctgcggatctaatggctctcctcctaaaattgttaaaccttttacaaacggtcttgacaaatcttttaaaacttgctctacattttcgtgagtaaacggtttcccataagaataagaccaggctttttggttaaaacagccacgacaaccgtggctacaaccactaacccagagggagcacctaactccctcaccattaataagatctacaggttcatatcctgcaaaattcaaagatgtttctccctttgcaaaacttcctgcattttacctttgttgtaaggccgtgaattaggggcagaaagataccctgatacacgtctaactacagaaatagtttcttcttcatggttgccacaatcaggacactcaaaccctttagccgttgccttaaattctccatgaaaaccacacttaaagcattgatccacgggctgattaataccaaaatagtgaatatgttcataagcgtagtctactaaagtctccaaagcttctaagttattctttaagtttggtgtttcgacataacttatgttaccaccattactaatctgtgcaaaacctgcttcataatcccatttttcaaaaggatttgttaccaaccatacaggttgatgaaaagagttagtaagatagtctctttctaccaaacctgggtatttttcatttaaagctgttgcaaacttatagcacaaagattctgctggagttccatagagactaaacgccagcttagatcgttctttaaacacagcacacacatctttcatatgttgcagaatgcttttaccaagttcctttttatctttttcttctggataaaggatttccaaagcttcggcaagacctacataaccaatactaatagaagcataaccaccttcaaacaaaacaccaatttcatcattggcatttaaacgcgctaaagccccttccatgaaaagaatagggttttcagatgctttggtatgtctgatacggtttacacgtaacatgtgagcatcgtaggctatctccatatgtttattaaggaggtcggtgaaagattctcctttacttctcgcttccgcagcgatcagaggtaagttgatagaaactactccaaggttgaatcgtccatcgtatttttctccttgttcggtggcatagtacgacaaaaaggaacgacaacccatactcgtaacagtgccatctgctgatcccgtaacttctttgttcaaaggaacagaaataaaatctggataaatacgatcagcacaacatgccaaagcttgttgcttaaggtcatagttaggatcactaggtttcatgttaacaccttcttgtaaaaagaaaataactttagggaatacaggtgttacatgatctttgcctagaccgttactatgcactttaagatagttagctgtgatcattctgccaaaaacagaggtatccagacccatactgattgtaataaaaggagattgtccattaacactcattaaagtattaacctgatacaagagagtttgcatagcatcgtatacatcttgttcggtcatttctagggcttcttcccttgcataacaaccgtagcgacgtttggttatctccatgtttttaaggaaactagcttcaacataaggactaagacctttatcaatgtgcgcacacgtctgacctccatactgactggaggcaacagcttggatgatttgagttagcactgtggtagctaccccaatagattttggtttttctatctgtgcagcaccgatcttaaaaccattttctaacatatcttgataattaacaagacaacagtttgtaagaggagagagcagataatccaagtcgtgaatatgtccaaaaccttctgtatgccattctgacaagttttttggcagtatctgtgtcattgccatatgtttgcttaaaattcccgccaagagatccctgtgtgtgttaacgaggtgggaaggtttgtttgcattctctctagtgtatgtttctgaagtgcgatctaaaaaagaaaaaacatcttggtacaaatctttcattattaatccttattttgtgagtagaactattattctacctcttccaaccgaaaaaagctttgaggaaaatcaaaaaaggcgcaaagtgcgcctttaagttttatcgtttggagaggaattgtcttcccatgatcttaccgttctttacagcggtcccatcgtgtccattataatcccaagttccatcaatgttacgcaagaagctatcacgaacagtgtaggctttaccgttctctactttactttcttccacaatgattgccataacaagcttattttcaatttcggtagtaaccgattctttaataccctctgtaacttcacgatcatattggatataaactcgctcctcggtcacttgcacgtctaccacatttttaaatgtgtatgtctgctgtgtagtgtaaaggacacgaacaacactcttcttacctactggcggcttcttacgaggcttacggtaacgtggtttagggttgttagttggaagccaaccaacaatatcccgatcatatccaacatgaccccaagtgaaatgcgtagccgatccactatccgtagttccgtcacgaaagagaacttctacgtgaccaccacaagggcggtgtccaccattattatagttgtattttgccgtgcgcgggagaatgaagtattctttaatcgcccactcttccagattgtcgatattccaagtgaatactgttcccttagcaacatctgtttgaccattgttgaagcgaacctgcacgaaatcttctgaaggcataacacctgtgttcggcagatattcaaatgcagtatcttccgctacaaactgttcttcctcttgctcctcaatacttggcacaggcgcagcttcatcgtatttcgcagcaaacatatttttaaattcttgggccgtgacttctacaaggccgcgatcaccagtagcagcagagtgtgggcgtggtaaatccccaacttcaatatgcattgcatctaaacctgcttgacgatcaaagaagataaccttgcggaattgtttatctttatattgtggcagttcatacatacttgggtcgattgtcttcaaacgttcagcatcttctggcttccagaagcttttacctgttgcaaatctaaagtctaccagtagtttaacaacatctcctaatgataaactatctgcatctacgaaaacgtcttcgattcccaataaccctgatttcttaagaatcagatctaacatgtaacctcctgtggtttgttctgcgtctggataacgatcaacactggtgctggttacaccgtttatttcaccagtggaggcattgtaggaaatatatgggaaggtcatatcgttcattgcaaaatcacctgaacaggttggatcatcttctccctcccagccatacaccttcacaataccttcacacaatttgtcatacacaccagcgcgacgtgctgcttcagcaacttcctgtttacgggcaaatttattaatcatgattcctcctgttaattgccatagatgcacgaggttcggctatggctgttgcataaatatatggatgaccttgtggggacaatcttgttccgaatgaccctaattctaaaccattcatgtcttccacgtcaagccctatttctgtttctacaattcttgtttggactttgtagtaggtccagaagaagtatcgcatttcttcggcatactctttcacttcaccaaagctgggatagaactcaatcaactccagcttcaagaagatgttgaagtgagaatcatccaacacttcctctgtgcggtaacatggtgtcagggccatgtagggatgaccagcgataaactcgtagccatccttttccatttgcaagaatgattgctcggcactggcaacataaaacttcccattaggatgccccaaaggagcatcttctttgccaggtggcagtgtgaatgccaaaatatctgcatccactaaataaggaacatctaacatttcagcaaagcgtccataactctggatggcttcggcaatcacacctgtgttcatgaccttcctcctgtgcgaaacgcacgtttagtaatgtttgacataatgatcaaatcttgtaaagtcatatctgggaactgttgttctaaaactccctcgacagcacctataatatctgacaattcaacaagttgcattattttgcaatcctgctcaacagcatcaaaaagttcttctacttcctctttaatcttttctatgctgccataaggttgtttcttaatgtctgttatgtgataccccgccatttaacgatcctctctgatttgattaatcttacgagcaagggcagctataagcttatcttcttcggatacaggagccgtgctcttacctaaacgatgcatgtctaaaatctcttgaacagtccggttccattgcagacatttaatacaacgtgtatgtgcaacatacagaagatttcgttctgattcttcaagacctacccactcacccttcttatcataattggaagggaagtcatttgcaacaataacctgatcccactccaaaccttttgatttgtgggctgtagttaaagtaactttagccgttggagagttacggtgcatacgtaaagtgtatgcaatattattagctttaccagaaacaacaatgtttaaaagtcgttttgcatcaggatctgattctgcacactctacaaattcttcccaagaggtgtaagggagaactgtctcatgcttaactttgtccaaatcgcctctacgtaaagcattaacactatcaaccatagaaatgaaatctttggtatctacgttaataataatctcttctccgttagcgattcggtccatagcttcgagcaacagagtcaaattcttacggaaaataatggtgtaaggtttactataatctaccacatcagaatgaaaacttccagtgacagtatcataacctttgcctaccagcggatgcttcagaggtgaacgatcagaaaggatcgcattagcaatgtccgcaactttaggaccaaagcgaaaacaagctgtcagaggcaactcaaccccatatgtagccgtttgcttcatcatgttctggcttccacggaactgataaatactctgaaattcatcacccacaacaacaatacgtttagccgatttagcattgcgaaggatagacaggaatgcagggttaacatcctggaattcatctccaaaaataatatcgtatcctaagtcttctttgctcaattcaaagagtttcacataggtgtcatgagtcataatggtttctgatttaggatcgatacgctcacgccaaagttgcttcgcatatttaacaacttcgttaataagtttttgttcgttgatgttcttacgtttaagatctgacatatgcactttaggaaaatgtttatgtccaatatgttcatcgtcagaaaactcatatttagctaaagtttgttttaccattaacccgatcattgcacgagtcagtagcactttaccattcttatcaatcaagttctgaatcttgaattttttggcaatctcactaccagttccagctacgttaacatattgaccttctggacgagataatttgtgtcgaaggttttgtggaagacgctggtaacagattgaatgtagcgttcggcacataacgttaggcggcattttacgccgagcttcctctgccatacttttgttaaacgccaagtatagaatactatcatttgtgccattagccaacatatatagtgttgacgttttacctgatccagatttagcttgaattgtaacgaaacgattttctttatacccgctttcaatagcgtattgttcctcggtaggtgtaaaactcaattgtgtagacacgtatttctcctctcttaataaaaactcttgacaatcctcatcatttccttagctctgctggcataaggttcttttagattaggtggcaaatgtgcattaatgtaccccatttgtttttcccatgtccacttatctttaaatcttggcatggtgtctcctgctaaactgttttcttttcgtgtttgaataatccaattacatggaaaatgcacaccacctttacggaagggaatataatgtcccaatgtgaatgccttattgttctttaaacgtccagctaaattaagattaacaataagactacgaaacacgtagtattgataaagattgtcaacagtatatacagagtagtatgctctaagtgcattatctcgactaagattaccaacatccaaactacaccagtttaaattacttggatcgtagttgtgattatcaatccattcttctctttcctcaaattctgcattaacagcagactgccctgctgtagatacaaaaagagaatttgcatcaaagaacatactcactccccctttagtttacatcgtttagagcattaccaatctttaagataataacatcattaagagcttcttctccattaaggccagagaaagcaggagtaacgaaagttaccatataataatggtcttcttgtaggattgcgataacgccgtctagtttaacatctcctgtgaaacgaaaaactttcaacttttgttctaaaggaagatctccttcaacatttaaaaccatatctccgacaccaaacttttctgccccgatgtagatgtaagcttggtcctcttttttatgataatacaatgttgcttgtttgtcttgtagtgttgtgataccaaacacatctacatcaataatatttttcaaaaattctcctcccaaatccaataattgtctacataagtaggatgccttttgtcccactcttttctagcccaagctacggctgctaccaatacatctccatgacaaggttgaggtgagcagaagcaaactaaatctttcccttctaactctaataaatcttcaagagtgatcttaccacaacgaatttgctcccacaaccactctttatacctttgtatggttgatcctcgtggttcatcatcttttaacttaaaaggatttgcaaacttagaggcttttagtcccatatgtggcattgctctaccaatataaacagcaccctctgggattgttttgcctaaatggtaaaagtttaataccttcatattaacctaaacacatacgtgcgatcagaccctggatgagtttatctgcttcttcgcgatcatagtcggtatcttctataccaccatcttcgtcacgataaactttaccttccaggtacccagcatcgatcaaaccaataatcaaatcgaactgccagcaagagttaccgaaagggcgttttccactgaaactatcttcttcttcccaaagcgtagagagcagtcgtctgaaatattcacgcacagtaacagtgccaagatcatcgtcttcaaaaacaacatctaaagcatctggttcagctttctctacaacaggcacataacgttgaccattaataacaacatctacgattgtttctctcatttttcctcctttttgtattcaatgaacatatctgcatagtaagctttacgttcttcaaatttagcagggtttagcacaatgaacaacacctttctgttgtcttgtggttctttgactgtaatatataaatcttttgtgcaatagaaacctgtggctttgtaagcgtcaccccaattatccactccacgatctatacgatcaaacttacagttatactttttatcatccacctggtagacagcttcaccaccataccaagtgaagaattggctaccttccaccccaatcttgaaaccatcacgggcggctgtagcattggtggcaatcatcaacatcaggacacaaagtagccttttcatttagaattcctcttcagtcttctgtcggtttttgaagaatactacgtcatatacctctccgtaaccatcatttacacagaacataataaaacgatcatcttctgctgttggtgcgcgatgttcaagttcaaaactttcaataaaaccgcgtgaatttacgtagtagatttcatcctcaccagagaacatccaatccttgtctatcagatagaaagctaaactcacaggcgacaactcatccttcacagaatcattgtacagcatgtgggctgcaactgccaaacttaaagtcggattatacaacattacacctcctcgtcagactcatctgctttagagaatacaacattaaacgtttcaccgcaaccattatttacgaaatacatgataaagttttcatcttcgtctacagggccacggtattccagttcgtagctatacagagaactatcgcttgtggctccctgcggataccagaaatagatctcatcgaaagatttaacccacttcaaacctgtacgatcctcaaacactaatgaggaaggattgtcagcatctttgacagcttcttcataatcctggtggaacttgactgctgttgataatgtgctcattatgcctcctcgtaatgtttgcaaacaacgtgtctccacgtcttcttataatgttctcgcttcgtcatagcttcttgataagagggaatacgctgtaacagaagtctccattcacagtctacgcccatacgtccgtacaaagcataacgaacattgtttttcttgtcttgcatactccctccgatcagttaattaaactttttcccaagtaccaaaagcacaggaagggtagattccaacttgagggtttccgttatcatctttgaaagtaaaactgttgttgtctttatcaagaactgtagaataaatcttaccaacagtaacgcagttggaagcttgacccagttcagtgagagtaagacatttcattttctgtttctttgtagccatttataaaatctccttagtaagtgaatctttattctacacaaagagctttgcacatgtcaagtaactctttgtcagattagtcttaatgattggtgatgttgatgacaatcttagtttcaaccttagcccaacagtaatctgcttcattaaaacgactagtcacaatgtattctcctgcacgagaacctgttaagcacactgcacctgtatctgtagctaagtagtagtcccgttcttgttcacttacttctgaatcgtagtagtagaaaacagacataggttcaatttcagataaacggtataactttggaacaggggatttctcgataaactcaacagaagttttactcatttgttttctcctagatctaaactaattaagaagtcacgaaggatgatcatttgttctgtagacaatgataatacaccttctccataaatatcaccagaccattcagcagttagatctagtgtaccagtaccaggaaaccaatcaacagtgatctgattaccattagagtcaggtagtatttcactgactaacataacacactctcctattattgttcttgatcttacgatcatctaccgataagaacaagtacttaaatctctgttcttcgaacatctaacgatagagattaatctattacataatctatactcgctatcgctcgacccttcggggttagggtagcatattttttgaaaaaagtcaacacttattttttggtaagtagataaatcaattgttcacctgcttctggtgcatatagtgctttagtatcgaagtcaaagaagtgagtgactcctgttactttggatgcatgaatagataatcgtgcaagcttaagcagattatccatttccgcaatctttgcacgaaatactgcacgtgtagcgtcaaaagctgcatgtggcatgtatttacgatttagactactacgtttaaatttacgataatctgcaatgatcctgttacgttctttgttcaagtgctttaccagtgcagtatatacatgtggttctttgttagccattgttaatctcctcttcatatgttggtagtgcatggtatgcgatcacaggtgccaagtcaaaataaaaatgaccattgataacagctatcgtgccattgcgtgttttgttaacttcacagaatcccttcttgccgtttgccatgattacaagccactctccgataggaacatcctcggtaccagatactttaatccatccactcactttacttcccctttgtaatcggacactataccaggtcttacttttgccttaagatgtttcaactctgccataggagttgccacttgtataaggttaataatttcaacctcgtagatagtatactcataacccgcatacttcccgatggaatgcaggtatttgatagcatgttcaggtgaatctgcttcaacataccccaaatcttttgtagtgcggccttcacagtcgccttctgtagttacgtgataaagtgtcataaaacctccttcttgttggctgcttcaatcatagcgttaagagtctccataccgctttcaactgcttgagcaatctcttggaacacagacttcttaaagatgtataaagaccctgcctgtaagcgttgcacacaacataaaatcgcttggtgatccatcaggaagtcgccgtaggctgaatcaatcttacctgtaattgggttctctcgtgaacgaggatcgtattctaatgtgatatgcgttacaccaggtaaagtaacaaactgacaacggatgttgacacgtggtgcaattgacacgctaaacaggctgtttgacatttaaacctcctcgtagtaaggcaaagctttaatcaattgttctgaagtaccattctctatccacgtagccccgttgtcaagagaaacataccctttcttatcgataaatttacggagacagccagtgaacttgtttttgtagatcatttcttctttcctttctttaatttgttgtgacctttacccttataaagcttgtgattacgagcagacgggttattttggttctccagtcggctaacaggtgtattccaaaggtttcctgctacaaaagatgctgccacaagttcttccaggtatacaaaatccaaagcaggtatctttgtttccctcatctcgcgttctacattagacaacacgccttcttccttactatcttctttttcaattacagaccaaccctcttcctgccaagcttcccctctgaaccaagtttccatgttataaccttgttcgtcgagaataacaccatctcgcatctcaaaccattcgccaccacaaaaatggcggtgctcaacacgtctaccttccttcattgcttctttagcttcgagccaagtcagtttgatgttttggatgttttgcatttgttttctccttttgtttggtaggagttgatcttaacaagattaaaaagtatgtcaatacttgatctgaaattattttcaggtatcatgtatgaacattaacaagagaggtagatgatgaacattactttagcaactaagaatatttctgaaacaattaacggttttggtgttattgtagccttgcacggtaacaacgagaaatggttggcttcttttgaagaggatcgtcaacacaatatcattttagacgctcctataaaagttatgcatatccttggtgaaaacaaagtgctcacttcctcccgttcaaaggaacaaattacaaacgaattagtaaaactgcttgacaatgttcttaacatgttcgataatgcacctatcgacacaaaacgtgtcttaatgtgaaaggagaatataatggcttaccctgattacattgacgaacgtgctatgggtttcttccgtaacttcttggttggtcgttctcacggagacaacggttccagttataaaacaagctgggatagtcaatgtggcgctaaggctaccaaaactttgaaaatgccaggtcgtccgttgtgcgcgtattgtggtaatgaagccttagctcttcaacctggtattgaacatggtgattatactattaaaggctacacttgtgtctgcaaaggtgcaatggacgaggcggattgggtgaaagaaaaagcagagatggaggaacgtcataaacgagaagcttatgaaatggaaaaacgtatgcctgttccagatttgcaagttaagaaaaatattgttgcgaaaatgatggaaaaagtccagaaagcagagacggaagaagacctaaatcgtgcactggaaaacttacgtaattttaaagaagaaaaagagttgcgtgagattatgtggtaaggtatactatttccatcaattaagagaggagaaccaaatgtattattcacaagacgaagtagcaaacattaaactggcagtgggcgatcttattgtgtcacctaactactattgggataacacagatttggttgaagtagtaacccatgttggagttgaaggtattgtgctctacacactaggtggaggtgttgttggggaaatggaacgttatacgacaacgaagaaactggtaagctcttatcacatgtttttacaccaaggttcggaagagtatacagctttcttgttgaaattagatgcagatcgggagaaggcacgatgaaaattgtacacgatgaaattcaaatagaagaaagtgacctgatggatttggatgcagctttggggaaggtaatctatgcaggaattaaagccttccgtgagaaggcaaacaatagcacgtttgtcatgatccccactaaactgatgcgtgttttgtatccaaatagaagtgcgccgtatacagatgaagaagaggagacaggtagaagagagtggttaaatattttagaaaagatggagaatgcttttattgatagtggtaatccagaaatcgtgtatgctgaagatcaaaggaaggcacggttagagggccgtcttttattcgctagttattttgataatctttggagctaaatatgtctgaattcttcacaatggctttcttagggatctatctgattattagtgctgttggcttaatcatgtctctaatagaggaaatgggaattaagtggaattgtgcattcggtatagctcttatgctcactccagtttggatttacatttgcaaatcggttgaactaattggttagtggaggtaatatgtttagtaaagaaatgagagaggtaatcgctactctggtagttgatcatggtattgaagttgagcgtcacgtttggaaagatgagcctcctttctttgatttggcatcacgggctaaaagtcacatgtatctccttgaagatgataaggattttattctgcgtatgcgttatgatcgagagtttagaattcctcttgacacagatcctgatgatgtagtattgtggttggcagagcatttcgcatttaacgctctacatggaagaagttttggtaatgaacgttgggataccatttgtcgtaaacataatattgaaccagaatacgggagtatgtaatgttaagcatcaaacctaaaatgattactgaagatcaaaaagagtacatttataaatgtggtcgggtgtggaaagaatacactaaaggtaatgaagttattgtagttacggaacatgctatttctttatcagatctttttggtgattatttgcaagtcattaaaattggtattgacagaggtttggtgcaggtgttaacattatcccaagttgaagcagaacacttagacaaaatcattgtcgagttctaagaggagaaagaatatgatctctttagaatcaatagcttttaagaaagggtataccgcagggttcaagtttggtatgtttaataaagtaaatccatactgtccaatgacacacaaaaaggaattcgaagaatgggaagatggattttctaaaggctaccaggcaaagggttggttgtaaggagagaatatgattttaaacttcatcatcaacttgtgtttgacattgggactactctgtgcaatagtatcccctctggttggtgaatattgttctgaactggcgatgtttatagttcttggtgcggctattgctaatatgtttgtcgctgcgatttgtatgttgtgggaataggagggaagtttatgaaaaaattaatcttagccacattgctggctaccgtaagcttcaccacttacgctcaaaaatttgtagcagttaaaacggatattggtaaagatgttgtgatcacaggcaacaaattttactatacacctgggaatggtgttctagaagagtgccaagatgttgaggcatatacaggaaaagaagataacacggaacgtcctttttattcgattatagccacttgcaaaaatgaaatagtagctattaaacaatacaaagatgcccctggaggagaatacttattagtcaagaacattaagagtgaaaaaactgcaaagtttacagtaattattttaaaaggagaaacgttctaatgaaatacactatttttggagatgtagctgttgtaaataaggaatatggtgttgaagctaataaacttcctgctggagtttgggttgtcaactgtgatccgcacggtaactactctttagtgcgtggcgaaagtttctctcttccgaacactctttatggggaaactaaagaccgcgccgcacatgttattaaaacatttgctcgtcgtagtaaagaaggtaaaaatactggggtgttactgacaggcacaaaaggcagtggtaagacgatgttagctaaactaattagcatgtccctaatgtccacagaaggtttaggtattccaaccattttggttacacagccttacacagatgctggattcttagaatttatgagtaaaattacagatcgtgctgttgttttatttgacgaatttgataaagtgtacgctaagaaagaagatcaggaagcactgttgaccttgttggatggaacaggaagtgggaataaactttacatcctcactaaaaatagtggctatatctcggaatattttgtaaaccgtcctagccgtatttattacagtttcaattacgataaactgtctagtgaaactatgttagattacttggataagaatttggtaaataaaaagcacgtagataacttccaacgtttatgggatgttagcacagagttgtctttcgatgttattcaaggcattgtagaagaattgaatttctatccaaaaatgacttttaaagaatgtcttgaaatgatgggtatttctttaggcaacgatgctaaatggaatgtggcttctatcgtagctaatggcaaaacgctgaaggtgaattggatcaataactggcacgacttcacccctactaagtttttgtcgggtgcttgttccctaaacatctatctacaaagcttgaaagatgatgaagtggaagcaatggaaaccaacagttatgttatcctagatgaagatggtgatccacatattgatctatgtgcaacggcggatggtctaacttgtgatctgattgaaggtggtaagattcttgtgatgagcactacaccaggaaacactttgcgagtggtgctggagcctgtaacacaacgttccactacactgggtagcgtgttctgatacagcacaaatagctaaacccgcttcggcgggttttgttatattgatttcagacttatagggagagaggatagacaaagatggcgaagacgttagaacagtatataggagaatgtaaaccaatagcggaagctaaaggatatgagattatagggattgtagagccatttaaaggtgtgcacacgaagatgatcaacttctgccctaatcatggggagtggagaacatccacatttgccaattttaaacgtggtaagtctggttgccctgggtgcaaaaatgagaaggcaagacaagacaacagtaaaaacctagattattacctttcggaatgtaagcctattgctgaagctaagggaatcaagattttaggcattaatggagagtttataggtgtacatacaaagatgatcaacctttgtcctgagcacggggaatggcgaacattaacatttcataatcttaagggtggtagtggttgtcctaaatgcggtaacaaaagatctaggaattctaaaatactcccagacgatcagcacatacaagacttcattaatacaggaaagtttaaagagggtacaatcttcactaaaacagataaaaaacgaggccgcgattctttatggtgtgtagagtgtcctgcctgctctcacgatgagtatgtgcaagctggggtgtgtgatggtaagttttatgtcgcagggaatgaccttaaacaagggaagattccttgccgttgtgcaactaactgtcattacacagaagcacagattacctatagggtaaaaaaggcagtagaaaggaaagggtatatctgggtaggttggatcgggaaaccgtctgtaagattaggtaagtttaaatatggatgtaagaaacatggggtacaaataggacgtgccagtggtttgttaaatcatggtactggttgtccgcaatgtgctaaccagacacaacaacaatgttacattaaccacatccatgatgaacaaggtattctctgtgctttgaaatttggaattgccaataatagtgatcgccgtatcaaaaaacaaaatagtcataatgtgtttactatgaaacaggtccaagtgtggcacttccctactgtgaagcaatgcaaagatgcagagaagcgttgtaagcgtgtccttcacacggaagcagtgagcaaatatgctatgccagatggctacacagagacagtagagttatcttgcatggcctcaatacaaaacatttataaactttatggtggaacattacaggaggaaacatgttagttgacgttcaaattatgcgcaacgaaagaatggacttctttgaagcagtagagaaacatctgatcagatgggactatgaatttgttcctgctggatgtggaccagtagagcatttagcggaagacgacgatgtatacatgatcattcgtcaagtgtaccagacagaccagtgtgaagaaactcccgaactgattttgtttgagtgtaaagatcttgcaaaatattttgactatggcggaaaagagggtcataatctctccagatacaataaacgtctacttatcttagactacatgcggaacaacaaacacaaactcatcgacgcagacgcagtttatggctactggtggatggattaacaaaggagaaactatggcacgtttagcagataaccctgtattctaccccgttcttgatctttatgatgaattgacatatgttgtggagcggtataattacaatgaagacctcttggagacaaaccttaaagtagttctgatgaaagcctatcagcaagggcaacgtgaaattttggagagtatgaaaaatgcgaataactgatgattatgtattcttcttttcacataaagatgtttttagtaattggtatattgcaccctttacagaaaccgaaccaggttacaatcagacatttaattgtgtcgaacaatacatgatgtggcgtaaagctttgctctttaacgatcacaacaccgcacaagctattctgactcatagcttaaaacgagaagatgagaagatacaagcttattacaaacgtatgggtagggcagtagcaggtttcgataacaaaatatgggaagagaatcgtgagcgtattgttatgcgaggtttatgcttgaagtatgtacagaatccagacttgtatgccgatttacgtctatatcaatacaaaacatttgttgaagcaagtccttacgataaggtatacggaattggaatggggatgtatgaaccaggggtgctaaaccctgccacctggaaagggcagaatcttttaggcaaatatcataacaaactgatcgaaatacttttcccagacaaaataccgcaaagacgatatttgtgatattttaacttttttcatttttagaacaaaggtgtcactttgtagcacagaaataaggctcctacagcaccgtagagagcctgttattttgtcctatacaaacccttatctttttcagtttgcatcactaggattcgatctaagtgggttcctgaaggtttaccaataagattaaaggttatctcaaattcccactacctattatctcaaaaatccctcaaattatttaaactttttaagaatttacaaaagtgaaagttgaaaaccaaaatttaaagtttaggaaaattatcttaaaatgttagatacaaaacaaaactcaaaagtcaaggaaaattttaaaaattttgcgcgcccacagtatttaaagtttttttgcttttacaaaaatgaaagtacaaaagcaaaatttaaagtttacaaaaatttatgcagatgggaatgagaagagttctcatatggaaatgcaaatgataatgattcgcatttaggtttataaatgagattgattcttatttgataaggtaaatgataatcattctcatttagagaatgacgcgcaggggcggtgtttgtctcgcgctcccgtgtcccctcgccatgtaataagaataacagatccagccaggaaagcaagcgattattttatctttacatttctttacaaatatatagcgcccagcctaccggcgatcaaccttccaaccagcgccctggtatgttagccccgcctttacgccgtggggtggcgcttcctcttctgtatgtaaaacagtataagcccgatccctgggcttgtcaagattattttttgttttcttgccaggaaaggacacctaaccaaaaatgcatatcgccccgcgcccctggtgggatcttgctttccccgccgccactgcaagcccataaataaccatcagcaaacggatcaaaatggtctatctcttccaccttatgatcgcccaggttgagaacggtttcaacctttaagcccgttgcgcttgctacctggtgcaccgtgccgccttgccagcccaatgagtgcataaggtgtaatgtagtatttgtcatggtgtcgccctttctttgttgtgcgccctggttggcgcggtagaaagatgatagccctttcttttatatatagcaagcaaaaagaaaataaaaaagattgaaaaagtgattgacgttcgccaggtggcggcataatatttaccacgtagggcggcaatggtgccgctcattatttggagttaagatcatggcaacattgcacattgtggcgaaagctggacaaatcaacgtaatagtaaacggttttactgagttcagtcatccccaggatgatcatgaaacggttttatctttcattgattcactgttagaaatgggagtaattacagaagatcagcatactgcaaaatgcaagcgcgttaagcagattgtaggaatagaataaaagtcttgacaacaagccacaacctgataagatgtatcacatagggcggcggaatggtccagccgctcacaacagaagagagattataatcatggcatcatatagcgcaacaatgatcgtagctggcaccactggtaaacctatgagcggtggcggatctttcgcaaatatcaacattgacgggcgtttatccctggacgcagcgatcaccgtggcgcgggaaacatttaagaaagaatgtaaattcaataaacaagattatctcggtttcgctattgaaaaaaccgcgcgttttgttgattataaaagcccaaaaatggttgatactacactaaaagcgcaagatgtagcgtttttgctttaaggcttgacattaacgaataatttgttaatatgttacataaagcgggaatagttcccgctatttgtaaggtggtagaatgttttacatcaaattaaaaggtcacgtgatcgcgttcaaagataacgctttttacagattagcaaaatatgcgttaatacatccccactatgtttatataagggcgcgtgatgaaataaatatctttgatcaaacaacatgcgagaacatcgagatccgcaaggttggcgtacgtgattatcgtacatctttctacccttgcaaggattcagcaagtctttttaaagtatgccaattgttgaaaaaaggtggttaatatgggccgcgaatatgtgatccagtcttgggtaaaacatgaagcagatgatccgcgcatcattcccgatcatcttatcgatgaatccacgggatatagcggtgagcaaataggtaacagattagcacgtagtaacggcaacgtaaaagcgcgttatgtgcgccctggctggctggcaaatggtaacgctgatttatccagtgcggaagatgcgagcgacggcgcgaaagataatcctttgtacaaagttgatccggcttttcgtgtcctggatgaataccccagcaagatagcggcgcttgatgaagcattagaaagtaagcgcataacctggaccgcttacaacatggcaaaaaacgtacttgatggtaaattgattcaagccgaaagaaaattagccaaaattgcagccatagcccaggaggaagacgaggagacaacggaagaggaagagtacgaagagatcccgccgttgttgtgtattgatgcttttcctgattatcagccgacagaggaagaaaaaaggatcgcactagaaaactttgaaaatagtctttgacatatcgccgccactggtataatatttaccacgtagggcggcaatggtgccgctcatagtgaaattatgcaagaggtttacaatgattaataaagaaaatagcttgacggttggaacgattaacgctatcattttcgccgttccattttgggttgtagtagcggctattattttctaaaaatattcttgacaacgttttttaatctgataagatgtatcacatagggcggcggaatacttccccgccaaaacaaaaagggtaacacaatgagcaagcaaatcaatactatcatgtttaatctggtatctttccgcgatgatatgaaaaatttaccacgtgaaacggttgatattcatgtttcagcttatcgcgcccttattgatatgttaccgctaaaacgtgatcaacatgccgctaatatgatgcttaatgctatgcttaaaaagatgattcaaacggatcttactctggcgtatgagtatcaagggcgcttatatgctacttacaacaaggcggtacctggtctgggaagtaccgaagagttgcacggcttaaacttggatcagaacacttgggatagtatgcgccgcgttatggtatgggccgaaagcggtaaaatttacgaataaaaacggttgacactgtttaaaattccggtatagtttaccacatagggcgggaagtggtttcccgccaacaatgaaaaaggttatcatcatggctattaatattaatgtttcctcttatgctaccctggctaacacggctaaaattgaattatccagcattgaggcggtgcatattagcgcccgtcgctggtttcaacagtcctacggtaacacatatttttctttaatggttgacgttgagatcggcggtaaactgatcgaggtggttaacgttccgtttcaatatggctatggtgatcattttgataccgtcgccctggaagaatttagcaaggttatcaaccttgagggcaaggaattttcacgcggcgcgtatctttcccgtttttgccgtgacaatgggatcactgtatacagtcatgcaagcgatgttaaacgtaaaaaagatctataaaaagcattgacagcacgaataaaaagagtaaactgtattacatagagagcgggaacacttcccgcctcactgaaaaagagagaaaaatcatggctaaatctaaaatgtacaacggtcacaaaaacaaaactcattggaatgtaagcctgtggattaataacgatgagggattgtatcggtttgcattgggattgatcaatgagtgcggtaataaagatcaggcggctgatttaatgtgctaccgtttgaaacaggatggaatcactacaacgccagacggctttaagtatagtaaaactgcaatccgcgccgctatggttggaatgtaaaggagacataaaaatgaaacatcgttcgacctatctcacaaaacgttttagcttagatcataaattgggctattacggaagaaatagaaaataatttgacaacgtttaaaattagtgtaagatgtatcacatagggcgggaagtggtttcccgccaacaacagagagattaaagattatggctatcaatattgttcgtgtatccggcaccgttggcagttcccaggttgtagcagttgtaacaaacaaaaagattaatgatgtatgtgagatcttgaataagtgggctattgctaattttggagaatatgcgagcgtcgagtacatcgaatcctaccaggtgccaaccatcagcctaaccgatctcaacattgatcgcctgttatgcctggatgaattaatctgaaaaagattgttgacaccggaaagaaaaagagtaaactgtattacgtagggcggcaatggtgccgctcacaacagaagagagattatcacgatggctaatatccgcacactgttaaaaaatgcaagtcaagttttattttcagatgacgagtatttcaataaagacattacaggcgtgaaaaatttaaaagacgttaaggatgtaataggtattcgcggatctttacgtaagggcgattactacggtaacaaggtgcaatataaactgtcaaaagattatgattttactttgacaattatcaactaagggatcacaaaatgaaaacttgccaatgtggtaaaaagtctatctctggtttaaaacgtggcgttgctctttgtcaataccactataacgctcaaacgtggggtaagcagtgggcggatcaggtggaagaggcaaagaaagaaaatataaaagtagttgcaaagaaataaaaatagagtaaactgtattacatcaaggcggcggaatggtccaccgcctaacaaagagaagaggaaaatatcatgatcactttcgctacccgtgaagccgctcgcaacgttgcacgtaaagttaacgccgccaacttgggcgctacgcttaaagcccctgtaaaagatgaatcaggaaaatggatcttccctggtctgcgtcatgctgacaagttaggtactttaagccttaaaaaataatcgttgacttttcgttatagcgccttataatgggcgctatagagaagagaaaccactattaacaaggaaacatcatgattacttttgctattgtcgccgttgttgctggtcaggtttacgtaaacgagacatttactacagaagacaaggccgcaggagatataaccgccgtttacaatgagtgcaaggcagtagaaaggatgttatcgccttgtatgctaatgagtgaacgtcaggatgggataacagtatttactaacattgaaacagggtaccaaatggtagtaacaaaataaagcttgacacggatttaattttcagtaaactgttacacgtagggcgggaatagttcccgctaaaaagagagaaagaccatgaaagcacaaaatgcaattaaagagtacatccttgccgctatcgattttaatgattatggtattacaaccgaaaaagagaagatcgcggaattgatgcgccgttttaattccgagtactggtaccctgataaccaatcacgttttaattatagtattgttaaagcacttgcatcatggttacaaggtttgccatcagatattaatatcgctttcgaatattgggaaattgatcgcttgttaacatcctggggatacattaaagagaatagcagcgatgataaaatccaacgagaaagggaaaattattggctttatattgcaggcgtgatccttgcttgctcttatgaatgataaaccttgacaattttacaaaacagtttaaattaataatatagcggcaatggtgccgctcatataaagaggaaacaaaatgaatacatctaatcgcgcagaaaaaattcaatcttccaagatccgcaaggcctggaatgaggaagtgatccgcaaaggcgacaagcgcaataaaacaaagcgcgggaagagtgacaaatataattggatggatttagagaattaacataacaa

SEQ ID NO: 13 - DNA, 43963 bp, Unknown
  Podoviridae; Autographivirinae
tctgttcgtttcgttcactccgcttgcgctacgttcactcgctcacgggtaccttaggttattccttgatggatggcttaggttagccttagtggcctaccttagttataaccttagtgcatagcttagtatcagcttagtagtgtaccttagtaagtcttagtgtcttctcttagtgattgcacatgcaagcatgtaagatgccattaggtcgcggtcggtagaccgctaaagaaagagaatagtaataagatgcagtaggaggaacaccagaagcctagccaacctaagctatcctagccttgtatctattgcttttccttagtctcacatgttagacaacctatcttattcttagtgatgataacttagtgttgacaagataatcttagtgtaatactatgcatcacgtaggcggtgctgaagcacctagtagccagctagtaaggcatacgaagagactagcgcttacattgctctttaacaatttgcttagtgtaacctatgtatgccgtggtcaactacttattgaatgaggaattaactatgacattaaacaaccgtgaactgtccgttctcttcactctgttgtgctacatgattcgtaacaacgaattacttacagacgatgagttagccttgtatcaccgctttcttaacgaaggttggaccgatacagttaatcaataccgtaacatgatagatgagttgagggagggtaaataatgtatcagcatgaggttttctttgagtcagccagtgaagctatccgcttccatgatgatatgatgcaagctggcgtaggtgttgatgtatatcactatttgatagattacgacactgaatatcaccgagttaccttagtatctgagtatgacaaccaagtcattactgagtatctaggcagtgaagattacgattacgatgaagtaataacgacaaatctctaaattaactgttgacagccacggcatacaaggttacattaagcatcaagacggcgacgtctttaaacatcccgctctttaacaatacggtttgtgtcttgataggctaactaactaactaaggtaattatcatgaaagggttaatttgtgtagaacgtatggtcaatggtaaacttgaaatattaccactggaaaaccaatctagcttcaaagagtggtatggctgtttctcactgatttaaggtaaaggctggcactagtcagcctatcaaggcgcaaaccaagctctttaacaatttggatggtagcttcttagtctggataggttaaacctaggagattctcttgagtctcctataatgtaacctaactaactaaatgaggattaaatcatggaacgcaatgctaacgcttactacaaccttctggctgcaactgttgaagcattcaacgagcgtattcagtttgatgagattcgcgaaggtgatgattactctgatgcactacatgaggttgtagacagcaatgttccagtttattacagcgaaatctttacagtgatggctgctgatggtattgatgttgattttgaggatgctggtttgattcctgacacgaaggatgtaaccaagattctacaagctcgcatctatgaagctctttataatgatgtaccaaatgacagcgatgtagtttggtgtgaaggcgaagaagaggaagaataaggatggaaaagcaatataactttatcttttcagacggtgtaaccctgaagtgttccctacgattcgcacaaattcgtgaggaagtactaggcactacatacaaactatttagctgacactataagagaaggcttaacaaggcgttactaaggtagcgcctgattaaactttcacttactaggagttgagattatgaaaaccttgattggatgcttcttgttggcttctcttgctctggcatttaccgctaaagctggttatgatgcttataaagtagaacaagcccagcaagactgggccaaaaagttcaacttgtgcagcaagagcaacacctacgagtactgcaacaaaacactaagacacttatggaaagagtaactagcctatagcccacctgagtgggctatgtgatatttacttaccactatataaggcgattactatgactactgaaaacaccctcgtgtctgtccgtgaagctgcaaccgctgaaatcaagcaacatttagacaatatcggcacttcttacatcaaagtaggggcttgtctgaatgagttacgcggagactttgaaggtcaaaaagagtttttagcctatgttgaagcagagtttgccattaagaaggcacaatgttacaagctgatgagtgtagcccgtgtctttgaaggcgatgatcgctttaaaggcgtggcgatgcgtgtaatgctggcgcttgttcctttcgctgatgaaaatataatcatggagaaggccgcagaactcgccgcaaatggcaagctggacactaatgccgtaaacgccctgattgaacctaagaaagagtcaaaggccgaaacggtacaatctaaggctgagacagtaaaaccgcaggagaacgcgactgagtccgcagaatcacatgaaatgcaagcgccgcaggtagtgccacccgcgagcgagcaggagtccgacgaatcagcaccttgggaagaggaaagcaaaccggaagcgccaaaggcagctccgatggataacacggctaatactgagaatgccgctattgctggtctgctggcacaaattaaagcactgactgagcaattacaggcagccaatgaccgcatcgcctccttaagtagcgcacgcgaaagcaagaaggcatccgcacctatgctgccgcagttcaaatcttcctgcttctacgctcgcttaggcttgagcgcggaggaggcaacgaagaaaacagcagttaacaaggcacgccgcgaactggttaagctgggatacggtgaaggccatgaggcatggcccttaatctctgaggcagtagaagagttgactaagtaaccttatcggtggcatcttcttaggtgtcacctattaaggtttctttcactaggagtaaacaagatgcaagacctacacgctattcaacttcaacttgaagaagaaatgtttaacggcggtatccgtcgctttgaagcggaccaacaacgccagattgcatccggtaatgaatcagacacggcatggaatcgccgcttattgtccgagttaatcgcgccaatggctgaaggtattcaggcatacaaggaagagtatgaaggtaaaagaggccgtgcaccgcgtgcattagctttcattaactgcgtagaaaacgaagtggcagcatatatcacgatgaaaatcgttatggatatgctgaacacggatgtaaccttgcaggctatagccatgaatgtagctgaccgcattgaggaccaagtacgttttagcaagctggaaggtcacgccgccaaatactttgaaaaagttaagaagtcacttaaggcaagtaagactaaatcatatcgccatgcgcacaacgtagcggtagtggctgagaagtcagtagctgaccgtgacgctgatttctcccgctgggaggcatggcctaaagacacattactgcaaattgggatgaccttgcttgaaatcttagagaatagcgtgttcttcaacgggcaacctgtcttcctccgcaccttgcgcactaatggtggcaagcatggtgtttactacttacagaccagtgagcacgtaggggagtggattacagcatttaaagaacatgtagcgcaacttagtccagcatatgctccttgcgtcatccctccgcgtccgtgggtatcaccttttaacggcggtttccacactgagaaagtagcaagccgtattcgtctggtaaaaggaaaccgcgaacacgtccgcaagctgaccaaaaagcaaatgccagcggtttacaaggctgttaacgctttgcaggcgactaagtggcaggttaataaagaggttttacaggttgtggaggacgttatacgtctagacctcggctatggtgtaccttcctttaaaccactcatcgaccgtgagaacaagccagctaatccggtgccgttagagttccagcacctgcgaggccgtgaactgaaagaaatgcttacgccggaacaatggcaagcctttatcaactggaaaggtgaatgtactaagctgtacaccgctgaaactaagcgcggaagcaaatcggcggcaaccgttcgcatggttggtcaggcccgtaaatatagccagttcgacgcaatctacttcgtgtatgcactggacagccgcagccgcgtctacgcgcaatctagcacactctcaccgcaatcaaatgacttgggcaaggccttgctccgttttaccgaagggcagcgtcttgatagcgctgaggcgcttaagtggtttttggtgaacggggctaataactggggttgggataagaaaacttttgacgtgcgcaccgctaacgtgctggatagcgaatttcaagacatgtgccgcgacattgcagcggatccgctgaccttcactcaatgggtaaatgccgactccccttacggcttccttgcatggtgctttgaatatgcgcgttatctggatgcactggatgaaggcacgcaagaccaattcatgacgcacctcccagtccatcaagatggtagttgttctggtatccagcactacagtgctatgctacgcgatgcagtaggtgcgaaagcagtaaaccttaagccctctgactctcctcaagatatttatggtgccgttgcgcaggtagtaattcagaagaattatgcatacatgaatgcagaggatgcggaaaccttcacttctggcagcgtgactttaacaggtgcagaactgcgtagcatggctagtgcgtgggatatgataggaatcactcgcggcctgaccaaaaagcccgtaatgacactaccttatggcagcacacgtctaacctgccgtgaatcagtgattgattatatcgttgatttggaagaaaaagaggcccaacgggctattgcggaagggcgtaccgccaatcctgtacacccttttgataatgaccgtaaagacagcctgacacctagcgcagcttataactatatgacagctttaatctggccttctatttcggaagtggttaaagctcctatagtggcaatgaaaatgattcgtcagcttgcccgtttcgcagctaaaaggaatgaaggcttagagtacaccctgcctactggcttcatcttgcaacaaaagattatggctactgatatgctccgcgtatctacttgcttgatgggagaaatcaagatgagtctacagattgaaacggacgtagtggatgaaacggctatgatgggcgctgctgctcctaactttgtgcatggtcatgatgccagccaccttatcctaacagtctgcgaccttgttgataaagggattacatctatcgcagttattcatgactcttttggcactcatgcaggccgtacagccgaccttcgtgatagcttaagggcagaaatggtgaagatgtatcaaggccgtaatgcactgcaaagcctgctagatgagcacgaagaacgctggttagttgataccggaatacaagtaccagagcaaggggagtttgaccttaacgaaatcttagtttcagactattgcttcgcataatattaataggccattccttcgggagtggcctttcttttacctactacctgtaacatttcattaacataaagtgtctcacatgtgagacttatttaccggacactataggatagccgtcggagacgggaaagaaagggaagataaagggtataaaggaagtaataggtattaaaggttatataggttatataggaatacctattaccttcttccttcctcttattaccacttagaggaagggcagacctaggttgtctcacatgtgagacttcgtatttaccggacagtatagataagattaactcactttggagatttaaccatgcgtaactttgagaagatggcccgtaaagctaaccgttttgacatggaagaagggcagaagaaaggcaagaagctgaataaacctgtccgtgaccgtgcatctaaacgcgcagcgtgggagttctaagttatggctattattcagaatgtaccgtgtcctgcttgccaaaagaacggacatgatattactggcaatcatttaatgatctttgacgacggggcaggatactgtaaccgtggtcacttccatgataatggcagaccctactaccataagccggaaggtggcatcgagataacagagttacctattactggcaatatcaaatatacaccttctcaattcaaagaaatggagaaggaagggaagataagcgaccctaaattacgcgccatcgcacttggtggtatgcgtatgaaagaccgttgggaggtcatgaatgaacaagaaagggcagagcaagaagcagagtggaaacttgatgttgaatggttcctcacgcttaagcgtaagaaccttgtttccagacacattcgcggcgacatttgcgcattgtatgatgtacgtgttgggcacgatgaagagggtagagtctcacggcattactatccgcgcttcgaaaaaggtgagctagtaggcgctaagtgtcgcacattacctaaagattttaagtttggtcatttaggtaaactctttggtatgcaagatcttttcggtatgaatactttgtctcacgtgttagacaagggaagacgaaaggattgcttgctcattgtcggcggcgaactggatgcactagcagcgcagcagatgctccttgattctgccaagggtactaagtgggaaggccagccataccatgtatggtctgtcaacaaaggcgagtcttgccttgaagagatagtgcagaaccgtgagcatatcgcccaattcaagaagattatatggggttttgatggagatgaggtagggcagaagcagaatcagcaagcggctcgcctgtttcctggtaaatcctatatccttgaatacccctctggttgcaaagatgctaacaaggcattgatggctggcaaggctaaagaatttgtagatgcatggtttaatgccaagtcatctgatgaagtctttggtagccagattaaatctatcgcatctcaaagggataagctcaaggctgcacgtccagagcaaggactatcatggccttggcctaagctgaacaaggtaacgctaggtattcgtaagaaccagcttatcattgtaggtgcagggtctggtgtaggtaagactgagttccttcgtgaagtagttaagcacctcattgaagaacacggtgaatctgtgggcatcatttctacagaagacccgatggtcaaggtgtcccgtgcttttatcggcaagtggattgataagcgtattgagttacctccaaccaacgacccgaaagaagacggataccgtgaggtgttcgactataccgaggaagaagctaacgccgccattgattatgtagctgatacaggtaagctgtttgtagctgacctagagggtgactattcgatggaaaaggtagagcaaacttgcctagagtttgaggctatgggtatttctaatatcatcattgataacttaacggggattaaattagatgagcgtgcttttggtgggaaggttggtgcacttgatgaatgcgtcaagcggattggtactatcaaagaccgacacccggttactatattccttgtatcacaccttacacgtcctccggcaaaccgtacccaacacgaagaaggtggcgaagttatcctttctgacttccgaggctcaggcgctatcggattctgggcatcttacgccttggggattgagcgtaatacaagagctgaaacgcttgacgaaaggactaccacgtacatctcatgtgtcaaagaccgcgaccaaggtatctacactggaaccaaggtcatgcttaagggtgacattcaaaccggacgtttaatggaaccacaagcccgtactaagtcatttgatacaggtgaagcaaggcaacaagaagtaccagatttaccggacactatagaagagactaacttcgatgaagaaagtgagttctgattagtgtatttatcagggcttgtctcacatgtgagacaggctcttattaagtacattaaataactggagattgattatgtataacttagtgttgaatgtaggtgactttgtacgcaacatcaagaaagattcaagtcgctatctttgccgtggtgttgtaacctttgtaggtgagaacctgtattatgtagaatatcgcagtggtgttaagcaatattaccacaagaagacagcacataaatatcttgaaaagattgtagagataaacaatcaatgtaagtgcatacatgatgaggtttgcgataaatgtgctcgccagatgcttaagaatttcctagctcctctttattatggtgctggtcctcaaacactagcagagtacatggcagaaaagaaaaccacactcaagaaagagcgtcgcaatgtaatcactggtaagactcaaagtgagatgattaagcaatgtggcactgcattaggtgttacacagtttaatactcgtgcattgggtaaatccacaggacaagctatggtaaagattggagaagccatgatgcatccaaatgtacctgtgcgaatcatggatgttgaccatgcaatcacagaacaaggtacgcaacgacgtgtaattaataagcattttgccgacactatagaaggtattattcgtaagcaagggttgaaaggtcttcacatcttaaatggtgaagaattactgtacctacctatcgttactgaagaaacatacgtgaatatctaaggagttaatcatgactaaggtattaatttatatgcgtggacctcataaatgctatgcagttgtagcaccaaatggtgttaagccttatcgtacttcaaaaagattggcattaataggtgctagtagtagtgcaagtttccaaatggaactttttggtcattggacggaaaggcaattccgtgaggattttaaagtcattggcagcttcatggtgaaatatgcagaataaacatagtcttaaaatgttcgatggtcatgaagacctgcaagccaagattactaaccaagccttcctgttcgctcaggtaactatggctgaggccaagaagaatagtctcactcgtgaacaggttatcaaggaaagtgaagtgaaacgtaagattcgcagtcgataagtcaagggttgtctcacgtgtgagacagcctttcatcatattgattggaggtgcattatgccacgtgattatgattctgattgggactattatgactcaatgaatccaaaacccgaacgttcagatgattactacgaaacagaggcaatgtatgaagactattgattggaagaaggaggcagaaggtcgtatcctcgtgatggatgcggaagctaaaggactccttgacgccatccgatatggacaccgtgaagatgtgcatatcatttgctgcatggacttgcttactaccgaggagtttctcttctttgacccgtatgagatgcgtgaccctgaagcaagagaacgcctgaaggaatgggaaggtcatcaagatggaaccttggttgacggtgttagcttcctgaagcactgtgaggctattgtgtcgcagaacttcctagggtatgacggtcttctctttgagaaagcattccctgatatttggaaaggctttaactataccgagaagcgcggcaagggcagactccgtgctgacctgtgtccggtgcgagtcatggatacgctggtgatgagtcgcctgttaaaccccgatagacgccttcctccgcaagcatatgccaaaggtatgggtaacgtcgcccctcactcaattgaggcgcacggcatccgtataggccgctataaaccggagaacgaggactggtctaaactaactgaccacatggttcaccgtgtacgtgaggacgtggcgattggtcgtgacttgttcctctggctctttaacggggaatggatggagcacaaacgccgtggcgtgaataaacgcactggcctaggtattgagacagccttccacatggagtccattgtggcgctggagatgagccgtcaggccgagcgtggattccgtctggatatagataaagcattagcacgatgcgaggaattggacgctaagattgatgagacagtcgcagcgttccgtccgcacatgcctatgcgtatcaagtctaaaccttttaaaccggaagaaaagaatgaagtatgccaacgcgcaaatgagtatggagctagcaacaatatacctactgtccttgacccctcacactttcttcatgccgagagacgaggagatcgcaagacagtatggagtgtcactactaagtctggtgattggtcggctagtgtcaagaaagactttcctcaccttagaggaaaccgtaatgacacgccaagcatcaagtggattggcgcttactcgcctgttactttcgaagagattcccttgggtaacagggatacagttaagcaagtgctctatgattatggatggaaaggtgttgaatttaacgataccgagcaagcgcatctcgatgagcacggagtgttacccaaaccttggagtggtaagataaatgaaaagtcccttactttatggcaagaaagagccgcacgtgaaggtaaaacagtccctgattggtgcttgggtatcgctgcatggtacatactcgtatcccgtcgtggtcagatcctcaaccgtggtgacgttgaagccttcgaccagaagggggtgtggccttcgcaagctggtacacgaaagtgtcgcggccttgtacctgtagcatttaacaaggagttaggaatcaatgctcagcaatactacgaaaggtacggatgctggcctacgtcagacaaggatgacggagaatggcgtgtgccagctattgctattagtattggaacttctacgttccgtatgcgtcatcgtaacgtggttaatattcctgcccgtggtttgtatcctttacgtgatttattcatagccggtaaaggtaagctaatccttggttgtgatggtgctggtcttgaactacgtgtactgtctcacttcatgaatgaccctgaataccaagatattgtactgcatggtgacattcacacccataatcaaatgaaggctggtcttcctaagcgtgacatggcgaagacatttatatatgccttcctatatgggtctggtatagctaaccttgcagcagtatgtggtgttactgaggaagaaatggaggaagttgtggcaagatttgaggttgaactaccatctcttgcacgtcttcgtgagaatgttatcgcacaaggtaacaagtttggctacctacaagcacctgatggtcattggggtcgcatccgcatgtctggtggtgaacttaaagaacacactatgcttaacgtactactccagatgactggttctctgtgtatgaaatacgcattggtcagagcgtttgcagtgatgcgcaaggaaggtgtggccttagatagcatgggaaacccttgcggtatagctaacgtgcacgatgaaatccagatggaagtccctgaagatgaggtcttgtatctcaactacgacttgcctttcaccttagaagggttcgaaacagagaaggctgctgtgaaagcagtgttcgatgcagaggagaaacgtgttcatgtggattctgaaggacgtatgtggtctgctgcaaatctcgttagtattgatgctgatgctggtgtacttcattgccagcgtcgttatcaccgtgcagggcatatcattgccgacgcaatgacctgggcgggtcagtacctgaagatgcgttgtccgatggcaggtgagtataagattggtgcaagttggaaggaaacacactgatggacaggtttgatattgtttgcctattctctaccttctttcttatattccttatgcttgcttgctatggaagtatgcgattagatatacctgatgaagaggagggttacgattgatgcaggcatcttttattattcttggagtcatattatttatggtagtattctgggctttctctggcattgacccagattgtgatggtaactacgactgagttatactcaaggtcacttacgagtggcctttatgaataacttattcctacttattttgtctaacatgatttactggacactatagaaggaaagcataggtaatctaggttataaggtagtataggtaattaagtaaatataggagatataaatatgtctatggtaactactctggtattcgtggctcaatactttcgtggtcttgctaataagttcaagtccaaggctatcaaagctattgaggctcgcatcgaagcagtacaggcagagcaagttaaagttgaagaacatcgtagttctcaaatgattgactgtcataaccgctactatgcatctcgtgatgaactaaatgcacgtcaagtcaaagaggtagaagatatgctggcacgtcaccagcaagagcgtgacagcctgaaagctgaatttgaagagaacaaggcatcaattgcccttgtacatcaagctgcatctgacagtctgaagaaagagattgttatgctggaaatcgaactggataacctgaccaaataaggggttatgatggaagaagtaattcaagctaaacatgtaggtattatctttcgcgatctagagcagcgtaaagttgcaggtcatactcgtctggctaaagaggaagacaccgcaatcactactgtagaacaagcagatgcctatcgtggaccagagttcactcaaggtgaaacttgtcaccaattgagcctgtcaatttgtgacactatggctattgtaaatgtgcaagaagtcgaagagggtgagtgtgtcagttacatctaccctttagatactattgcacgcattaaggtaatccataagtaattactagacactatagaacaataggtcggcttagttcggcctatgattgtgtagtgtaacaataggagactaaataaatggcacgtggtgattttgattttggtgctcagattactaaatctgaaggtaaagtctttaagaatccagaagtaggtgatcatgaagcagtaatctctggcatcattcatgttggttccttccaagacatctttaagaaaggcaataccactgaagttaagaagccagcaaactttgttctggttaagattgtcctgatgggcgacgatgataagaacgaagatgattctcgcatggaacaatggatggctgtgcctctgaagtctggtgataaggcaacactgactaagttcctgaatgcagttgaccctaaagagttgctgggtggcttcgatgatttcattggtgaatgcctgactgcaacgatggttggttctggtgacaagaatgaagatggctcattcaagtatgttaactggaagggatttggtggtatgccggacaagctgaagaaactggtcattgctcaggttgaagaggaaggtctgtctatgacaggtcacattaccttcgacaagctgaccaaagaaatccttgatgacatcccagccaacttggtgcgtcaatacttcctgaacgagacgcctcgtggtaagaacctgtctgttgctggctctcatgtagaagcaataattaaagctgctcgtgaagaagacccagagtggaagaaggctaagaagaaagatgacgaggatgctactccagctaatcgtaaatctctggatactggagagtctgttccacaggaagtacctgaagcagaagatactcctgcaccggagatggatgaggacgcggaatattaaggagaaaggatgaaagtacaaatcgtaaccctgcactgcaagaaaggtatcacaacgctaggaggtggcactttccactctttctccgaaggggagatttatgctgacctgcactacatctggcgcgacggacagcacgtggtgaactacagcgacccagctacggggaaacgccacggcgtatcgcttccggcgcatgacattgctcaggtgaacacagttttataaagtctcacgtgtgagacaaatcggtgtccggtatttactggacactatagaagagaagaattttaatcggcgataatgccataaccaacaaaaggagaatttaatatgttcaagattgaaactatcgtaaaccgtgttgttaaaggtgctgctctggtatccgttgagtctttcattatcgtcgatgaaactgatcaactggtagctggtactaaggcttacgatacccgtgaagaagctcaggctaagattgacagcatgggtaacttcgctgctggtctggagttcgctcgtgcctgcttccctgagcaggctgacaaagcccagatcgggaaggctaacatcgtagctgaatatctggattgggttgctgctggtaaaccagtgaaagaagttaaggctgctgaagaagctgaagctacggcagtagaagtagctgcaccggaagctccggtaagcgaagaggaagaattttgataatagcaggtgttgcctctgttagtcctagctgactatcacgctcacctcatccaatgccctgtctgccttagtgtaggcagggtcttttgcgtaatagttattggagaatgaattatgccgactattgaatctcgaattgaactggacattagctacaatgcaatcaccagacagtatattggggttgcctatgattacaaaactggtgagaagctagtggaggtgagacaatgggatgactattggttaagacagaacctccatgatgcggtgtcctccttcctgaaggagtggcctacatgcgaccaaacttcgacttcggagctacagtatcggaagacaataacctgttgctgtggccaactgaaggtaatcgaatcgctttaatagatgctgatatgttaccttacatcgtagggtatacaatcagtaatatgacttatgtacgagccacaactcgtgttaagtcagggcaagtcccctcaatcaaagatacacctgagtgtaagcaagcgtgtgaccgtgtgaactccttgcttaactcttgggtgtatgcagcagaatgtgatgcagctaagttattcatgacgaaatcagaagctaacttccgtgtccgcctagcattcaccaaaccttataagggtcaacgtaagaccgagaagcctccgttcttctatgaattgcgagagcatctcttagaggttcatggtgcaatcttggcagatggggaagaggctgatgacctcatgagcatcgcacaatgggacagccaccgccgcttccagcaagatacaggtaacgagttccctatcggtagtccagagcataaagcattctctgatacttgcatcgtttccttggataaggatttgatgattgttcccggttggcatcttcagcctggacaagagaagaaatgggtagagcctatgggttggcttgagttacgccgtaaggctaatggtcaggttaaagaccttaaaggtgctggcctcatgtttcattatgcacagatgattatcggtgatgatattgataactatgctggcatacctggacgtggtgctaaatacgcctatgaccttctcaaagattgtaagacagagaaagagttgtacatggcagtgcttggtgcttacaaggctaagttcggacatggacaagttaagattaagaattaccgaggtggttatcgtatcggcaaggcttttgacctgatgctcgaatgtggtcgcctagctcacatggcaagattcaaaggtgatatatggcgagccgataagaacccaatcttgtggggagatgatgcggaatggttagcaaattaaaatcatcggaggtagcagcttataagagggaattgctagagaagcaaggatggaagtgccccctatgtggcggcagtctcaaggctgttacccctataaaccgtgtacttgaccatgaccatgagacaggattctgccgtgctgttgtatgccgaggctgcaatggtgcagaaggaaagattaagggtgttatctctggttatggtaaggctggtaacaaccgttacttccagcttcaatggttagagcgactatatgaatactggaagttacatagtacgcctcagacagataagttatatcacaaacaccaaacggaggcagagaagcgcgaggctaagaaccgtaaggcacgccttgcttatgcaagaaagaaggaggttaaagttgggtaagcttcgcagcttgtacaaagactccgaggtacttgatgcaatcgagcaagctaccgacgagaaaggtaatgttaattacaatgagatggcacgtgtattatcgtgtcaccctgtgggtaagaagattacccgccagttggctcgatactggcatggtcaattcaagaagaccaagaagaatggtgattattaccagacccttctgcaagaagataagcgtatcaaagaagagcgtaagctcaggactcctgaccgctacgaggatttggctattgtgccattgcctgactcgcctcatcgaagtgtactggtgatccctgacactcatgcaccttatgagcacccagataccctagagttccttgcagccgtggcagcacgttaccgtccagacacagtggtacacctaggagatgaggcagacaaacatgccctgtcgttccacgattcggacccaaatctggatagtgctggcatggagttagagaaggctcgtatcttcatgcacaaattgcacaagatgttccctgtgatgagactgtgtcactccaaccacggctctatgcacttccgtaaggcaagcgccaagggcatccctgtgcaatacctgcgcacctatcgtgaagtcttcttcccgcagggaggtggcgaccagtgggattggcaacatacgcacgtccttgagttgccgaatggtgaacaagtggcattcaagcatcaacctgctggctctgtcctagcagatgcagcgcatgagcgtatgaaccttgtgtgtggtcacttgcacggtaagatgtctgtggagtacgcacgtaatacacatgaacagtattgggctgtgcaaggtggctgcttaattgatgagtcatcccgtgcatttgcctatggtcgtgagtctaaatacaagccagcattaggttgtgtggtcattctggagggtgtgcctcacattgtcccgatgcaaaccaatagcgacaaccgttggattggcaagatttagttgacactatagaacaaagggctaggtaagactttatcggctggcgtatccaaatgatattgcactagcccttgattgtatagtgaatggaggattcaatatgtcacactatgaatgtaagaagtgtcataagcgttatgattactgtacttgtggtcaagagaaaacatcttttaaagttggagacaaggtatttcgtaatgaaaaagattcgattccttggaatcaatactgcaaagaagctggtattgaccctgatagccctgtaaccatagatgatattgatggcattaacttgtgctttcgtgaggtgaggggtacaggttgggattccaaaaaattcaaacttgcatctgataagttagacaacaatatggtaactaatcctaagcactacgagttctttgatggcgtagaggcaatcactatcattgcccgcagtatgaccgagaagcaattcgctggctattgcatgggtaatgctttgaagtaccgtctacgtgcaggtaagaagttcaacactgaagaagacctgaagaaagcagattactacaaagagttattccagaagcatcgtcacgaatgtattgatgaggatatttgatatgaatatctttgagttcctaggtcttccagaagaccaccgcaatcacccattcatgctggtgaagcatcgcggtgaagttcctgagaagaaattaacttttccatgttatgcacaggtgaaacgagatggtatcttttctgctgttgttgttcgcactgatggtgtcgttggcatttttggtcgcactggtaagaaattggcaaacactgaaggactcgaacaagcctttgctacctttccggttggcatttatcttggtgagcttcagtctatggccattgatatctaccttgaggcaatctctggggttgtgaaccccaatcgcactgagccacttgatttcataggccagcagattaaagacaaactgtatatcgacttcttcgatatgttaactattaaggcattccatgatggattcactgatgtttcttatctcaaacgttacgatgctttacatcgtcgtatcggcgctcatcttagcgggtacaacgctatccttcctattactccttgccataatgagcaagatgttgaagcgtttgcgcaagagcaaatagatgcaggccgagagggtgctgtattcaaactggactgcgattatgaagcaggccacaaaggttatcgtcagactaaagaagtccgtaaggtaacttatgaccttacttgtattggctttgaagaaggtaaaggtaagtacaaaggtaaggtagctaacctcattttcaagtggaaaggaggcaagacaatcaaagcgatgttaggtaaagggtggactcatgcagatgcagaacagatgttccacgacattaaacatggtggacgattgaatgtcattggtaaaatctttgaagtcaaaggtcttcaggattcaagcaagggcaacattcgtctgcccaaagcgggagaattaagacatgacaaagatgaaccagatttcttttgatagcatgaaggcaactcgtgcagttgaggtagcagaagctatctttgaaactttatcctgtggcatggaagtgccatatactttacttgctgatgcagaagaacttggtctttctgtagaagctatccaagagaaggttgacgaattatatggtacagacgaagaagaaaccgacgatttcatttgaaggaatggagatgcttgagatgattctcaagccttcttctccgaaggtgactaagactcatgaagagttaatcgttgatgaagtgaagcgttacatcatggattgtgtcagagcacaactggtggtccaatgatacgtccagcttccttcctagatattcctgagattataaaccttgggaataaatatgtggaagaggaagtcaaggtagtggcccatcactcagcctcatgggatgcagaacaaagcgcacattacctttgcgcatctcttagtagagaagatttattcctatgggttgctgtagatgaagggcggattgtagggttcctgtgggctggctatcacgagttggccccttggacacctgtaagggttgcctctgacattctcttttatattataccagagaagcgaggaaccctacttggtatgcgtctcatcaaagccctaaagcaatgggctagtgataatgaatgctctgaggttcgcctgtctatcgcctctggtattaatgaagaacgtgtcggacgtatgtataagcgacttggctttgaaccgtttggcactgtgtacaacctgaagttctaaggagataacatgggtgttgtaaagaaagcatttaaggctatcggtcttgctcaagatgcaccacgtattgaagccaaagtcccagcacagcagcttgagcgtaagcctgagactgaagctgaagatattcaaattggtgcaggcggtgatgatgcgactgcatctgcaaaaggtaagcgcggccttgtccgtccggtagcttctagcttgaaggtgtaatatgaaacagagcacagatttggagtatggaggtaagcggtctaagatacctaagctatgggagaagttctccactaaacgtagctctttccttgatagggcgaagcattactccaaactaaccttgccctatctgatgaatgacaaaggtgataacgagacttcgcagaatggatggcaaggtgtaggtgctcaggcaactaatcatctagccaacaagctagcgcaagtactattccctgcacagcgttccttcttccgtgtagacttaactgcacaaggtgagaaggttcttaatcagcgtggcctgaagaagacagagctagctaccatcttcgctcaagtggaaacacgggcaatgaaagagttagagcaacgtcaattccggcctgctgtagtggaagcattcaagcatcttattgttgctggtagctgtatgctatacaagccgagcaaaggtgcaatcagtgctatcccaatgcatcactacgtagttaaccgtgataccaatggcgacctgttagacattatcttgctacaagagaaagccttacgtacctttgacccagctacacgtgctgtagtagaggttggcctgaaaggtaagaagtgcaaggaagatgacagcgttaagctgtacacacatgctaagtatcttggtgatggattttgggaactcaagcaatctgctgatgatattcctgtaggtaaggttagtaagatcaaatcagaaaagctacctttcatcccattaacttggaagagaagctatggtgaggattggggtcgccctcttgcagaggattactccggtgacttattcgttatccaattcttatctgaagcagttgcccgtggtgctgcactgatggcagatattaagtacctgattcgtccgggtgctcaaactgatgttgaccactttgttaactctggcactggtgaggttgtcactggtgtagaagaagacatccatattgtacagttaggtaagtacgcagacctcacacctattagcgcggttctagaggtatacactcgccgtatcggtgttgtcttcatgatggagacaatgacacgccgtgacgccgaacgtgttactgctgtagaaatccagcgagatgcgttagagattgagcagaacatgggtggtgtatactccctctttgctactactatgcaatcgccagtagcgatgtggggtctgctggaggcaggggagtccttcactagtgacttagtggaccctgtgattatcacaggtattgaagctttaggacgcatggctgagttggataaactggctaactttgctcagtatatgtcactgccattacaatggcctgagcctgtcctagctgctgtgaaatggcctgactatatggattgggtgcgtggtcaaatctctgctgaactgccgttccttaaatcggctgaagagatggcacaagaacaggaagcacagatgcaagcacagcaagcacagatgcttgaagaaggtgtggctaaggccgtgcctggtgtaattcaacaagaacttaaggaggcgtaatgtctttctcatttactgaaccgtcaaccactcaccctactgctgaagagggtccggtagaaaccaaggaggtaacaactgatgctgctactactgatgctcctgctgacgctggcacttctgtacaagatgacaatgctggtgcacaacctactgaagacaccggaggagaagcttctggacagccttcagaaaaaggagacaatggcggagagaatggtgaacctaagccagatgataccgcgaccgacactgaggaagtgcaatacttcttcggagaacacgaagtaacagtagacatcccacaggatgtaactgacagccttaaagagaaaggcattgatgccaagcaggttgccaaggaactctattccaaaggtggcaagtttgaactgtcagatgcaaccaagcagaaattgtatgatgcttttggcaagtttgcggtagatgcttacctatcaggtctaaaggctcaaaatgaagccttcttcctgaaagaagccaacgcagctaaagagttggaagcagctaacacccaacgcttctctgatgtttctaaggaaattggtggcgaagaaggttggtcccgtcttgaggagtgggcgcttgaaactctatccgatgacgaactcacggcattcaatgcggtgatggagtctggcaaccagtacctccagcagtacgctgtgcgtgaactggagagccgccgtaagcaggcacagggggatgataagccatccctgattgagccatcagcacctgctaaggctaatgaagagaatggcccactgacgcgagatcagtacgttcaagcaatcgcaactcttagccagaagtacggcaatgaccgtaaagctatggcagaagctcaggctaaactggacgcccgtcgccgtgctggcatggctcgcggtatctaattcagtatttactggacactatagaagggagaaaagttctccctagttatcaatttgatttataaggagattataatacatgtctacaccgaatactctgactaacgttgctgtatctgcgtccggtgaggttgacagccttctcattgagaagtttaatggtaaggtcaatgagcagtacctgaaaggtgagaacattctgtcctactttgatgtacaaactgttactggcactaacacagtgagcaacaaatatttgggcgaaactgagttgcaggtgctagcaccgggtcagtctcctaatgccacccctactcaggcggataaaaaccagttggtaattgataccactgtcattgctcgtaacactgtggctcacatccacgatgtacaaggtgacatcgatagtctgaaaccaaaactggctatgaaccaagccaagcaactgaaacgtctggaagaccagatggcaattcagcagatgctgttaggcggtattgctaacaccaaggccaaacgtaacaagccgcgtgttaaagggcatggcttctctatcaacgttaacgtaactgagagtgaagcactggctaaccctcagtatgttatggctgcggtagagtatgctctggagcaacagcttgagcaggaagtggacatctctgatgtagctatcatgatgacgtggaagttcttcaatgctctgcgtgatgcagaccgaattgtagataagacttacactatcagccagtctggtgcaaccattaatggcttcgttctctcttcttataactgccctgtgattccgtctaaccgattccctaccttcgctcagaatcaggctcaccacctgttgtctaatgaagataacggctatcgttatgaccctatcgcagagatgaatggtgcagttgctgttctgttcactgccgacgcactgctggtgggtcgtaccattgaagtgactggtgacatcttctatgagaagaaagagaagacttattacattgacaccttcatggctgagggtgcaatccctgaccgttgggaagcagtgtctgtagttaccactaaacgtaatgcaacttctggtggtgctgctgaaggttctggtgatgatcacgcaaccgtactggctcgtgcacagcgtaaggctgtatatgtcaaaaccgaaggtgctgcggctgcattctctgctgccccagcaggtatccaagcggaagaccttgtagcggcggtacgtgctgtaatggcaaatgacattaagccgactgcaatgaaacctactgagtaacacctatgccctatctaccttgcgtaggtagggttctttttgttaggaggattcatgcctgtaattagacaaaccagtaaattaggacatatgatggaagatgtggccttccagattattgatagtaagctggaagcggtaaacttgtgtatgcgagctattggtcgtgagggtgtggattccctcgactcaggggacttggacgcagaagatgcaagcaaaatgatcgacatcgtatcccagcggttccagtacaacaaaggaggtggctggtggttcaatcgtgaaccaaactggcaacttgcaccagacactaacggtgaagttaatttacctaacaactgcctagcagtattgcagtgttatgctttaggtgaaaagaaagtacctatgactatgcgagcaggtaagctctactctacttggagtcacacctttgatatgcgtaagcatgttaatgctaatggtatgattcgtcttaccttactcaccttactaccctacgagcatctacctacaagtgtaatgcaggctattgcctatcaagctgctgtagagtttattgtgtctaaggatgcagatcagactaagctagccactgcgcagcagatagccactcagcttcttatggatgtacaatctgagcaaatgtcacagaagcgattaaacatgctggtacataaccctactcagcgtcagtttggtatcatggctggtggctctcagaatgtacctgcttactctcattcaccttatgagaattgggcgctccgtccgtgggaggatcgttaatggaagtacaaggttcattaggtagacaaatccaagggattagccagcagccgccagcggtacgcttggatggtcagtgcacagctatggttaatatgatacctgatgtagtgaatggtactcaatcacgcatgggtacaactcatattgcaaagatacttgatgcggggactgatgacatggctactcatcattatcgcagaggtgatggtgatgaagagtatttcttcacgttgaagaaaggacaagttcctgagatatttgataagtatgggcgcaaatgtaatgtgacttcacaagatgcacctatgacctacctctctgaggttgttaatccaagggaagatgtgcaattcatgacgatagctgatgttactttcatgcttaatcgtaggaaagtagttaaagctagtagcaggaagtcacctaaagttggaaacaaagccattgtgttttgtgcgtatggtcaatatggtacatcttattccattgtaattaatggggccaacgctgctagttttaaaacaccggatggtggaagtgcagaccatgttgaacaaattcgaactgaacgtatcacttctgaattgtactctaagttgcagcaatggagcggtgtgagtgactatgaaatacaaagagacggtactagtatatttatcgagagacgggatggtgctagctttacaataacaaccaccgatggtgcaaaaggtaaggacttagtggctatcaagaataaagttagctctactgacctactcccttctcgtgcgcctgctggttataaagtacaagtgtggcctactggcagcaaacctgagtctcgttactggctgcaagctgagcctaaagagggaaaccttgtgtcttggaaagaaacaatagctgctgatgtattacttgggtttgataaaggcacaatgccttacattattgaacgtacagatatcatcaacggcatagctcaattcaagataagacaaggtgattgggaagatcgtaaagtaggggatgacttgactaaccctatgccctcttttattgatgaggaagtaccccagacaataggtggaatgttcatggtgcagaaccgcctatgctttacagcaggtgaagcggttattgcttctcgtacatcatacttcttcgatttctttcgttatacggttatctctgtattggcaactgacccctttgatattttctcagatgctagtgaagtctaccagctaaaacatgcagtgaccttagatggcgctaccgtgttgttctctgataaatcacaattcatactgccaggcgataagcctttagagaagtcaaatgcactgcttaagcctgttacaacatttgaagtgaacaataaagtgaagccagtagtaactggtgaatcggtaatgtttgccactaatgatggttcttactctggtgtacgagagttctatacagactcttatagtgacactaagaaggcacaagcaatcacaagtcatgtgaataaactcatcgaaggtaacattaccaacatggcagcaagcaccaatgtcaacaggttacttgtcactaccgataagtatcgtaacataatctactgctacgattggttatggcaaggaacagaccgtgtacaatcagcatggcatgtatggaagtggcctataggtacaaaggtgcgaggtatgttttattctggtgaattactttacctgctccttgagcgaggagatggcgtgtatctggagaagatggacatgggtgatgcactaacctacggtttgaatgaccgcatcagaatggataggcaagcagagttagtcttcaagcatttcaaagcagaagatgaatgggtatctgagccgctcccttgggttcctactaacccagaacttttagattgcatcttaatcgagggttgggattcgtatattggcggctttttcttattcaagtacaaccctagtgacaatactttgtctacaacctttgatatgtatgatgacagccatgtaaaagcgaaggttattgttggtcagatttaccctcaagagtttgaacctacgcctgtggttatcagagacaatcaagaccgtgtatcctacattgatgtaccagttgtaggattggttcaccttaatcttgacatgtaccccgatttctccgtagaagttaagaatgtgaagagtggtaaagtacgtagagtattagcgtcaaaccgtataggtggtgctctcaataatacagtaggctatgttgaaccgagagaaggtgtcttcagatttccactgagagctaagagcacggatgttgtttatcgtattattgtagagtcacctcacacattccagcttcgcgatattgagtgggaagggagctacaatccaaccaaaaggagggtctaatggctataggttcagccgttatggctggtatgtcttctattggtagcatgtttgcaggcagtggtgcagcagccgctgctggaggtgctgccgcaggtggcggaggtttgctaggttcactaggtggattcctaagtggctctactgctggtttctctaatgctggccttcttggtgctggccttcaagggttaggcttgattggtgatctatttggtggaagtgatgaagccaaggcgatgaagaaagcacaagaagagcaatggcggcagcagcttattgctacacaagaggcgtacaagacagtggcagacgcagaacgttctgctgctaaacaatatcatgcagatgcaatcagtaatcaggtttcactgctacagcagcgagcacaggttgcattacttgctggggctactggtactggtggtaattctgtgtcctctatgcttaatgacttagcagcagatggcggcaggaaccagagtactatcattgataactatgagaatcagaagattaatttcaccaaccagcttaagtctatccaacgtggtggtcagatgcagatgcgtgagtttaagaagccttctgctatgaataccttggttaaaggtattccaagtctggcatctgcctatgtaactggtagtaagtctggcaaggcattgggtaaagccttaactgattctcgcacatattcatctggaacaagaggtatttaatggcaattgagcgacaagcagtacaaggtctgccacaagtgcaggccacttctcctaatgtcatgacctttgcacctcaacaagtgggaggtgtggaggctggcgtggcttctacctccggtagtaggtttatcgaagaccttattcgtgcagcaagcagcgtggctgatgttaccactggtatccttaatcagaagattgaggaagataaggttgttcaaatggaacgggcatataacggattaatgccttctgaggatgcaactcgtggtggcgctcgtgctaacatgcttgtcaaagctcaactgctagctaatgatgaagcagcacgaatgaaagacatggctactcgtttccaaggaacggatgacgaatggacacaacttatggttgactctcgtaatgagatgcagaataagctgttccagcaataccccgagttgcaaggtgacaaagatactatgcgtatggtcactaatgtcttccaagaacagcagcctcagatttgggctacacgaacccagcataaacttgaccgtgaacaagcagaccgtgaggatacctttgacgggcgagtggcttctacttgggattctaatattgaccctgaagcctctggctatgctttacaggaacgaatccgcgaaggtcttactcaaggattactacctgaacagatgtacaagaagttagtccagcgagcaatttcacttgcacaaggcggtgatgttagcatggctgaagccctgaagtatgtgaaggacgataagggtgtttctgtttatgctaagaatccacagcttatcacagccatcactagtggtaatgcagtttgggctaggaataatgtagctgatgtaactcgtatgtctttcgaagttaaagaatcctaccttgcaggtgatttaactgatgaagaattgttggaacgagcacagcacattaataatctgacaggtaactctgtcttctctaatccagaactagaggcactgatgcgccaacgggctaagcagaatgcagagctaggtgcaatgcaggatatgcgacgtgagctttactccgaccgcctgactggcttccaaggtaagactgataaagagaagaaggcttacattgatgttatcaaacaggatagccaactttatgcagaccagcaaatcaaacaacgtggcttggacccttacagtcaagaggctgaagctattcgtggtgcagtggaagtgcagcgcctgcaattcatgaactccaaaggcttagtggatgatacctttgagtctcgtatcaaagccatggaatctatgctatcgcctgagcactttgccaagggcgaaccacaggagttgatgactattcgccagttgtgggaacagttaccagaagagagccgaggtgtctttggtgacacggtgaatggctacatggataactacaacactgcactacaaatgggagagacacctttgcaggctgcaaggtttgcgcgtaaagcacagcagaaattctctcgtactgagaaggaaaccaagaagttcaactcagctattggagatgcactggatgaggtatctggtgctggctggtttgatggtaaaaccgaagtgtcagacttaggtaaagctattgcggaagaagagttacgagctaaggccaatatgttgtggtctagtggtatgcgtaacatggattccatcaagaaggctttaattacttggggcaataaacgctacactcaatcagaggatgcaaagacttccggtggctatttcattaaaggtgattacacttctgcatctgatatgcttatgtcagttgggaaaggcgtaaaccctaccgatgtacctctggcgcttggtaggtatgtagaaacacagatgccagaattgaagaaggagcttcaagagggggaaactaaagatgatatatacattgattacaatgaacagaaaggtactttcgtgattcgtgctggtgcagcaggtcgccctctttctggagtaatccctgtaacctctttagataccacttcactgctagattctgcctatcagaagaaagtagaggaacgagatagaggcgagtatgttcacccgtatcgtacagatattggtgcacaagagcctatgccagctaaaccaactgccaaagatattggtaaatttggactagctaacttcctcatgtcttctgcttttgcttctggtgagaatctgccttctaacttcgagattaactatcgaggtaatatgcaacaattctatgacaagctagctatggatgagaataaagataaagttggctttaataaggcaactggaacctttactccatataaagacgctcgcggtgagtctatcggttacggtcatttcttaacggaagaagagaagcgaaacgggtatattaagattggtgatgaactagttccctatcgagggtctatgtctcagcttacagagagcaaggctcgcgctcttatggagcaagatgctaagaagcatgtgcctcctactcgtgactggaagattccgtttgaccagatgcatcctgcacagcaacgtggcttgatggatttaacctacaatttaggtaaaggtggaatccagaactcaccgcgtgctcttgctgcattcaaagctggtaagcttacggaaggctttatcgaaatgctgggcactgcatcaagtgaaggtaagcgtattcctggcctactgaagcgacgcgctgaggcatacaatatggcatctgctggtggtgtgcctaagattaccgaagtggagactcgtgaagatggctccatgtgggttaggtttggtggacctatgccagcaggttctgtctcggcatggactcataaacgtattggcgcggatggttggtatcaggtttatgaggctgcacctaccaagttagctaaaggttctaaggtaggtaaagttaagttgtagtacctaactcaaggcttgtctcacatgtgagacaggtctttatgataggcactatggaggaattatggaacaagacattaagactaattgggctggatatgtccagtctactcctgagccgttttctattgaggcggctccggtatcggctcctacgatacgccagcgtaatgagttacaagagcaagttcttgaagctaaagctgacgctgatattttaggtgctgtaggtgctgccttccagaatgagtggttggcattcggaggcaagcggtggtatgaccgtgccactgctgatttcacacctcaaccagactttgagatacaacctgagcaacgtgaagcactacgtttcaaatatggtacggatatgatgcagacaatcactgagggtgttcgttctgaggatgaattgaacttccgtattcagaatgctgatgaagaccttgagcgcaataagcgcattgctcaggctggctgggttggctctgtggcgacgattggcgctgctgtgcttgaccctgtgggatgggttgtctctattccaaccggtggtgccgctaaagttggactcgtaggccgtgctgtgtgtggcgctatcgccgctggcgtgagtaatgccgctattgaatccgtattggtccaaggtgacatgactcgtgatttagatgacattatggtagcactaggttccggtatggctatgggtggcattattggcgctgtagcgcgtggtagggccactaagctcagtgagcaaggggatgacagggctgcgagcattgtgcgcagtgcagacgcaggggaccgctatgtgcgtgctgttgctgatgatagtatcggtgcgatgcgtgttaagggtgaagaggtactcactgagggtgcatttgatatctctagcaaaggtgaagatttgctgaaaaccctacagcgggaaggtaatgcaattgatatgacccctcgccgctgggccggaactctgtctgcccttggtactgtcgtacattcctctcaggatgcaagtgtacgcggccttggtgctcgcctgtttgagtccccccaaggcttaggtatgcagaaggcatctgctagtctcatgcagaatactaacttgaaccgtctgaaatctgctgatatgaatcgtttcaacgatgggttcgatttatggctcaaagagaataatatcaacccggttgcaggtcatactaactctcactatgtgcagcaatataatgagaaggtatgggaagctgtacgcatcggtatggatgagtctacgcctaagtctatccgtatggcagcagaggggcagcaagctatgtatcgtgaagcattagcattacgtcaacgctctggtgaagcgggatttgaaaaggtaaaagccgacaacaaatatatgcctgatatctttgatagtatgaaagccagacgtcaattcgatatgcacgataaagaagacatcatcgaacttttctctcgtgcctaccagaatggcgctcgtaagatcccaaaggaagcagcagatgagattgcacgagcacaggtaaatcgcgttgctgatgctaccttaactggaaagcttagttttgaaaaggcaatgtcaggtcagactaaggcagagtatgaagctatcatgcgtaaggcaggcttcagtgatgaagaaattgaaaagatgatagaagctctggataacaaagaaaccagagataacatctctaaccgagctaaaatgagtttaggattagatgttactcaagaatacaatggcattcgtatgcgtgacttcatgaataccaacgtggaagagctaacagataactatatgaaggaagcagcaggtggcgctgcattggctcgccaaggcttctctacctatcaggctgcacttaatgcaattgaccttgtagagcgaaatgcacgaaacgcggctaaggatagcaaggctagtttggcattagatgaagagattcgtcagatgcgagaaggtcttcgcctgattatgggcaagtcgattgatgcagacccacaggctatatctactaagatgatgcgtcgtggtcgtgatatcacaggtgtgcttcgcttaggtcaaatgggcttcgcacagctaggtgaacttgccaactttatgggtgaatttggtattgctgcaactactatggctttaggtaagcaattccgcttcacctctaaggcgttgcgtaatggcgatggcttcttccgagataagaacttagctgaggttgagagaatggtggggtacattggtgaggataactggctaacaactaagggtgcacgtcctgatgaatttggtgatgtaaccacagtaagagggatgatggctcactttgaccaatccatgaactcaatacgtcgtgctcaaaccaacctatcactcttccgcatggcacagggttctctggagcgaatgactaataggcaaatagctttgtctttcattgaccaccttgaaggcaagaagattattcctcagaagaaactggaggaacttggtcttactcaggagttcatgactaacctacagaagcactatgatgctaactctaaaggttctggcttgcttggctttgatacaatgccttatgccatgggtgaaactttagctaatgctattcgtcgtaagtcaggtctaattatccaacgtaacttcattggtgatgaaggtatctggatgaacaaagcactaggtaagacatttgcacagcttaagtcattctctcttgtatctggtgagaagcaatttggtcgagggattcgccacgataaaattggtcttgctaagaagacagcttacgggtttgctttgggttcaatagtgtatgcggcaaaagcctatgtgaactctattgggcgagaagaccaagatgaatatttggaagagaagttatcgcctaaagggttggcctttggtgcaatgggtatgatgagtacaactgctgtatttagtctaggtggagatttcttaggtggcctaggtgttctaccttccgaactcattcaatcacgctatgaagcaggtttccaaagtaagggtctgattgaccaaatacctctggttggcgttggtgcagatgcagtaaatctggctaactcaatcaagaagtatgcagaaggtgacacagaaggtgtagatatcgctaagcgagcactccgtcttgtgccacttaccaatataataggtgtccaaaacgcattgcgttatggcttagatgaactggaggattgatgagttatactttcacagaacatacagccaatggcacgcaagtcacctatccctttagctttgctggtagggataaaggttatcttcgtgcctcagatgtgatagtggagtctcttcaaggtaacacttggattgaagttacatctggatggcaactaactggcacgcaccagattacttttgatgtagcaccagttgcaggtttgaagttccgtattcgaagggaagtacaaaaggaatatccatacgctgagtttgaccgtggtgttaccttggatatgaagtctttaaatggttctttcattcatatactggagattacacaggagttacttgacgggttttatccagaaggatacttcattaaacagaatgtaagctggggcggcaataagattactgatttggctgatggcacaaatccgggagatgcagtaaataaagggcagcttgatgccattgacaagaagcatacagattggaacgccaaacaggacattgagattgctggccttaaggctggtatgacttctggtattgcgcacagaactgttccttggtacacgatagcccaaggtggtgagatttccgtaaacccaccttatgaatttcaagatgcactagttttccttaatggggtattgcagcaccaaattgtaggcgcatactctataagcaacaacactatcactttcgcagagccgcttgtggcgggtacagaggtgtatgtgctgattggtagtcgtgtggctacatctgaacctaatattcagttggagttgaactttgacttagtagaaggccaacaagtagtacagattggctctgcatttaagtacattgaggtctaccttgatggattattacaacctaaacttgcttatcaggtagacggtgacattgttactttctcagaaagagtaccagaatgccggatgactgctaagattatcacagcataaggaggtgggatgattaactccgaactggtagatagtggtgtgaagcttgcgccacctgcactcgtatcaggtgggtacttcctcggtatcagttgggataattgggtgttaatagcaacattcatttataccgtgttgcaaattggggactggttttataataagttcaagatttggagggagaagcgtgagcgtacacaataaacatgcagctacagaggacgaggttggcattctgcatggtgctattaccaaaatcttcaataagaaagcacaggcaatactggacactatagaagaagaccctgatgcagcattacatttagtgtctggtaaggatattggtgcgatgtgtaagtgggttcttgataacggcattaccgccacacctgctgcacagcaggaagagtccaagttatctaagcgcctcaaggctatccgagaggcatccagtggtaagataattcaattcactaaggaggattgatggctaaggcaagagaatcacaagcggaggctcttgccagatgggagatgctacaggagttacagcagacctttccttacacagcggaaggtttgcttctctttgcagatacagttattcataacttaattgcaggcaaccctcatctgattcgtatgcaggcggatatcttgaagttcctattctacggacacaagtaccgcctcatcgaagcgcctcgtggtatcgctaagacaacactatcagcaatctatacggtattccgtattattcatgaaccgcataagcgtatcatggttgtgtcccaaaacgccaagcgagcagaggaaatcgcaggttgggtagttaaaatcttccgtggcttagactttcttgagtttatgctgccggatatctacgctggggaccgtgcatccgttaaggcgtttgagattcattacaccctacgtggtagtgataagtctccttctgtatcctgttactcaatcgaagcaggtatgcagggtgctcgtgctgatattattctagcggatgacgtagagtcgatgcagaatgctcgtacggcagcgggccgtgccttgcttgaggaactgactaaggagtttgaatctatcaaccagtttggggatatcatttaccttggtacacctcagaacgtaaactctatctacaacaacctacctgctcgtggttactctgttcgtatctggactgcgcgttacccttcagtagagcaagagcaatgttatggcgacttccttgcacctatgattgttcaagatatgaaggacaacccagcacttcgctcagggtacgggttggatggtaatagtggtgcaccttgtgcccctgaaatgtatgatgatgaagtcctgattgagaaggaaatctctcagggtgctgctaagttccagcttcagttcatgcttaacactcgcatgatggatgctgacagatacccattacgcctgaacaatctaatcttcacctcgtttggtacagaggaagtccctgtgatgcctacgtggagtaatgattccataaacatcattggtgatgcacctaagtatggtaacaagcctacggatttcatgtacagacctgtagctcgcccatacgaatggggtgctgtctcccgcaagattatgtatattgaccctgcgggtggcggtaagaatggggatgagacgggtgtagccatcgtattcctgcacggtacattcatttatgtgtatcagtgctttggtgtacctggcggataccgagaatcgtccctgaatcgcattgtgcaggccgcaaagcaggctggtgttaaagaggtattcattgagaagaactttggtcatggcgcgtttgaggcggtaattaagccgtactttgaacgagagtggcctgtaactctggaagaggattacgccaccggacagaaagagttgcgtatcattgagacgctggagccgctcatggcagcccataggcttatcttcaatgcagagatggtgaagtcagactttgagtcggtacagcactatccgcttgaactacgcatgtcctacagtcttttcaatcaaatgtcgaacataacgattgagaagaacagcctccggcacgatgaccgcctagacgccctgtatggcgctatacggcaattaacttctcagatagactatgacgaggttacacggattaatcgcctcagagcgcaggagatgcgcgattacatccatgctatgaatacacctcatctacgcagggcaatgctatatggagattacggtactgagcgaagagtgaccaacacttccgtagcgatgcagcagcgagtttacgggcagaactaccgaaataaatcggcaagcagaaatacactttctgcaaggatttcaaggacttattaattactggacactatagaaggaaggcccagataataagagaaaataataggtaatatataggttaacctaggttatataggtatgccttagtatgggtgtactcctgtacaccctattccttactaccttactatatttacataataggagagagacaatggctaatgattatagtcgtcaaccattaacaggtaaatctaagagaaagcaggtacaacctgtaagtgaagaactaatgcttccggtaatcccaaaagaggcagctagtaagaaaagcaatgttattaatgatgccaccaaatcaggtaaacagaaaggggccatggtgtgccttgaagtggaagatggtgtattgaagattgctatcgcggttgatggcaaagaagattcagagtggaagttagtgacagtggaacccactgttaccccagcttaagagaaggaggatgttacatggctaaatatggtactacaggttctgttactggtcaggcttttcgagtaaaagcagtacaaactattgcaacggcaatcccgatgcctgttgttaaagaagcagaccttaagagtaaagaccaccctatcaacatcaaacatttatcaggtaaacagaaaggtgcaatggttgctcttgagaaaagtgacacaacattacatattgctgttgcacgtggtagtgaaccaacagacctttgggatgtaactggcatggaatcgctcgctgtcactccagcaggtggagaataatgcttaacaaatacttcaagcgtaaagagttcgcttgccgttgtgggtgcggtacatccactgttgatgctgaattactacaggtagtcacagatgtgcgtgagcactttggttctcctgtatttatcacttcgggtcatcgctgtgctaagcacaatgccaatgtaggtggcgctaagaactccatgcatcttactggtaaggctgctgacattaaagtgtctggcatattaccttctgaagtgcataagtatcttactagcaaataccaaggcaagtatggtatcggtaagtataactccttcactcacatcgatgtacgggatggttgtgcgcgatggtaagatgtgttgaatggtgtgagcgtatggttgcccaagctgccgaggatggcaactatgatgactggaagaactactctgacttgttagctcaatggaaagggagatgcaatgaaaaagctgtttaagtctaagaaggttgtaggtgcactggttgcacttgttattgctcttgtttctgtaggtcttggtgtagaccttggctctggcacggaatcctctgtgacagatgtggtctgccaagtgattacctgtgaataagtttctagaagtgctggcaggtcttattggcctgcttgtctctgctaagaagaaacaagaagagaaggaggcacaaagtgaagcgaatcatgttagtgacaacccttctgattggttcgctgaccacttccgggtgtcagcaggcgttaccagagaaagcaatggtgaaacctctgaggccgacgctgacggcagtttacgaggtagacgataaggtctgctttagtaagcctgacgctacaaaacttggtttgtacattctctcgctagaacgcggatacaattaatacatagctttatgtatcagtgtcttacgatttactggacactatagaagaggtaagatagcgccgttcttttgagcggactattactagccaatcttcatagggagggttggaaagtaataggagatagcatggctaaattaaccaaacctaatactgaaggaatcttgcataaaggacaatctttgtatgagtaccttgatgcgagagttttaacatcaaagccgtttggtgctgcaggtgacgccactactgatgatacggaggttatagctgcttcattaaactctcagaaagctgtcacagtctcagatggtgtattctctagctctggtattaatagtaattactgtaacttagacggcaggggtagtggcgtgctaagtcaccgttcaagtacaggcaactacttagtatttaacaatctacgtgcaggtcgcttaagtaatattacggtagaaagtaataaggcgactgatacaactcagggacagcaggtatcccttgctggtggaagtgatgttactgtaagtgacgttaacttctcaaacgttaaaggtactggtttcagtttaatcgcataccctaatgatgcgccaccggatggacttatgattaaaggcattcgaggtagctattccggctatgctactaataaggcagccggatgcgtacttgctgactcctcagttaactccctcatagataacgtcattgctaagaactaccctcagttcggagcagtagagttgaaaggtacagccagttacaacatagtcagtaatgttataggggcagattgccagcatgtaacttacaacggcactgaagggccaatagctccctctaataaccttatcaatggggtagtggctaataatcctaagtatgcagcggttgttgcaggcaaaggaagtacgaacttaatctcagacgtgctcgtagattactcaacttctgatgctaggcaggctcatggtgttacagtagagggttctgataacgtcataaataatgtgcttatgtcaggatgtgatggtactaactctttaggacaaaggcagactgctacaattgcacgctttataggtacagctaataacaactatgcgtctgtatttcctagctacagtgctacaggtgttattactttcgaatccggatctacccgtaacttcgtagaggtaaagcaccctggcaggagaaacgaccttctcagttctgctagtactattgacggtgcagctactattgacggcactaataatagtaacgtagtgcacgcacctgccttagggcagtacataggtagtatgtcaggtaggttcgaatggcggattaagtccatgtcactcccttcaggagttcttacttctgctgataagtacagaatgcttggggatggtgctgtgtcattagctgtaggtgggggcacttcttctcaagttcgcctatttacttctgatggcacttctcggacagtggccctcaccaacggtgacgtgcgtctttctaccagtagcacaggctatttgcagttaggtgctgatgcaatgaccccagatagtactggtacatacgcattaggttccgccagtcgagcatggtctggcggttttactcaagcagcattcactgttacctcagatgctcggtgtaaaacagaacctcttactatctcagatgccttactggatgcttggtctgaagttgactttgtgcagtttcagtatttggatcgtgttgaggagaaaggtgcagactcagctagatggcacttcggtatcatcgctcagcgagctaaggaggctttcgaacgtcacggtatagatgcacatcgctatggcttcttgtgcttcgacagttgggatgatgtatacgaggaagatgccaatggctctcgtaaactgattacaccagcaggttcccgctacggtattcgttacgaggaagtactgatattagaggctgcgttgatgcggcggactattaagcgtatgcaggaagcactagcttccctgcctaagtaagcaacaggcagtgcgtaagcactgcttttagcgcaacttttcttaaaggttatcacgatggtagcctttcagaaaaggaggttacatgattcaaagactaggttcttcattagttaaattcaagagtaaaatagcaggtgcaatctggcgtaacttggatgacaagctcaccgaggttgtatcgcttaaagattttggagccaaaggtgatggtaagacaaacgaccaagatgcagtaaatgcagcgatggcttcaggtaagagaattgacggtgctggtgctacttacaaagtatcatctttacctgatatggagcgattctataacacccgcttcgtatgggaacgtttagcaggtcaacctctttactatgtgagtaaaggttttatcaatggtgaactatataaaatcacggataacccttattacaatgcttggcctcaagacaaagcgtttgtatatgagaacgtgatatatgcaccttacatgggtagtgaccgtcatggtgttagtcgtctgcatgtatcatgggttaagtctggtgacgatggtcaaacatggtctactccagagtggttaactgatctgcatccagattaccctacagtgaactatcattgtatgagtatgggtgtatgtcgcaaccgtctgtttgccatgattgaaacacgtactttagccaagaacgaactaaccaattgtgcattgtgggatcgccctatgtctcgtagtctgcatcttactggtggtatcactaaggctgcaaatcagcaatatgcaacaatacatgtaccagatcacggactactcgtgggcgattttgttaacttctctaattctgcggtaacaggtgtatcaggtgatatgactgttgcaacagtaatagataaggataacttcacggttcttacacctaaccagcagacttcagatttgaataacgatggaaagagttggcacatgggtacttctttccataagtctccatggcgtaagacagatcttggtctaatccctagtgtcacagaggtgcatagctttgctactattgataacaatggctttgttatgggctatcatcaaggtgatgtagctacacgagaagttggtcttttctacttccctgatgctttcaatagcccatctaattatgttcgtcgtcagataccagctgagtatgaaccagatgcggcagagccatgcatcaagtactatgacggtgtattataccttatcactcgtggtactcgtggggacagacttggaagctctttgcatcgtagtagagatataggtcaaacttgggagtcactaagatttccacataatgttcatcatactactttaccatttgctaaggtaggagatgaccttattatgtttggttcagaacgtgcagaaaatgaatgggaagcaggtgcaccagatgatcgttacaaggcatcttatcctcgtaccttctatgcacgcttgaatgtaaacaagtggaatgcagatgacattgaatgggttaacatcacagaccaaatctatcagggtgacattgtgaactctagtgtaggtgtaggttcggtagtagttaaagacagctacatttactatatctttggtggcgaaaaccatttcaacccaatgacttatggtgacaacaaagataaagacccatttaaaggtcatggacaccctactgatatatactgctataagatgcagattgcaaatgacaatcgtgtatctcgtaagtttacatatggtgcaactcctggtcaggctatacctactttcatgggtactgatggaatacgaaatatccctgcacctttgtatttctcagataacattgttacagaggatactaaagttggacacttaacacttaaagcaagcacaagttccaatatacgatctgaagtgcagatggaaggtgaatatggctttattggcaagtctgttccaaaggacaacccaactggtcaacgtttgattatttgtggtggagaagcgacttcgtcctcttcaggtgcacagataactttgcacggctctaattcaagtaatgctaatcgtatcacttataacggaaatgagcacctattccaaggtgcaccaatcatgcctgctgtagataaccagtttgctgctggtggacctagtaaccgattcactaccatctacctaggtagtgaccctgttacaacttcagatgctgaccacaagtacagtatctctagtattaataccaaggtgttaaaggcttggagcagggttggttttaaacagtatggtttgaatagtgaagcagagaggaaccttgatagcatacacttcggtgtcttggctcagggtattgtagctgcttttgaagctgaaggtttggatgccattaagtatggaattgtgtccttcgaagaaggtaggtacggtgtgaggtatagtgaagttctaatactagaggctgcttatactcgttatcgtttagacaagttagaggagatgtatgccactaataaaatcagttaagcaagctgctgtactccagaacacagaagagcttattcaatcaggacgtgaccctaagcaggcttatgccattgctaaggatgtacaacgtcgtgccatgaagaaaccttctgcatcttctgcgtaagcaggttaatatcttagtgtacacaagggcaggcttaggtctgctcttagtgtatccaaaggaggtaacatgatttggattcatacgtatggtgtaggtccattccagaagaatgtactcaggaagattcatgagtccgaggagtcggccttagccagccagaaggtacttggtgggactatccagtgctacatgaagaagccacaaggtttcgacttagtgtaaccataggtggtcacaaagtaaccaaagtcaaaattttgatataggcgtgtgtcagctctctcgccctcgccgggttgccccccccccccatagggtggcctgagggaatccgtcttcgacgggcagggctgatgtactccttggatagtacaagggaggccgagggggcgcctaggacggcctagggaatggcttagtggtggacaaggtgattaccttagtgaagcctcttagtgcattcctgaggccattcagggcgtttattagggattgacagggtgggagagcgtgggcta

SEQ ID NO: 14 - DNA, 72689 bp, Unknown
  Podoviridae; G7cvirus
tggctggggctacacccttacactcaactagcccccccggtatgttgacggtgtagccactaccctaccccaccttacacgttacacatgctccgcatgttatggacatgtcgtcctatcatcaactattggagctatcatcatgactactaccgctactgtacgtatgaccgcaggaactttacttggtactgttaactcagctgctactactgttgcagatacatttggtacagcaactaaagcagtaggtatgcttaattcatatgtaagtactatggcagagaaacaagccatccgtactaaattagaaatgcatacctttgttaataaactggcagaggagacagctatgactgagactctgcgtaagaaaagtattgaagaattctgcaaggataaagagaacgctcggatctataacgcagaatattcaaaagtaatcgacatcctgactaaaagctaagtcacataggaggctcttcggagtctcctgttttgaacattagatagatagtcaaaagtagataaatatctactttaggagaaataaaatgtccctgacagattgcaaatctgaatctccgcaggaagcattagaacgttttgaagaagccgttcgtcagcaagagcaatatcagtctgacatccatcattatggagaatcagacatagatatctcagacgaaactgtagaaagtaagtatcagaaagctaaggctgaattactaacctggttgtcctacattccgtaaaaaccaagacgctccgcgtcttatggatgatgtaaatgcatccactaatcattgaacttttatccttttgtttgggtgttctcaccgacgagttcacccgtaaatcacataaatctggagagtacaaaatgtctattcaaaaattcactttcggtcaatctaacaatgctgctacttctactactaaaactgataagcctaaagctcagttctggctgaacattggctatgtagctaacgaaggttctgatgatgagaaattcatctcattgcctactggtattccgctggatactcaggaaccgctgcctactaatagcagcaatgctgacttccgtgctatgcgttgtgcacagaacgacttgctggaacagttaatcgaatatgctcagaacctggaaccaggtgaagaaggtatcattaacctgcaagttcaacttcgtcgtgtgaaagcagaggctgctgacatcccagcagacgagaataaatatgctcgtaaactgactttctaatcaaccactagactcccttcggggagtcttttatttttaactagacgataatctatttctactttttgagtatctttagacgaagggtactgaaacagtaaccagatagatatagatttatattagatgaaggagtaaccattatgcgtacagtatgtaaccgttataactcacaaaagttgattgttatgttacaaccttggggtagtaagatgtctcttaatgctcgttggcaggtatctgtagaagataagaatggtcagcattatgaccacttctttgtagctaaacctactcgtaaacaaatccgtaaacttcataaggtgtaagactatgttggacttcattgcgtttgtaatactctgttatgtgctgtatcgcctacgtggttacattctcaatggagccaagtgggtaagaactaagctggtacttatctgtaagttacctgttgtattcgttaagtgtctgtttgcttccatcgtagctaaagaggtacgcaagcaactatgggctaaagaagcagaagagtttgcaaagaggaaccagtgatattcactaacatagaagatgccattgaagagtgtatctttcgtagatatcacactggtgtacagaaacgacactatggtgttgtgcaactcaatggctatcaaatggttgtaagaattgtacgtaacagcaaaccttttaactttatgtggagtactaaacatgcgtaagtcattaatcatgggaaccaaagctgacgtacagagaatgaaggaacgtctggctgctaagcaacagacatctgaaccagtacgtaagattgttactttcaatcataggtgtatcaaataataaggagtcctccaataggaggctcctattttttatttttgaatagttagatatgtatttaaataggagaaataaccttgaatgaaatagtatgtatacttcctcaccaagctaaagtagctgacaggaatatacgggtacatttaccattcccattaagtaatccatttgctcgtaacgaaagaaccacggtagaagatatagaggtagcttatgaggcttaccttcgtaatcgtcttattaatggtgacaagttaattacagcagagatggaaaggattgctggctttgtaactgatagtacaggtaaacctgttggtttaattggtactgaatctgatgttaacgttattcgtaaaatactgatggaggcactcggtgaacaatcttagtgatgtcatcgtagataaaacaatattagtaaatcccaaagggtatgcctggttcatgctaaagcatacccgtaaggtatatgttagaaaggtatatatacgtaactttggtaagttatcttacagagaagtacgtattaataatgagatgtactttctagatgaatcagtgattatcaaatcaactgaagacagaaaggctccttactttaactattacggattcaactaaaatgatgtactcaactgattatggtgtttgccctgtatgtaacaaacgtaaaggagttgctaatcataagcgttgtagtcgtatattacagaaacaacggaaccagaaagaatgggataagctgttggaaaaccagcataaagaagaaaatcaacagatggctgttaaggcatctactcaacgtattcgtcgtattaactatatacaggggtatcagaaatgagactaatcgtagctggtggaagagacttcgtaaataccaatcttatgattgaggaattacagaagttagtaaattcagtaaatatacctgaatgcccagaattagtatgtggtatggctcgtggagcagatatgcttgcatataatctatgggctaataacaaaatgcctattcataatttcccagcaaactgggataaatatggaaagtctgctggttatagacgtaaccaggaaatgggtgaatttgcagatgctgctgtatgtttctgggatggtaattccaaaggaaccaagcacatgattgatatcatgtataggcttaataaacccgtatacgttgtgaggtactaaatgattattacatatcctacaggcaagactgtggaatatatgaagcacaccattcaagtacctcactgggttaagtatatagctttattaccacgtcaatataaaagtgctaatacctcattaataggattctctaagaagcctaagctaacagaaaacaatatctgggtatcctctgggagacaagaagaaattggtttttgtgatttgagtattgtcgataataacatctatgggacattgagaaaggtatgaaaactattctagtagttcatgattctacatttacagatgtagataaaatgatgcgtaatattgattatgtatctcaaacaagccaggcattcaatgaagaatttaccctctactgcaatgctgaatctccactggttcctatccttaaagaatcaggtctaccattctctacagagaacttcccggaagaaccagactatgtaatctcattcatttatgacttacatgatggttctgaaactagtgaactagctatgaaccagtggcgtagtaaacgtcctgtgttcgcattccaggtacttaagccatgatttataaagaatattatgtattcaaaaagggggatgattttatagctatgccggatgattatatagattggcatacaactcccgtattaaatgaagcattttctgtacctaacctagaagaggttaataaagtaatgaacggggtaatgttaacaagagggttagcttacaaaatagacgcattagaaggaactactgtatgtaaagtaagtacatctattgaggcattaaaaccatgaagactattacattaggggacgacaccaatgctttgctgggtgtagctgcacgtccaattatcattgttaataaacatcacggtaaatccggtgagtatatcggacgtggttcaccattaggaaatccattcgttattggtaaagacggttcaagagaacaggttatagccaaatatcgagtatggcttaatgaacaaatcatgaggaagaatcaagctgtattggatgaacttaatcgtcttggtaataaagccattgatgagaaagggttggccttacagtgcttctgttatccgaaaccatgtcatggtgaggttattaaagagaagctagtaaaagctatgtataactactttgtggagaatccaaaggggtaactaatgaaagaaatattcgtattcactaccaatacactaggacaacataccaatgcttctgccaagttagcttataagaaacatggtgctcgttggggcatggcctatggtcactatggtaatagctttgctattccagtaagagatggcaatggtaaccgtatcaaagagggtgctatctatggcttcattgagggctttattgcttatgcatctgccaatccacaatgggatttcaaagtcatgagtaatgactacctggacccataccagttcattaatgtaaccggaaatgtactgttacccgaagcatggcgtaaacacttaggcgatgcttacaactactggagttaataatgacttatgaagaactgtgggctgctcaagtcagagccagagcacttacacggcatgatatctattgtgcattacaaaacgaactaaaggatcgtactaaactaggtcacatatctggtttaattaaaatacctatgcgtagtctggtatggccttaccagaagaaaaataacgagtttagtggtaatggtttatatgtacgtattgactaccttggtcaagagaacagtattcgtattaccttttggactaaacgttaggtaatagctgctccgcagcttttggttattaatcacatttaggagaataagcgatgtactcatccattgaacatcagaagcaactcgaaattcttttcaacaaaaatcaattactccctcgcatgaggaaggaatttgaggactccgaagaaattgactttaaggcattcgctgcctatttggaaattgattataagctgctcattgatgcaatggtgcagattgccctacataaacgtgctgaccttcagactatgattggctctcttatgagccattcagatgatgctcagtacatcgctgactgtctgtataagatggcagagaatgactgcttcaactatgaccctaccatcgacaagttcggtgttatctacgagattagtgaagatgttcagatggaactggaagcattccagtatccattacctatcgtaagtgctcctaagcctgttctgtgtaaccgtgatacaggttactatgagagcaggggaagtattatcctcaagaagaaccatcatgagatggatgtctgtcttgatcacatcaaccgtatgaataatcaacgtctaagcattaactgggacgttgctaactatgtaaaagactctcgtcctaatatggataaacccaaagagggtgaaacccgtcaggaatatgagaaacgtgttaaagcctttgagaagtacagccgtactgctaaggaagtaatggagttagtgaccaaagaaggtaataacttctcactgggtcacaaatatgacaaacgtgggcgtacttacgctcagggctatcacatcaactatcagggaaccagttacaacaaagctgtactggaatttgctgataaggagttagtaaataatgattaatcatcgtgcagtaaaagacttctatgcccatagggaattggtactaaaacgtatcaatgaagcaatgaaacgtgaagctgaagctaaacgtaaccgtaaataaattcaaatgcgagccaagaggactaatcccaatgagtgagttattaaaactatggcttattagccagaatgagcgtaaggggtgggatacgttcgactctgctgtggtagcagctaaaaccgcagaagaggctcgtcttattaacccagatggagaatggagtacatactccgcttggtgttcttccccagataaagtgcacgtcgagtacctgggtattgccaccgaaggtgtggaaccaggaatagtattgtcatcatttaatgctggctaatacatccaataagcaggctctccatagtggggagccaagaagcaaaaggaacataaaatgcaactgttaaccgctcgtgaatacctgaaagtagatattgccaataactatggtctggataaaaagacctgggatgagcgtattgcttggttcgatgagaatgaagctaacttgcttaatctggtagatgaagctgaggaatctgcactgttctatgctggtgtaaacgcatggaaagatatgaaagctggtaagcctatcggatatgccgtagccctggatgctacatcatcaggcttgcagttactggcctgcctgactggtgaccgctctgctgctgaactgtgtaacgtagttaattacatgggagagaatggtaagccattacgacgtgatgcttatacagttatatatcacaagatgctggacatccttggtgaagcatcccgtattaaacgtagtgataccaagcaggcagttatgactgcattctacggttcagaagccaaacctaaagaagtattcggggaaggtatccgtctcaagacttttgaaaatgtaatggaaacagttgcaagtggtccttgggcacttaacaagttcttactgcaatgtggtaacccggatgctaaccgttacatatgggtactccctgacaacttccacgctgtcattaaagtcatggttcttgaagtacagactgttaacttcttgggtaaaccatttgacatcactcgtatggttcagggtactgaagagaagacccgtatgctctctgctaacatcactcactctattgatgggatggtagtacgtgagatgctgcgtcgttgtaacttcgaccctaaactggttgcctatgtacgggaactgtgcgatatcgggccaagtgaataccccgttattgaggggaaccaagagaagactatggaaatctggaatcattatgaaaggtcaggattcctgtcgctgtctatcctagacttccttgacccgaatactattgcactggtagaccgtcaagtagtagcagatatgatcgacactatgcctaagaaaccattccctgtaatgactgtacatgattgcttccgttgccaccctaactatggtaatgacctgcgtcgtcagtacaatcagattctgtctgacattgctaagagtgacttactgggcttcattctgtctcaagtactgggacaagagttctctgctggtaagctggatgacagcctctggcaagacattctagaaacagattatgcattaagttaataaactagcctcattccttcgggagtggggctttattttttgcttggaggtagcaactatgcttatcaattttgaagtaatctctcagctaatactgatagttttatctgtactggttctggctacgatagttcgtgcccacaagtctaagtttgcttactgctactatggagcatactcactaggatgctttgtaatggcaggatggatagcttttgctatctactgtgtaaacaactaaccctcttaacggagggtttatttttttacatgtcatgtatactaatcctgctatttacttatgaggaaattcatatgccaactttaaaagtaggttttaacaaaaccaccaatgtcgcaactgtactggatgcgagtggttctatcccgggtggttcagtagaagtaggtacttttgtacacccggatgccacttacccagatagtttagttatttttcatggtgttcgtgatctgctgtataaacgttctgctaaagacccatctgaagaaggcttctggcctaacaacatcgtagatatgcagtccatctctattgatatgcaagctactccacgactgactattgctactaagctgcctcgtgtagtctccgctatcgaaggcgaagatattaactggcatgttgatgtagcaggcggtaaagcaccatttacttataaatggcagttcaaagctgatactgctggtgcagcattcactgatattagctctagtactaacccatctgctgctactgcaacattaacccttaatgacgtaaccgctgcttctgctggtacttataaagtgattgttactgatgccaatggaaccactgtagaagataagtctctactggctgttggctactacgaagcaagctcactggtagctactcctgcttcattgtctctgtctgttgctgctgatgctacttctggtaagactgtaaccattactaatgtgcctattggttcatctgctggtactttgtctattaagactgccccagagtctggtcgtgctacggctaccattgctggtaacgtattgacggttaaacctgtagctgctggtgaagctacttctgtagtagttaccaacggtaaggtcgatgtaaccatcgctattactgttgtagaataaaggtagcctttatttggggttgtaaaccctgatataaaactcccaagcttgacctcccagatgaagggaggtctttttttgacttaaacattctggagccaggaaatgtataaagagattgcatttttctcattcttactaggcggtttattaggtgcaggatttgtagctatttctaatacctactttggttctactccaaattctgtaacacaaaccctcaagcatgaatgtgaattgaatatccctcgtaatcaaaactgtgtaatgcagttcgtaccggagaaaaaatgaatatccacaatctacgtttggttgagaaactgtacgaagaatacaacgacaaccgacagcaattagctagtttgaagaagtcaccacatatggtgaaagtatcattcaatggtacggatttaggaccgcaagctcgtacaagaatacttcctgaactgctgtcattttatcaaaagagaattgctgtcttagaaaaacgctttgagcatttatgtgtagatttatcaccactcccagatgaaggagaagatgagtgaaattaacccagtcccaagcaatcttccttcgtatggttcaaggtggttctgccaccagcaaccgcaataataaaaccgcacagtctcttaagaaactgggcttagtgcagttcaatgctggtcttgggtggtcattaacccctactggagtacttcaactcaacgagttaaaaggtaactaaatgaaaactttaattgctgttgctgtagtagctttatcagttctgtcattcaatgctcaagcatccagccgtgaaactctgttagacgctgctgccgactacaaagccaataatgcaaactttgtgaaccagggttacttcatgggcatggttactatgggtgtagaggcaggaaataattgtgtaccggagaatatgaagttaggagccatatttgacagagtagcttctattatcctgtacgaccgaaaggttaatgcagtaaaagtgccatcagacatggttctgttagcaattgatacagcatacccatgtattaaatcttaattagtaattccattaactttaggagagtaagtaaatggcgagcattgactcactgaccgtatgtaatacacgtcaggcccgtaactttattatccgtgccctgcaagcaggtaacgtaccgttcctgacttcatcaccgggaatgggtaaatctgcaattattcgctctgttgcagaagaatttggtatgaaactgatagaccatcgtctgtctacttctgccccagaggatttgtctggtctaccattccgtaatggtgaccgtgcagagtttatcccattcgctgacttattccctattgagggggatgagataccggaaggatataatggttggctcctgttccttgatgagttcaactcagccagaaaagaagtagtagctgctgcatacaaactgattctagaccgtatgactggtcagaaaaaactccatcctaatgtgatgattatatgtgctggtaacaaagctactgaccgtgccattgttaacccactgggtactgcaatgcagtctcgcgtggttcactttgaaatggaacttaacttcgacatctttgttgaagacgtaatgattccacaagaatgggatgaacgtctggttgcattcttacatgctaacccaggttatctgcatgacttcgacccagcccataagaacaaaacgttctgttgcccacgcacctgggactttgttaacaaagacctcaagaaccgtcctgaaggtgctctgccagatgaagattctatctactatgcaggacacgttactgctggtaaggctacagaatttgttcagtttactcaggtatacaatcgtgtgattacgattgagaaagtagtcaaagacccgttaggctgtgcactaccagaagataacaacctgtgttgggctaccgttaatcatctggctaacaaaactactgaagagaacttcgatgatgttattcagtacattgaacgctttaaaacattcacccataagattctgtacttccgtacagtaggtagagcattaccagaacttcaggctacccctgaatggcgtaaggctgctgctaacatctctcgttacattcacggataatcacagcatgaaccggatacctcagcacacactcagtgatgaacaactcatgcgtgagtatgaccgtactcaggccaacgctttcctaggaagcagtgcagcgttctttggttcattactgtgtagtcttaaattctcatggaaacgtgaggattgtcccactgcatgtactgatgggatagagcttcgtttcaatccagacttctttatctggatgtgtccagatgcaagaaaaaccgtactaatgcacgagctatggcatgtggcatatttacatggcatccgacgtggaagccgtgacccagaaatctggaatcaggcatgtgaccacttcattaaccttcagttagaggaagacggttacaagttcactggtatcgacgaaggtatttgcaaagaccctcagtataaaggatgggtcgaagaagacatttatgatgacctgatgaagaaccctcagaaaaggcagaagccgtcagggggtgttggagcaggtcttgctggcgacatgaaatccccctcttcggggcagtcccagggtgctgttgtcaacaacgtagtacgtgcaatgcaaagtcagaagatggctggtggaacaatgcctggtaagggtgctggtcgtatggaagaggttattacccaattccttaagccagtggttccatggcaagaagttctgatgaacttctttaccgacattgatgatactcattatacgtgggccagacctaaccgtcgttacactgacatctatctaccttcactggaagatgatgaaggacgtttacgacacttggcctactttgaggatgtatctggttctattagtagtgctgactctctgcgatttaactcagaagttgcctacgttaagagccagttcaatcctaagaagatgtccttaattaccttcgacgatattatccaagaagaaatagacatcactgaagaagatacttttgaagagattaagattactggtcgtggtggtacaagccttgtgccagtacgcgagtggattattaagaataagccaaccgctgcaatcatattctccgatatgtatgttcgtccaatggaagaattaccatttgatattcctatcatctggtgtgttctgaataatcccaatgctaccgtaccttttggggaggtagttcatatccctaaaggaatgaaataatggttgttaatggtaattctctataccgttcatctcagttgctggatatcccagaccgtaaggtatcagagcatggtgtaagctatggattaggtgaagctggttatgatattcgtatcaaacaagatattaccttctatcgcttatttgggctgattccaatggtgaaagtcgttgatggaaatcaagtatcacgccatctcggtaagttcgccttggcctcagcaattgagaagttcaacatgtccccgtcctgtgtagcaatcgttcacgataagtctacatgggcaagacgtgcattatcagtgttcaataccgtaatagaaccaggatggaaagggtatcttaccctcgaactggtctatcacggtcgtaagaaattgcatatcccggctggtgctgggatagctcaagtattatttcatctggttcaggaacctgctaattacaatggcaagtatcagaaccaggaaaacaaaccagtagctgctagaccttcaaaataaaaggctatccggcttaattaaggaaaactcatgtctgtatttcaagtaacacaagaaaatactggtattcgcctgacccttaatgcgaaccaagtaattgcagtgcaagaacttaccgcaggtaactctgctattactaccgtaggtggtgatgtagtaattaccaaagaaacctatcgttcagtacgtaattacctgaagaaagctcttgctcctgcaagcaaagatgctgagtaagtagctgcttaaatagcccagcatagttgggctatttgtgaagaaactaactcaaccccacataggaaccatcatggaatctttagcagcaatccttgttctgttatttgtattagctgtataccttatccctactatcattgcttttgcacgaggccatgcctccaagtggggcattggtgtactcaatattgtattaggctggtctttagtcttctgggtagtagcactgatttggtcactgtccaacaaaggtcagaaccaagttacaaacgtaactgttgttcaaaccaatggtggcagtaaatcagagtaactaacctaagcatcattacatagtgatgcttgtggaagttacttccagctcattgcttatccatctcctaacccaagcccacctaacccgtgggcttttttatttacaggtactcttatgtcaagcagacaaaatggtaagtctatcctgcaagggctggacttaagtaagctggaacaaactgcaatgcttactctaggtaaaactatccatgatcaagtagagaatgaaattgagttagatctttacacgacaatgcaggctcttgttcaaaaaggatggactattagcagaccttttccttcatacattcctccggaacctcatctgaaatctaaggtagaccgaatcatagataagttctggcttagcccatgtagggatgatacgtatctttacctggctcaaatacaaaagaatcctcgtactaaggatgtgttcaaaggcaagagcactacccatcattacccttggtatagaagaggtagtaaatactaatgcgtatcccattcctacggaaaagggaacgaaatcctgttctttacaataaaggcatagaggatgagtatgaactcaaccgtaaagctcgttcctacacaacaaaattattcatggggactaacaatcctgatagattactggactttgtttttgaacaaatctttatcatatacagcttagctatgtctgctggttcacaagaagtaagtgataaggcaagagatgctctctgtatgctccgcagggagtatgaagccctcatgtatgaagacttatactcctttaaaaaagaaaccgctgtagcgtgttctgtggcccttactgaaggtgtagcagtattacaagaactaccccgtagtgagtttaagctggtatatgttcaggttaagaaaattacagaaaaccgtagtggtatcaccaactatctaaggtcattctaatgattaaggcaactgtcattgcagattccgttcacccagaaacaggaactcgtattactacctttgaattggtttatccccgattcattcacagtgagtttatgacccaccgtgtattcaaccgtaatgcctcaagcagtcgtgctattcccacggctaagttcatcgaacaagttcgtaatgaaccagtgatgcctagtcactggggcaagaaccagaaaggtatgcaagcagaagaagaactcactcctatggagattgaggatgctaagtttatctgggataacgctgcatctgctgctgctgtgtatgcagaacagctacgacgtgggcaagtacataagcagattgttaaccgtattctggaaccattcacgcatattcgtgtagtggtaacttcaaccagctgggctaatttctatggactgcgtgaccacaaagatgcgcaaccagagattcgtgaactggctcaagcaatgcgtaaggcacaggaagaaagtacaccgagagcattaccatatgggcaatggcatctgccatatattgctcatattgaccgtgttggggcttacaatttctgcaaacgcaatcgagttacacgcgatgaaccaagtgatgcagaagtgcatggactacttctcaaagtaagtgctgcacgctgtgctcgtgcttcctataacaacttcgaaggacgaccatctactatcgaggaagaccttggcttattcgctaagttagtagaaaaccagcctattcatgcttcacctactgaacatcaagctacacctatgaaccttggtgaaaagtatgtgaataacatgaacccagttacatgggaacaaggtgttacatccatggataaagaaggaaatctgtactcaggtaacctgcttcactttatccaattccgtaagttaattcctggtgagactattactgaatgaaaaaactagctttgtacgcaatgctaattagtaccctattaacacttaactacgcatacaaagttgcctttgtcgtagaaacagatatgcagttcattcgagctagtattctgttctttgtgagtgagtttggattatggtgtgtttactactttgctcatgactatgaagctattcgtgagcaagaggaagtaaagaaacgcatgagacgtttcattgaaggaaaatagtaagtaaacctaagacctcctcctggaggtctttttttgattctattaactcttttaggagggcgtatgcctgctaaataccgtatcaaagacacaccagtaatgtgtgagggtgagaagggtgacattgtatatgcctgtatacaggatgacttcaatgctgctctgatgttaactcaaatgacaaatacactgcatgtatcagtaacactggaccctaccggtgactatccatgctttcccatccctgctcataacctggagcaaattcatgattaatcctgaagttattcatagcaaaactggaaaagctgttccactcagtgagattgcagttacaggtgatattgctgcttgcccagctaacatcgcttccttatgtatgtgcattgctgcactggcagaagaacgtaagttatggctggaaccaagcaaggaaatgatactggctggtatgtctgaactaaatgcacttctgaaagaaatgtatgacgaggatgggcaactagttgaaccaactgatgaccaaatctcggatgctgttgtattcacccttcaagcaatggcaagtaaacgttaattaaatttaagaagcaacacttaaactggagagtaaataaatgttagttgcagataccaatgaagtagctacctcagcgacactgggtggcaaagaaactattgcctttggcatttccgatgacccggcattcttccatgtattaagtacttccttgtataacaatcctactctggcagtagtccgtgagactatctgtaatagttgggatgctcatattgaagcaggtaagactgatactcctattcgtatcactattgatacagacaattttattacattccgtgactttggtaatggtatccctgatgaactcattggttccatttatggtgtctatggtgcatctactaagaaatccaacagtagtgttactggtggttttggtttgggatgtaagtccccattcgcttatacagatagcttccaggttacttcatggaaccgtgggaagatgtcagtatataacgtagctaaggctgcgattgagaatgacggtaagcctggcattgttcctattgttactggtattcccactgaggaatcaggtctggaagttaaattccagttaggtaagcatgacgtaaatacctttgtgcattacattatatctattgtatttaacggtgagattaaagctgaacttagtatccctaaacttgttaaaacagaagaaggtaatagtattcagcaaggtgactacactctactgaatacattaggtatgtcatttgaacctggttcatatgatatgtctgatagctggtataagggttatatgggtaacagtaacatattcgttcgttacggtaacgtaatgtacccaattgtatccagcccagctagtgaagaggctgtgggtcttatcctcaactttatgaacattattggtgctgctaatttagtagttcaggctgcaccggatactctagctattgctcctagccgagaaacactgtctaaccaaaagttaaccgacgatggtattactactctatgcgtagatttagtagaccgtatggagaaggagattaaggctaaaattcctgaagctattaagcagattgaagaatacgcctctaaatcatctacccgttattgggaatattcatctttcttacttgcagttacagacagaactgttcaacgctatatgtcctctagcttgtgggctaaacaacgtaaacatcacatcaaacattggcgtaacttatccaataaagcattattagctcgccctgaatatgcgggtcttaagaagctgtatagtaaggctatgagtgctcttaaagatactcgtgcggatggtacaagctacccattccaggaattagtataccggcatctacatttacctcagcttgctgctttaaaagaaactggtattaagtggtctggttacatagtgaaccaaggtaaccgtgttgatctggtgagaggtaaacttactgattactttaagatgggctataactgccatttgggtattggtattttcactaccaagaacgttgtagttactcgacgtttatctgattgtgcggactctttctcatacttccctgaatacaaccgtggagacttagagcgtacagcttttgttcacgtcgttggtcctaagaaaggtgcagcagaagaagctgtagctaagttcactgctatgggttatcgggtaattgacctcactcaatataatgagtgggacaaaccaactaactaccgcagagaacaagctaagatagctgctgagaaacgagctaagacgatagctgccaataaaaccaaagcagggggtaaaactaatgctctgatttcgttgaatgcagttctcggtactactcctgtacgaaataaaagtggggattgggattctaagccgtacattgacaaggattttactgacccaagcttccatgagaagtacggtttcactgaagtggaacaacctaagtactacgtgttagccaatcaggttagttctggtagtccagtaactgcccggattggaaccatgtggaaatggtatgagttatccgatgagatgaaagcagagactgttgtctgccgtaatcaaatcgaagctaacaaggctaaacgacgtggtgctatccacattgacgatgttcgttttaaggaactgatgcctgtcattaccagcaagggatttaagaagtatgtcactgaacaccgtattggtattctggaatacgtaggactggatgacagagagtattgggaaatcctagatattcttggtctaacgttcaaaccattacagaatctgatttttaaaccagagtatgaatgggcttatgatttcttaagaaatcgaccacataacaacaaagaaaaacttgttgaaatgggttgtattaagtcagttgatgacttagagccatatacaatgatggttaatccgcgtaatcataagtactttgaaatacttaatcagtacaaggggttattcagctatagctggagtgctggtgacatactacagagtctggacttggggagtttagttaaacacctcaagaaaaatccagaggatattcctgggtttaagtccctctaccgtaatcgtctaaataaactgaaaggtaactaatctgatgaaaatcgaactgatttctatcatcgcactggcagttgacagtcgaaacttaacattgtggaagcctgatggctccacaattgtatatccacagagcgacccacgggttgctcgtatcgtatctgaagcacaaaccaaaggcttgggaattaccaaagacctgatagaagtaaacattgcaccagaagtatcactgcgtaatgagtatctggaagcagagaagaacactaatggattcgtccgtttcttcaaggtagctaaagctaaactcaaagagttcttccaggatggtacagatgttcaacctacccaagccgtttctgatattaagctaggcaatcccaccaagacattagtatctaaagctatggatacattcctggctgtacaagctaatgaaccagaagtaacagtatcagatggttgctacgacagacgtgacaatctgatgtggattactggctgggataaggaccataactatcctgcactggttcgttttattaacgacgtaatgggttgggggtatgaacaaaccaacaccatgctcagacaggaatggcctgttgcagttcgtgcagtatccgatgatgaaatgggtgagtttgctaaacaagccaagcacatcaaaggtgtacatattgtatttaccagccgtaaacataccccaccaccttacattgaagtagctaaaactacgaaccaggataagctggctgctgcatccgagaaattagctgcattaggtgctattagtactgataacgctaactttcacactgatgtgaaggaagatgaagtggttgttgctgttaccaacgatggggttatccctggagttgagaacctgcaacgtcacttacgtcagtctgccaagttgaaagactacaagggcttcactaagttccttgagcgtctggctccggttattaaagaccgtctgcactcagtagaagacctgatgaagttcatggaaactgctgaattgcctatcgctgatgatggttcaatcctgttccttaaacgccttcagtataaagggaaagaagatggtaaacgtgtattcgttgactgtcactcaggtaacatcaaacagtgggtaggctgtaaagtgcaggtacgggaagacctggtagatcctgaccgtcgtcaggactgttctaacggtctgcatgtagcatccatgagctacattcgtagcttcggtggtaacgtaactgtccttggtaaagtagcaccagaagatgtgtttgctgttcctcagtacagcactaataagatgcgtgtatctgcgtatcacattattgctgaactacccgaagaggaacgttgcaatgttaacagtggtatctatttgtctaaaactgaagtaggtaagaaactacttaatgatgccatcgttgggaaccatagttcacctaccacacttattatggttggtgggcatcgtggtactaacctcaaatacactaatctcacatctggttctgtagagcaattccgtacagttgctagtaaagaggcactgaatatggaagagtcactgaatgaagctgtagcttctgaaccagtgaaagctactgaccttaaacccgttattaagaaggctcctactgtgaaagaacaaatccaggaactggttaaagagttccttaatgcaacaacaccagaagataagttagctgctgctgaccttctggtagaactgcgttccaaagctcgtaagccttgggctgcatttgatgtaggtagtgacgtggtagctaagattgctgatgtacgtgctacctatacaactaagcctattggtaaacctaaagctgttaagcaggatatgacagttaaacctacccgttctgctgctgccactaaagtagctccttctggtaaacacgttgataatctgcgtagcatcctgaacgatacgtcatattctgactatcagaaaggccatgctctgcaagactataaacgtcatgctaagaagtcattcactgcaatgggtctgactgaagaagaagctaaattagctaccaagctggttaaagcagttaagtaatagcctgttcaaatgccctcacttgtaataaagtgagggtaattttgaggaggaattgtactatgagtaaagtattcagaagtaatcgcaaagcaactgatgaagacatcattcgtatgaatgctgttgggctgtccctcgcaactatcgctaagacgttgggggttcaccccactacggttactttgcgattgcgttctttaaacattgaaccagccgacacacgtcggacgttcatggaaaacgtattacgtcctttaccaacccatgtggctgattggctatcagaacaagttggtcctgcttatgaaattcgttcatatgtaagggacttgattctggaggcatataataatcgccaccttaaccaagagagtgagcatgacaagttcatccgtttgtacgctggcaaatacggaagcctggttccggaaagcagtaccaaatccgacgagtaagaatattagtacccagattggttgtcatctggaagaagtagtagagatgctagacgagttatacgctaactcagaagatgcttacgatattcttcacaatgccattgcagcattaaccgaattgtctgatttaatgaaaaaagatgacaaagaggtatatgcaccgaacagccatcgtttagctatccttgatagtcttgctgaccagattgttacagcaaccggcgtcggtactttccttgggatgaatgtccctggagcattggctgaggttaatcgctctaactattctaagtttgaagatggggaacctgtcttcaatgagaacaagaaagtcatgaaggggaaagactacactcccccagatttgtccagtttcatttaacgaaagccccaaatggggctttctttctatggagtcatatatgaattggcacgctttatttgaatacatagatggaaagctctattggaaagttaatccatctatggcagtgcgtataggacacgaagcagggtccataaatggagatggttacattcaagtaggttacaaaggccatgtttatcaagcacacatagttgtgtgggaaatgcacaacggcccggttccaccaggaatggtcatagaccatgacgacaggaacagaaccaataatcgaatagataatttgaacttagttactcaattacaaaacaatagaaacaagaccaaaagtaaaagaaacacatctggtgttactggagtgtactggcacaagcgtgaccagagatgggtagcatcaatcaggatagaaggtaagctgaaacagttgggtcagactacctgtctggaggaagctattaaattaagaagggaagctgaaataaaacatggcttccataaaaaccacggtaaataactggagatttaaatgttttccaaacctaccaaagccccactgaaccaggggcaagaagcggttgcgaaggagttcttcgacttcctgctcgaccctaatgctaccgaattcaatattagtggcccagggggaactggtaagacattcctgatgtcgcacctcattgatgacactatgcctgcatacatggaaacttgttctttgatgggaaccaagcccctgtataacgaagttgtcatgactgcaaccacgaacaaagctgctgaagtactggctcaagctacaggacgtccaacatctacctatcactccttccagggtctgattgttaaaaatgactttaagactggtgaggctaatgtcgtaccatctaaatcattcaatattaagaagaacaaaatcatcttcgtagacgaagcatccatgattgatcgtcagttacttaagtatgctcgtgaaggtactcaccagtgcaaactggtatttgtaggtgatgcttctcagcttttacctgttaaagagaataagtctccagtgtatgcaggtaatatcccaacacactatctgactgaacagatgcgtactgatgcaccggaacttaaagcattgcaccagcaattgcgtgatacggtggaaggtaagacaggcttcctgccaattaaatgtatcccaggtatcattgactgggtacaggaggaagagatggagaaattggttctcagtcacttcactcaacctaccaacagccgtattgttgcttacacaaatgaccaggttattaattacaataactacattcgtgaagctaacggttatgtgggtgaatactccatcggcgagcagctggtatctaactctgctgttcgcttgggtgtggataatcgtttatctattgaacaggacgtaaaactcattgaccaggatagtagtactcgcatgattaaggttacaggtgacctggaactggaagttcgtgatagtactcttgacctaggctatggtggcattgtaagtgaagttccaatacctactgacccagactacttcaaccgtttagttaagtggttaggtaaagaaaagaactgggaaccttacttccgtcttaaagaaaccattccagacctacgtgctactcatgcgtgtactgtccataaatcacaaggctctacttacgacacaatctttattgatgcaaatgacctctcaagctgtcgccaaccggatatggttgctcgtctgctttacgtcgctgtgtctcgtgctcgtaagcgtgtagtgttctatggcaatcttgccagtaagtacggtggcctaactttctaagggaggatatatgcctcagattggttcagcgactattggtcaagttgccaatagcagcgagatagtcaagcatctgttcttagcagaactggttcgtcttgatggtgtgttaaacggtatcattgataagaatgatcgtatcaatggtgtagatgtatcagctggattcctttaccagggtgagttctatcagcgttctaacgctaccagacctccaacctacggtgagcgattaacgcttaatccagaactgtggcctgcaatggacaagtatctgaaagcctccagtcgtttgattatggaagtacaccttgtgaaccagactgtatatcgtctggttcgcggttgtatgtcctatcaggatgtacgtgatgctctgcctgagtgtctggtagcacaagaccagacgggtcagtacaaaggtctgcctcgtactcgtgaagcagcctggacacttgctggtgatgctatggcaatcaagcagtatgagaagattctgccctctattgagtattatgcagcttcccatctgattttctaaggtaaagctatgcgttacatcacctctcaagatactggtaagtatcctattgctatcctcggtcatcaaatccgaagggaggagatgattaaaacctacctgctgccttatgacctaagcatggaagacttcatctttattgaacttcattctgcccctggcaagaagaagactcctgcaagggagattaaggagttcatacagcaggaattacagcaagtactggatgatgcagaaactcaatatattatctgtactgattctgactacttcaaaatactgactaaagaggctaaagcagaggctaacctcggctatgtttgtgattcagtatggggtaagcagaaggttatctatacgcctagctacaggcaagtcttttatgacccacctgtagtgagagccaagattgctcagggtatggatgcattgcttaaccacattcgtgggcagtatgctgaaccaggccagggaatcattgagtttgaagcatatccggatactccagaaaagattaaagcctggctagaccagttgcttgagatgaataagccattggctatagacatcgaagcattcggtttaaagcactataacgctggtataggaacaattacattctgttggagtaagacgcaaggcatagcctttaatgtggactacgagccaattcctggggctacagaagcaccatatgggcgtatcaacagaaatgatattgttcgaaaccttctgcgtgagttcttcattaagtacacccaacggcagatgtatcacaacattagctatgacgtgtacatacttatctatcagctgttcatggataacctgattgatacggaaggcttactgcacggcatggagatcatgctacgcaattgggactgtactaagttaattacctacttggctactaacagttgtgctggtaatcaccttagtctgaaagaccaggctcaggaatatgctggtaactatgctcaggatgatattaaagacatacgtcttatacccaatgagcaattgctacgctacaacctcattgatggattgtgtacttggtacacttatgagaagcactgggatactctcattgccgatgaccaactagatgtttacaacaacatctttaaaccagcctgtgaagacattattcagatgcagttaaccggtatgcccatgaatatggaaaccgttaaccaagtagctgaagaaatggaaactgacaggaaccaggctctgaaaactattcgtgagtctaacctcatgaagaactttaccctgatgcttcgtcaggaatgggtagacgataagaatgctaagttgaaaaagaaacaggtaacactggctgattgtaacatcgagtttaatcctaactctagtccacaactacagaagttgttatttgattatatcggcttaccggttcttggtcttactaagagcaagcaacctgctactgacggtgacactattaaagcactgcgtacacatacgcagagtgaagatgttaaggaactgctcaatgcacttatcgactataagcttgtggataagattatcactagctttataccagctttcaggaatgcccaaccgggaccagatggctggcactacctgttcggtaacctcaatctgggaggcacagtctccggtaggttatcggcttcagagccaaatctacaaacaactccatccggctctaaatatgccaagaagattaagaaatgcttcgaagctcctccaggctggatattttgcggcttggatttcgcctcgctggaagacagaatctctgcactgacgactaaagacccacagaagcttaaggtatataccgatggttatgacggtcatagtcttcgcgcatatgcttattttggtgagcagatgccagacattgaagacacagtagaatccattaactccattcagcataagtacaaatcattgcgtagtgactcgaaggctccaaccttcttacttacctatggtggtacttatatgggcttaatgaaaaactgtggcttctccgaagagaaggctaagactacagagaaacgttatcacgatctctatgtagttagtgatatgtgggttcaggctaagctagatgaagctgctaagactggttatgtaactgctgcatttggtttgagagtgcgtactcctttactggctcaggtattacgtgggacatgtaagactccatatgaagcagaagcagaaggcagaactgctggtaacgcattaggtcaaagctggtgtctactgaataaccgtgctggctcagagtttatgcgtaaagtcagaaccagtgagttcaggttagatatacgcccttgtattcacattcatgatgcccaatacttcatgattcgcgataacatggacaccttgcagtatacgaacaagcacttggttgaagccgttaactggcaggatcatcctgatattgctcatccagaagttggtttgggtggggaactatccttgttttacccaacgtgggctaatgagattgaaattccaaatcacgctaccccagaagaagttcatcaaataattcaaaaggcattcgcatgaccaaaagtactaaagaaactgtagtcaaaaagtatcattggatggtggcagcacaggtaatcttccagcttcctaaagctgatgatggctccctgcttaccatgaacacaatgctgctcactgacgaacctcatgtgacctataaagatttggctcgtgccaatcactcactgaagattagtctggatcagcgtttcgatacctcagttgatttgaaagatattgtttatctatctattaacaacctgggcctgatgtctgaaccagagttccaggcaaacatgattcccaagggggaataatgactaagctctccggtggtcttaataactactatgtagttacaattaagaatccccaacggaaagagcaagagccataccaagcagagtgtgaggatattatccaagcactaggcatgaccttcgatgaaggttgtgcctttaaagctctatggcgaaatgctgctgcccgtatgggtaatggtaaacctggaaacacttcagtttatgactgtgagaaattggttcattacgctaatcgtattcttactaaagagaagttagtagatgaattacctgccacagatatcactgctactgggagatgctggcattacccggggaatggaaagccttatctaacagtgaactttcagttcattgaggtagcgtacaaaggtgaactagataacatagtcagctatagcttcgatgaggtagagagtattcgttggaaccaggtgcatagatacaggattacttactgatgaagataaccaacaaccatgatgtctcgctggccctggctgtatggctattacatgacgagtatgattatgtagacaatcctaagtatctgtctgtaaccacactgcttaagccacttaagcaaatcgtcatgaagcatcgtgtagacctcagtgaccagtcaattgatgttatggattttgtctccacatcaatgggtactggcttacacgattctattgagaaagcctggaagttaggccataagactgcattgaaaaagttgggttatcctcagcgagtaattgatgcagtagtcattaacccaaccaaagcagactttgatgctaaccctgaccttatcccaatctacattgaacaacgtggaaccagggtagttaagggttggactatcggaggtaagttcgacatcgtaacagaaggtctattgcaagactttaagtctacctcaacctattcctgggttgctggttcccgtgatgatgaacacaagatgcaaggtagcttgtaccgttggattcacaacgacatcattaccgaggatgtaatccgtattaactacatcttcactgacttcatgaaacacatggctaatagcaatccgaactatcctgctaatcgtattatgcataaggatattccgttgttatctgtcgataagactgaacgttgggtagaagagaagatacatctcattgaaaagtactgggatgctcctgaagaggaaattcctgaatgtactgatgaagagttgtggcgaacagagccacaattcaaatacttctctgatgcttctaaggtagatatgcctggagccagaagtaccaaaaactttgacgatatggcatctgctcgtatcttcatggctgaaaaaggtggcaagggtgctatcaaggtcgtggaggggcaggttaagcgttgtttatactgccctgtcgcatccatttgcaaacaaagagagagatattttccatcatgagtattgaccttaccggagtagtgcatcatcaggcgattgaagaaatcgtagatgtgctctgcaataaaacccagaacaatgaccggggattcttccgtgtcgaagtagcctacttcttggctaaaatggcatcctgcatgggtgcaaccatcgtaactaaagaccgtggtgacctgccggtaaacatctacgctatagcgttggctacatctggtttcggtaaaggtcactcagtaaatatcatcgaagacgggttcatgtctggcttccgtaaacgctttatggaagacaccatgcccgtcatcgcaaatgatcgtctatggaagattgctaacgaacgttctgctcgtcagggtactgaccagcaggaagagtttgataaagttgaggcagagtataaacgtgcgggagcatatccatttacgtttgactcaggtactccaccagcagttaaacaactacgccataagctgttaatggctgggtgtggttcaatcaatcttcagattgatgaaattggttcaaatctgttggctaacatggatgtactaaccctgttcctggagttatatgaccaggggaaagtaaaacagaagctaaccaagaatactgctgaaagcgttcgtggtgaagaattggatggcaaaactccaactaacctgctgctatttggtacaccaagtaagctactggatggtggtcagactgaagaccagttctatggctttctagatataggatatgcacgtcgctgtctgtttgccactggtcacttagacaagagagcacatgcaacattaaccccggaagaaatctaccgtaacctgattaaacaagataacgtacagactcttggtaagtgggctaaccatttccatagtctggctgacccaaacctatttggttttaagatggttgtagaagataccgtgggtattgctctgattgcttacaaaattgattgtgagaagcaagcagaagctatggctgaccatgaagatattcgtaaagctgaaatttctcaccgttatttcaaagcacttaagctggcaggtgcactggcgtttgttgaccaaagttcattcattgagatgacccaccttaaacaagcaattctgcttgtagaagaatctggagcagcatttcagacaatcctcaatcgtgagaaggcttatgtgaagctggctaagtacattgcttctgtaggtaaagaagtaacccatgctgatttggtggagtctttgccattctataagagtggtaatgcagctcgtaatgagatgatgactcttgctacagcatggggttacaagcagcacatcatcattaagaagaccttcaatgaaggtattgagttcttccgtggtgaaactcttaaagagacagacatcaatgagatgattgtggcgtatagtgatagctttgcttatgactacattggtgaacgtgtaccgttcgaccagttgcatgtattaacccaagctcccggtatgcactgggtaaaccatcacatgaagaatgggcatcgttctgaagaaaatgttatcccaggatttaacatgattgttattgactgtgatggtggagtacccctgcatacgtgccatgaactaatgaaggaatataagttcatgacctataccaccaagcgtcatactgatgaagagaaccgcttccgtctgattattccaatgaactatgagttacacctcgacactgaggaatacaaagagttcatgaataacgttatggcttggctaccatttgaaacagatgagtctgctaaccaacgagccaagaagtggatgtcctgtgagactggttcctatcattacaatcttgatgcgaatctgttagatgtgcgtgactttattcctcgtactagtaagaacgagcagttccagaaccagatgaaggaagtacagtcgttggataatctggagcgttggttcgctagtcgtattgcctccggtaatcgtaataatcaaatgattaagtacgcactggcattggttgacagtggttgggacttttctcaagtacagcaagccgtccacacattcaataagaaactggctaatccattaccagatgatgaattgaatgcaaccgtaatggtcaccgtggctaaacgctacgctggcaaataagtaaacaggagtctttctttggtttgaaggactcctaaattaaacgaggaaaaataatgtccgaagaaatctccaatgatatgaacactcagctaatcctgattgcaggattctcagcgagtggtaaatcagcatcactgcgtaacatcaggaaccaggaacgctggctctatctgaatactgaagcaggtaaacgtctacctttccgtaacaagtttaatacctacaacattgaagacccatatcagatttgggaagcatttgatgttgcatccccaggtggtgaaatggcagacgatgttgatggaatcattatcgactctgctaccttcatgatggatatgctggaatctcagtatgtactgccatctgctaatactcagaaggcatggggagattttgcacagttctttaaaatactgctgcaacagaaagttgttaaatttggtaagccagtaattattactgcccatgccaaagatgaactcgacgaagctgctggtgtgattaaaacattcatcccagtgaaaggttctctgaagaacaatggtcttgaggcttacttctctacagtggtttacgcagagcgtgtagacattaaagagctggagaagtatggcaacaagatgcttgaaattaccgaagaagaacgtgacttaggttataagcacgtattccagactcgcccaaccaagaagtctgttggtaaacgtctacgttccccaatgggtatgttcgataagtctgagacttacattgataatgatgcccagaaactcttagaccatctggctgaatactacgcttaagcgtttgcctggttgttaatcacttattaggaaaaatattatgtcactgttcagtaacttgaaagaaaaaaccaaaaacgttgaagctgtaaaagactcccttggtggtggtggcttcggtgcaaaggagtcagatatctacaccggtactgtaaaagtagcttacgtaggtaaagctgactctggtgcagactggatgcagttaatcattgaaaacctgaaaggttctgatggtaatgatgctggcgagttccgttcacaggtgtacttcacttctggtaattctaaaggcaataagcctacttacgagaagaacggtaaagaatacttcctgccgggatacaccgtcattaacgacatgatgctgatggctaccggtacggaactgcctgaagctgacttcgaagagaagattgttaaagtctatgacttcgatgctaaagcagaagttaataaatctgtcatggttccagtagacctggttggtcagactgttaccttcgccctggaaaaggttctggaatctaagcaggttaagggtgacaacggttacgttgattccggtgaaacccgtgaagtaaacgagattcagaaagtgtttcacccggaactgctggtcacagtcgtcgaggctcaggaagcagagaaggctgagaaagaactgaccccagaactggctgtattttatgcagcatggttagaaaagaacaagggtaaaacccgtgataagaccaagggttctgctggtggtaatggcaaaggtggcttgcctcctaaaccaagtgctggcacgggtactgctcctgctggtggtaaatcactgttcggtaaacgttaatgaaaatcccaattgttggtgcagacattagtctccgcaattggggtttagctcgtgggatgctggacattgagtccggcgtcttcgagcaggtcgaacttaaactggttcaaactgaagttgaccacaacaaacaagttcgaaccaactccaaagatatacaagccgctcacgatttgtttcttggttgtgaagaatggttacggtctgctaaagcagtattcgtagaagtaccagtaggctctcagtctgctaacggtatgaaatcctatggcgtatgcgtaggattaattggtgcatttcgtgcattgggttgtccaatctttgaagtatccccaattgaaaataaacttgcactggtcggtgataaaactgcatccaaagacacgatgattcgtgctgcccatgctatctatccagaagccaactggctcacagataaaaaaggtaaacttctgaataagaatgagcacttagcagatgcaatcggtgcaatccacgctggtgtaaatctcccagctttccaaaaccttcttaatttaataaaggcgtaatatgcaaatcattttgaaccagtccgaagtagaagctgctgtacaggcttatgtcgatgatcaaatcaatcttgctggagacattagtattgtcatcaatgcagatggtacagcctccgttggtattaacgaagaggtaagtcataacgatgatactccacccttggtagagaagaagacacgtcgttctcgtaagaaccctcaggaagctaaacaccgtccggtagaaccggaaccagaagaagtggttgaagaggtaaagggagaagaaacccagacctctactggtggtccgaacaagagttctacgccggaacctgaagaagaagcagtaactgaaccagaagcacaagaagaagttgtgcaggaagaggttaaggctgaagaaccagcagagaaacctgctactaagccttcactgttcgctggccttaaacgtagttaatctggtaggtggctcagaagctgctgctaggtgtggtagtgtttatagtcctgatgctactactggtcaggattatagacgtgtcggctccatacatagcttttatcatcactgtcattatcctgtggaaatgcagtggtaaacacggtggtgacaagccgccagagtaacaacaaccgaaccagtcccctttaatactctccgaaggggattggttcaaacagggttaacatgaacaaatttactattcactggctcaatggaaaggttagttctttcatgggtggagaacctgctgaaggaaaaaaaagcattccacattgactcagaaggctgcaaaatcttaataccgtatgcttggtataaagatggtgaagtagaagcattgaagaagagcagttaatatcgtgaagggttctgttagaatcctttgagataggaactcctatcataacctttcttaacttaatctttgccgtatggcactgacgctaggggtggccccccatccgtcagacagactattttaagaatcggttatcacagaaaatgtaaagcaacattcgggttaatcaatggcctcttcctataggggccatttctgaatcttaggctatatcccaaaggttagtatctttaggataaggcttcagatcccttatcaaactaaccgctcaatgttgagcattctaatcacataagcccctatatgggctgggttaaatgtcggatagcctagctacctacaacatcgaactgttagatcttacatgcaatatagggtataaagggaggattcgtcccctcccccctattatgggctatcggtgagtgcattagttgattagctgtggaaggtaggccgatgtccacaagcgtggcccagagctagtgtactctccgatagttttcgtaagcgattatgcggttttttagaaacgaaccaataacataagtgcaaacgaagaagcgtatctgatggcagcttaataagccaagcgtcagtcaggagtgagtcgtcctgattatcaaacgaccgtggagttctcccgtccatgtattagaaacgggggactaattatcagttgcacgagatggcttgacatgttcaagtttggactaagtgtgacaccgctagattggagggctgctgcggtaagctatagactccaaccggaggttcgaatccttcactgataaccaattcaaagtagcattgtatatttaaatgtttcccggcatttaaagcacccaccgtgacagtgctactctaaattggaagaattatgggggtaagtcgtaaccatacgacggcgtaagtaccagatgagacttctggacgcccctaccatatttgaggtgtaacagttaaatccagttgccggaagtgcaattctagatacgctgccaatgtgtgaacggtaaggctgtacaggactcggactcccacctcaaaccaaagtcgccaggtacttatggcaaacgggtagtaacgaactagtcattcgtcaaacgcccaacccaattatgagtcagcaagaacgccttcacttaaatttaaacaaaaaagcttaacgcaataattatgtaggggtatgtaaggattgcgaagaaggagccagttagagtctggcatgactcacctattaatacccggtaggcttagtggtaaagccccactagtaaaccaactaggacgcaggttcgaatcctgtccgggtaaccatattatgtccgcttagcttagactgggaaagcaaccgactaataatcggaaagtcactggttcaaatccagtagtggacacccatttagcagtaacatagtcctgattgcatcgcactctaaagacaacactggtaagacagtccagtggctgctattgtattgttattcccttcgacgggaatttcgctggagaatgggaactccttaaatcctagcctgagtaattaccacaggaacgggactatcaatcccaagcctggtcagcgtggactgtcttcgtggtaagaaccaaaagcctcccagctatgggtaaatagtactaagtcccctggagccgtcactctgggggacttttttatttgagtattaataattggataatcaatatgattgacctaatctcaaccccgtatgcctatgaggtaacggataatcgaggacgcaagtctttggtgtttgcaggtagcgtagcctataacaacgcagtcatgtttaagtacaaactcaaaccactctatgaggctaataatggcaacagtaagtaaagaagcaatcgaagctaagattaagagcgtctactattttaatggagctgatgcagtgaagtctgcatttgttgatccatctgcactcccggcagatgatttggctaacctgggtctgataacctattgcattatcatcttggaaaatggcttcaaagttgaaggtgtatctgcctgtgttgacccagctatctatgatgagcaaaaaggccgtcagtatgcatatgaaaatgcattcaataagatttgggaattagaaggttacctgctacgtcaggcactgcatgagaaagaagagactgctaaagctctggcttcctttgcagaaaacaacacctgtgatggtggtggttgtacaatctgattcaaaagtgtaaggtagtttttaccgaaaggtactgaactacccgacatgtggtaaggctcatgaagccaaaacaaaacaagccctcctagtgagggctttctcatttgaggtagttatgtcagaagaaattaaagtccattttaccaattatatcggaaccaagtgtgtaaatggtttccgaatgaacaaagaaacatactgcaaacttcgtggctgggatgtacctgctaatgaagacccattagaagaaggttacttagtagagtacccagactctaagtctaaccatcctcagttccgtggctatattagctggtcacctaaatctgcatttgaaactgcgtaccatgacgtagaaaaaggttgcacctttggtcatgcagtagagcttctcaaatccggcttcaaactagcacgtaaaggctggaatggtaaaggaatgtacattgagtacgttgctgctcaagaatggaatagcagtagcttagagcgtacaggacttgctgatgaattgaaacctcgtccatggttaggaatcaaaactgttgatgaccagtttatgccttgggtcccatcccaatcagatatattagctgaagactgggtgttagtttagtaaaaattaaagcccctctaatgaggggctttttcatttagttagctagattgagccaagggttaaggttatgggcacgaagtccctgaccgaagccccaggagtaaccgagattgccttgtgcagcaatactgaagatgttgtcctgaataggtaaaccaacattaccaaacatggtaggagttggagccaacatagccatagctgcgtgtaccgggttgttacgaatcatggatactgcaatttttgcagaacgaatcttaaagttatagaaccacataagaccaacactttccatatacccacggaagcgaccaggcagacggtcatagttaatgaactcttccgttacacgtccaagtgcttcttcacgagtcttacctttacgctgagtcaaatcatcatagatgattgctttagcaataaagtcagagtactcaaccgtcttctggataccctggaataaagcagtatccttggtgataagggcataacgtccagcattacgtacagacttaggtaacttatcagccagtttatccatgtattcgtgaagtttaccttcagtaatcaggatgtcatctcgtccaataccagcatctgcaattgaagaaaactcaccagcttctaacagaggccagatactcatacgcttatgactatcagtgatggactgaatttcagccttaagcttacgaatctggttcgggttagtagctgcacgtaactctgcttctgcatctacctgacgcagacgagatttcaggtactggttaatctcagcagtcttctgtggaatgctcttagcaatgttcttaacaggtacaccacgaccaaccatctggtaaaggttagccaggaagttaacagcaggaacaactactgatttaactacaatcagagtcttagcttctttaactaagttttgaaccaggttctcaccacccattacatacttataagcacggttgccgaatacacccaacatagctttcttgaaggtatccagtgtttctggtgaccaacgagaattgccagaccaggcatcacctacggaagctgcacgatagcccagtgcatcattcagcatgtcacgacgtacccacaactcaccaggaccaaacagactttctgctttctgacgagtttcactgttcatcagcttaagggcatcagcagttactgggtccagtttagaaccaagaaggttaacgtactgtgacttgttagaggcagacattttaatgtcgttttcatacatgctatgcaggttctcaatcagcatatcattgaaacgctgagccttagcttcctctacctgacgaccacgccatacaccaattgcacgagcaagatggttctcaccctcaatgtgcttcagcatgttagggtcaatagattgctcatatgcaactacattacctttgtcatcatatacaggcagcagtggttcattaccacgctcaccacgagccagtgctttagtgatgcggtctacggaaggcttgtcagtgatacgaccagctaccatagaacctatcgtaaagcctgtaccaaggtctacaccgccagcagtattgcgaacgttctgtagaataccttgtgagaatggagcctgtgcctgtacaggtgcgaagtagtaactacgtgctggaccacgactagcagagctaccctgataagtacccagacgtacataagacttctcaatcaaatcagcaaactgactatcttcagcaacaatcaggttaacaccctgtttagtctcaccaggaatgtaacctttatactggttcagggttgcacgcatgtcagatttggctttagccatttcatctttacgctgtccaaccagataagaagtagcaaaatcaatcccatcagcttctgattgagccagtgaagataacatctcacggtcagtcttactcattgcttccagtgcatacagagtaatcagtttatccagttgagctacatctacagtagaacgtgcagcctgtcgttcacccagcatacgagagattgcagtagcattacgcagcaagttattaccaactgtgccattaatcatgtactgagccagttgcttagatttacggctaatcaaaggccagttacgtcctgcttgtttctgcaaatctgcttccagcttattcacttcacggtcaacaatcttttggtcagtcagcaagtcacgaatttcacccagagacatagtgtcacgcagaacagctaagtcggttttacccataccggtatgcattgctttccactcatcattagtaagcttacggctgaacttagatgcaatagtggtaggcaaatgttcacggaactgctgacggtcagcctgtacctgtgcacgcactgctttaatcaaatcatatacagaagcattgctcttagtacgaccagttaagtcattaaccaggtcatggaaaggttgccataccttaccctggttcattgcagccataacaccctcagctacgattgcaccatttttctctgtagcaatagcagctattagttgtgcagcatgagcagcacctttaaccaacgggttcttggtattagctgcaacttcacgagcaccctctaaagcacgggtagacagtacatcaatagaatccaccagatactggttagcacggtcgatagcattaccactaggagtagcaatggaatcatagaaggactgtgcattgagactcgtctgcatgattgtctgagccagtgcatccataccttcctgtacgttggtagctttagtatctcctgctacacgagcattcagactagccattgcagcagtaccgatgttagtcagcattgcatcagcggtattgccagatttcttgtctactttcataacaggaatgtcagccagtactttacgcacttcttcacttaccattgccagaccaacaaaggtaggcagtaaggaagaacggccttgtgcatcaaactcaatgttgttagcacccatgatggtatcgaacttctgctgtgcatagtaacggtcagcagggttagtactatctgggtcagccatgaatgactcaacggtcaggttcttagtaacatgtgtgtagtattcctgtgcacgagccagagcagcaggattaatagcagcttcagtagccagtgcagcaacaatgttagtaaagagacgttgttcctgcatattcatagtgaagccatgagcctgaacatcacgagttactttagtcgcattaaccactgcatcagagaacttacctttacgaattacttgctgtactggttcagaaccaatgtagtctgtaatcagtttatcaaaggttttccctagctcttccagacgagtattgtcaccatatgctttgttatggaacaaagtagtatctttggctacagcagcagtaggtgcttgaccacgcataactacagcagagttaaacagtaagcctgagaacatatcatctgcattagccggagctttcttacgcccgaataccagacgtttgattgcttcatatacagcctgaaccatggttttcagtgcagtggttttcttctgcttgctaatcaattcacggttggttaaaccccaagccatgtactcgttaagtgcagcagctttagccattgctggttcaatgaagccattagacaaatgaccattaatggtattaagagcatctgcatatgcttcacgtactgcaggagtttcatccttaacatccagagtgcggaactggttcatcaggtcttcaatgttctgaactgcttcattaggagtaccttcatagtgagctagtacagattcaaaagtagaagcatgcaccaattcatgaaccagagtctctaaggaaggagtaactaagtagatggtcttatcttcaaagttagtccaaccgtatgcattacctgcttcagcagcttcaatatcttcaggtgctgggcgagtaatgttcttctcaatagcgtaagcatccagttgaaaaggggttccatagacaaccttgtagtctttagcagcaagagatttctgtacttctttcaatactgcttgctgttccggagacatctctttagccagcttagagatagcagtattagatagtagacgtacaccagacttcagtactcgaccaacctgttccattgccggtgcttctttcactggttctgttttagcagcacgtactgcatcacgacgcttgtttaactcagcatcaaacagttcgttcagcttagctacttgctggtctacagtcagaccttccagagagattttaccgttgttcacataaggagcaccaacagcagccatctggtcaacagtagtctgtacctggttcattactttgtgacgaatatctacacccagagcaatattacgcaggttacgttcaatctgttcagcaccaacacgtaacaggtcatcggtagctccttcacgctggtcatattccagagcagatttagcgatagcctgtttggtttcatcagacagtttgctgaagtctacactcttcatgaacttagcgaaggagtcataaacattcttgatagggttaccctgccaggaagtgtatacagcctcattagctttacgacttgcatcagtgatgttgttgataccaatgttcataccatcaaagattttcagggtattcttcggagcacctttcatagtagaaagggtctgcatcatcatgccatcgccagtaccaatggtcataaaaggaatacctgcaacacctgcctgtgaaggagcatagatgctcattggcacacgcatacggtcatctaagttggtagccagtacttggttagcaacatcagtgttttcactaccggcaatgtagaaagtctgtgaaccagtctcaatcattggagctagtggggataatgattcctggatttcattcagttctttctgtgttaagaaatcacccttcttccaggttgggtctttttctttttctgccagcttagcctgtactgcttgttggaacatgtcttgtagaaccaaagactgaatctgggtagccttctgcaagttctcagtagaatgcatcagaccttccccaacagtattccggataccagtacgcattggttcaacgaacaggtgaagcatgttctcttgtaagttcttcagggcattacccgatatggtaaacttctgagggtctaacttaccagtcagagcaccttctacctgttgaatagacaattcacctttacgcataactggaacattaccagtcagtgcttccatagaagtaaggaaagtatccagcatagcctgagcatcagcctcagacgcagcctccttaccaaacattgccatagctggggaaatactagggtcagcagcacgagcttgcagaacatcactgaagcgttcatagatggtatcagtaattgcactaaccatcttgccagcaataccacgagcacctgaaccatagatggtaatggtcagtgggtttttagcgataccacgtttcaggtccagagtaccgtcttcattcaggttaaagtctttaataaacaggtccattaacttctgaagatgattcatttggttcataaccggaacgttgttacggtaagtagtacgtaactcattaagtgcttgttgcagaccattggtagatgcttcatacaggtcaacactgtcatcctgtgaacgatgttcattcatagtcttaccagctttaccgaagaacagaccacctttagcagtattcttaatccagtctgaagtgaacttaccaccagtcattaataccattgcgttgattggtccgttggttacaccatcggcttcaacgtacagtggggtattaaagttggcacggtcatcactgttcaggtaacgggcatattccataagagccatgagagctacgaatgatttatcgccacccaaagaagtcttcagaatatctactgcatcagctggtaagtggccagacttatcaaactcaaccatcatatcaacagcaggtttcagattaccttccagagctttggtcagcttttcagacatagcttcacgggacatattatgtaccttgatacccaatgcctgagccagtcctagctggaagtcagagaatgtttggctgttttcattactcaagtcaatagtagagaaggttggcagaattgcttcacgaaccagtttactggattgtgggttgttcttacctaacatctgcatacgacctacacgggtcatgttgtaaccatagtgaataggcgtatccagaccattctcctgttcctgtaactggttgattacaccgaacagggaatcatatgccatagacactgacaggtttttaccctccagtgacttagcagtgttcacgttcagcagttcaggattaagagtaccagcacccatcagttccagaatgttgtcacgacctaatgcttcatagaagttaaccatcggcatgtgtacacggaactcggtagcctgttctgctttaagagcagctttctgctctggggtattcttaacagcagggttacgtaactgagtttgagccacggaaggaatatcatcaccaaagtacattttctcttctggttctacgagaacagcttcctcgatagcagtaggaaacttgttaatggcatcgttatcatccagcttctcaatggtatacagaccgacggtcttattagagtctgggtcaatctcagacacatcaagcatagactctttaacttcacccatctcaatgagagaagacagaatctctgtagccattgccattggaatacctttggtataacccagtggtgcattaggattacgattcaatccccagtaagattcaatcttttgagccagtgagttagtagcttcaaccagagtctgagcattctcaaattcagccaggataccttcaggtaacaaggatgcttctactccagtaatagcagctacatctttcatgtctttaacagcagcattctgtgtagcagtcagtcgccattgcagaccagcaagtacagcagtctctaacaactggtcattgaacttaaaggtgtctccgtctttctctacgatattaagtaacttaccacctacccaacggttagcctctgtgccttctgcaaagcgtttaccaacgttcttattagcaagaaacttagccagacgatcagacagagtagtcttcagagtttcaccaaagcccattaagtcctgataacgcttaatcacatcacttgtgagagcgttattttctttttgagtgaatgcttcaaagcgtgcagtagaagacagtgcttgcttaatatcagtcaaaggggattcagaaccaatggtgcgagacttaggttcttccggcagggtaaatgatttcaggaactggttcggtgtcttgtcattgttatagacagggaaaactgtttccattttcgttttagtttcagctactttttgagtggtatcctcattggtgagggtagcatctactgtttcagacttagtagtagagacttcttctgcttttgaactagcctctttaacaggaacagtcttattttctaccactggtttagctttaggctgtacagtagtagtagtctcttgcgctggtgcaggagtttcatcaacctgattcactggttcattggtctgttgagactgagtggcatcaagaccaccttgacggaactctttaactacctgggcagcaggcttgtccagacgtgaatctaatggagtaaccttcacatgagaaacattaagctccgggtaagccgtagcaagtgcgttagcaatatcagctacggttttggcctccagtcctacttgctgggcaaacttaaccgacttggtatcatacggattgacaccaagaccagtacgactacgtacccattcacgggagggagtaagagcctgataatggacagacttattcttatccgcattcccagaaatcagatgctcattcaacgctccgaccttattctgcatgtgctgggcgaacttcataaagtcgtcgaggtaagcggaagccaaatcgaagttaccagagttgtacgcagaacgaatgcgtttagcatgttgcaacgcagagtactgaccttcattagaacgagactcgtcggttttaatctgtttactaacaatgtcttgaggacgtaagcctagttcttctgctttagcgtcaaattctcgtgctccttgcaatagagcagcagcagattgcagggcagcacgctgatgattccccagtgtaatcttaccttcacttgcatgtttcagaaccatgttcactgagtctgcatccagtacttctggagacatatcagcagccatagcaatgttgtttgcttgggcttggttagcttcttcggtagctttcagtttacctgcttcagcctgttcctgaatcatagaatggatggcacggaatgcacgaagtacctttggtgtattctgaacgttagccatcaggccggagaactggtcaacaatattagcagcaggagaaccctgttccagattagctaaagcaccaggatcacggttaatgaagctatccatagacatgatgttgtcatacatctggattgcagcttccatttgaacgttagggtcttcggcagtattaaccaggtcagccatcttctgaatagcttcaacacggttagtggaaccagaaacagcttcacggattgctgggttagcttgttccagttctactgggtcaaatttcattgcctgagttaagtcagcagcatactgagtagcagcagctttctcttcaggagaaatatccattgcatctactgcttcttgtacagttgcttgtgcttgttctgcttgagcagtagcttcttgtgcagcagcattaaccgtagcatcagatacaggggaagcttgttcattacgcttagcaacttcttcgccacgctgaaccaggatgttagtaataggagaggcagcttttgctaatgcactaccaaccagagaagcaccagccagagtagtacgtaaagcaggcccagcagaagcaccaacagctttaacagttgtacctggagcctgagcaacaccagcactaccgaagccgtagagtgcaccaagacctgcttgctcaccgacacctttaagcaaatcacgcttagcatctacattaccctgaattgccttgttctgtgcaaactgacttgtaccagactgaataccttcttctactgtttcacgtagcatgttagaaccagcaccagccagcgaacctaccttaagtgggttaagttcaaatttggataccagaggaccagtagcagcagcaaccggagcagttaagccagcagcaatgatacccgtttcagatgcagtttggcgacgtgcttcatcaggagataaaccatcagcgatatgctgttgataaacaggagacttacttgccaattcttgatgggacatcttcatgatttcggaagcagtctgttggtatgcaccaccagcttccataccaccaattgcaatagcaggtgcagcaacacgaccagcagacaatgcaacctgtgcaggacgtgaacctaactcagcagctaaggtaatacccttaacagctttatcaccacctaccattactttaccgagtgcagatacaccacgaattaatggaccaccggtaaagagagaaccaacaccttcactcagcccatcagtagcagccataccattatcaagcgtattagcaacagaatcaaaagcatcacgaccaatacgagacagagaggcaaccaaactgctctctccatttttaatgtcttcttcgtagagtttctggttcttttgtgcagaaatctggttctgattctgaacaaccttacgggtagcattcagagcatcagactgtagattgtgtaccccttcattcagccaatccataccggaagcaatggatgccccggcattatcattgaccagacctgtgccaagagcagcaatgcccccaagggtattagcaacaccaagaccaacaccagaaagagtatcaccaaatgcttctgcgttagtacgttgtttagataagtcctgacgtacagcatcagcagcattagcccggctattaagaatctgtagaccttgctcattaccgtatttattaagaatttctaatggggaggcttgagtgaaatctgcctgaagtgaacctggttcgaatgcaccgattccaagattacctacacgaccagtttggagattgtaagcattctctggggttaattggaaagggctttgcccttgtgcagcttgcttctgagaggttgcagtagagacatcgacttgcttagcattagtgatgctgtctgcgaaacctgccagacggtcaaatgttgacatagcatgtttcctgttcaaacttatatcgtatatagaaagcttactctacagtaagccagtgtaagaaaaaagccccgaagggcttttgttagtattaccgattttgtcttggttgcatatactcaggcaaaccctgtgcctgacgtaaataccgtgcagcacgttcttcatcttccttggctcgtgctctgtccacactagcctgtgaccggaaacctcttggagccaggttagatgggtctgcttgaacttgtgcttgagcagcttgtagcattgcagcagctttagtaacagcttcctgacgagcaggcaacaatgcagtaagtcctgtttgtccggtgttaatcttgttctgggtatttgtcagtgcagctacagcagcatcataagcagtctgtgctgcctgaatattctgcatggcttgagcacgaccaaggttacgcacactgccttccagtggttcaccacgttgtacaccctcaattaactgatctaccagacggtcattaagacgcataccattaccagcttcattggtaatgaatgggttaaccgcatcaatagcacggctaatgtaaccttcaggtacaccagtctgtgcacgttgcataacagcagcagccatagctggagacatattcccacgttgagaaatatcagttaatcggttaagtacccagttacggtcagcacccttaaagtcaccatccagtagacgattagcaatctcacctactggagtattatcggtgacagtacccaggaaatcggtattaaggctaccggtattatcctgcatagagcgagtaccaatcataccctgagccaaggtagatactgcctgatttccctgattattctgaagcagagagaatgggtcagcccctacttcagcttgggcaataacaggtttaatctgttcccaagtcatatccttataagcacctggggtagagttaggtaaagcagcccaggtatctttaaggttaccattcttacgagcctcaaaaatagccctaccaatcttctcctggttctcaggggaaagaggttggttctgccaatctgaaccaagaactttgggggcaaagtctttcaaggtagcttggttaatctgaaatgcaccaacaggagaagcaccctggttcgacttcataccatcctgatgcttgattacatcaccgatactcatttgagtaataggagtggaagtaccagcaaactggtaagtaacatcataaggggaaccctgtcgagtaccagcagtaccaggagcagatgtagtacctacgccattaccgtatacacctgggtaagcattagccagtaatccttgcaaacgtgcctgagcaaccggagacaggttcctgctatatgcctctgccaacagacgtgcatcattgggattctcagcaccccgggtaatctgtgacattacacccatagctgcctgactatcagcatcattacgctgagacacacccaaatcaaaacggttctgtgcttggttaatagcctgaccaccttgaccttgaagacgtcccatcatctccagttgctggtcagcagggagtgcagatagtgcctcacgggtctgccccaatgcagcattaatacggttctggtcaccagactggtaggcctcggacagtaaacgaatagctggggaagcactatctaatgcagcatttgtatcctgtaaacgaccaaagagataagcattatagtcattggttccctgctgaccttgttgagtcagaagagtacctgctcgctcatccagattctgtagagtacgctggtttaccagtgaagggtcaaccccctgaaacagtgcaccagatgccaaagcattacgatactcagtagggtcttgatactgcatagcattcatcatgacggcattgccagcctcctgcttggcagcgttctggaaattacccagtgcatcacttaagccggaggtggcgttacctatcatgctaccaaatgtgcgaatgctgtcaccaactccagagaagttaggtgcatcaacattacgccatgtaatttgagccatgatggtttcctattaacgggttaatttattagctgcaatataagcatcagcagtagactggtcacggttctctgctgtagcacggctacgagcacgatcttccagtgcagtgttataagacttaatctggttattcaggttagtgttagtaacactcttagtaaagttcaactggtctttggctaacttattagcctggaaaccactgtagatattagctaatgaaccaagtgcacccagtcctaattggaaggtaggtacattcaatcccaactgatcagctgaaccagacaggaaagaagcagggtaggctactcctgtatttgcccccataccaatagttgcacctgggttatagttcatagccggggtattaaagttctgattgttattagacatccaagacatagcagctggctgtggagttgggttgcctgttaagaatgacaaatccatggggattctcctgttaaacaaggtcagtattaagagtcatatcagagtagttgccaaccatgtctaaagacaagtcagctatatctgaaccagtcatgagagtacgtgacaagaatgaatccaacgactccattgacacgaattgcatggggtcaatcacaccctgtccagcagtaccgaacatctcttcatactgcttattgattgccatcatatcagtattgtactgctgcattacactctctgctttctgaatagtagcagccgtggatgcattaatatactgactaatgccattacccactgaactggtaagttgcatgatgttttgagcactcatcatttcaccagctaaagaggataaggatgtaccagtagacaaagcagtaccaacgttcatggctaccattgaggcaatagcagcaatgataaaacctagcttatcaccgaacagtgaagtagatactttagtaataatggataccagaatcattgcagctatggcgtttgctacagcaccaactattacagcagctaatccaacaaaaccaagtgatgcaccgactgcaccgtatgccccaagtatacctgcaccaccagcacctgctgtaaatacagagacaactacagctaccactacaacaacaattttaaatgccccagtctgataccacttctgcttaaccttcttatatgagttcatcactaagtaggagcaggcagtggataactgagtgctacgaaccagtgacattgaacggtagatattggtgtgcagtggaataatgaatccactctcctctgcatcacccattgcttcggcaacatcaatgtgcactgacttatttttatataccctgttgttgtgatttagacccagtactctaagtttacgataggtattattaccatcctgccaaagcaactcgtattcctgcattgaatagaatgtgtatgttacctcaagtttcttagcagaaccggagttggaagctgtccttatgttcttacgagtaagggttatatctcctgcatacctggctcgaagttgcccctgcttagcaccagaccatgcttgacctgaatgggtagtttcagatacatagttccagccaatagtcatgtcgtacttgtactgcttattactatgcaccctaaactctcgcttaggtataactgggtattctggcagtggtggaggtgttccaataatatgcccttcagtcctgttccaccattccacatatgtgtcaactgcatcatttgctgcctgatagcctgcaatcactgcttccagtgttgggtaggttgggtcaggtgggaatgcttcagtagccatctgaaagaaacgatagatgtattccttagcactatcctcgggggtattaagggatacaccaaatgaaccatagatgtactgaatatcacctatgtcatcattcttcttaagctctgtgactactttatcaatttttccaccagtagctttataaagggctttcttacagtgtgggtagattgggtcattctctacccattgcttatcatttctgattggaatgaatgggtagaatcggttatcagtagcttcagtctcgaacaaagaatctagtgcaacgttaccggagttctgcttataaataagcattttaggtgtactaacagcagtcatctcggtatcagtacgggtagtctgggatgagtacttacgaaccagtgtctctgtggttgtagtgattgtatctgtacgagtaacacctccacctatatcaaccacattagtagttacagaagtactggattgaatctcaccaaattttgtatgagtcattaccctgtcagatacaactacagtcacatcatcaggtttctcagtgaatcctctacgataaactttaacgtaagagttccagttatccacacttggttctgtgacagtactgtcttcatccggtctgccatcagagtaaacagaatgagtatgtatagtcttagtaagattggttgtgttagccgtcgtatcacttgagacggtagtccataacaaagtggaaggtaagtcatcctcatcatcatagacagtagtcggtcctactaccggaggattagtagaaggggacttatagaatgagtaatcagcatagagatataaagcacctggttcaaagttagtaggtgtgaatgtaatagtagagcctccatctaaggaggtcatagtgatttcattagtatcttcatcaatatctatgtcgaatcgttccatgattcgacttggagcattctcataaagatactggtcacaccattgctcaaagtcagcaaagccaatctctgctgcctgaacatagactgattcaccagcagggggtgtaatttgaccctctataacggtagggtcaatcttagccaatacacccaatgaagaaccagccataccaactactgaatcatagtggttcttactccagctggagaacagtcgcatacgaatacctggcccattcagataactatcagagatagtatctgccatagtgaatcctgtattggaaacaatattacctataactacagtcttcatatagttagggcgtttatgtatatcccctgccatgttatagacagaggatgctacgtatactttggtcttcccactgaataagcccatattagttcagcccgttgttagacttcagcttggtcagaatggtgtcaatacttgcgttagtgaaaccatttggtggattcaagccttcatcaatagtcttctgagtaatccatgcatcagtaaacagcttagatgctttaacctctgcatcacgttgataagaagtaatctgttgtgagtacaactctttctgtttacctacagaaccagtaacagtagctccatcactacgggtatcaagtgtctgtgcacgttgtgcttcagtctgctcagtaagcaatttaagctgttgaggtaacatctgactaacattaaacaatgcagcacagtatgtttcagactcagtagcaatcttcatcttagtaagagcatactcactcttagcagacagtgcctgaatcttagccagcacaaactgtgctttaaacgttgccagttgaacacgagcagtaactgcctgaatctgtgccatagcagcagcccagtatgcctggtcacgaccaagtaagaactgaacagcattgctcatgcaagattccatcatagcaatgtatgctttggtatattcaccaccggtaatacggttagctttaaactcagctttcagatgattgtgtgcagattccattaatgcatcaaacgtaccactaccaccaacttcacgggtagtgagtgattcattggatattttatcaatagcaccaaagattggggaagcatccccaccagggatatcccattcggggccagtcatatcaacatcaggaagggtaaagtcatcacccttagttaactcttctaggagtcggttagcttctacctcagcagaacaagacataatcattcctcttggttcaaaaagaaacggcccacggagttaccccagtgagccgtgttgaactgtagcttatacgttaatcgttcaggctaccagcagcaatctgtgcctgagctagttgagctaattcagcttcagtcaacggaggcagtacctcaatggagaactctcgtgcttcagttgcacgaatatccggtaagccattcttacctttacgggtcgtaatgttgatgaacttacgctctttaaggaactcgtagatacaatacggaatgtgataaccattgtcggttacttcaccgaatggaacaaacttacgcacagtacccatatattcgttagctacggtgataatctcacctggcaggtctttcttcttagggtcaaggttctggatacgtacacgaatcagtcgagtctgttctgcacgaatcttttgaccaagagtcatcttcttaacaccagcttcctgtttttcacccagcggattaacggcagcttcttctactactggttcatcttttacttgtgcagcttcaatcttctcacgaagcttttcaacggaaatgttgttagagaacttgatattcatcaacgttgcacgttgcttaagaacttcaagttcgctaggcattgcaatatcgttaacggtatcttcgttgccctgtacgttcacttctacgtcagtggtcggtttatcgttaatgctcatgttcatatttcctgtggttcattcagttttattaagagggggacattagtcccccttgttttatttcggactattacagaggagcaacagtcttaatcatagccagacgttctgggcgtttaaccaggataccgtagtaccacttgatagaactgaagccagtttcaccatacgggtcattacggtcagcagtttctttaccaggcatcttagtcatgatggagaacttaacagacttaccatcagtctggaagccaatggtagagaaggagtcatcaccaactaccagcatcgggaatacgtcgtagtgttcctgaccaccaaccatagtagaacgatagcctgggttagaagtagcctgagcaccagcacctgcccaatgcagcatctcaggaacctggataatacggaacttgtcgatacaaccaacttcaccattcatcagagtaccggcatcagcatagtgctgaatttcgatgaatgctttgttaccgaacagatctttcatcgctttcagttctggaaccaattcagaaccaacgtacattacacgagtaccaccaagtactttggtatcagtcagtttagaaccagtgataatagtagtctgagtcggggtacggttctcagtaagaatctggtcaagacgcatcaggttcttataagaaactacagacggagtagaaccttcaccggtgatggtagcatcagaagtagcagcacctgcatacaatacagtaccagcagcagcaagcaggtctttctggagaacagcttcagtcagctgtacagcaccgttcatcaattcgcgagacaggtgttctttcagttgatcatcagaatcgaagtccagggactcttgggtaaattcgtagaagaaaccgaacttatggatggagccttcacgagacagacgggtaaagcctacacggttaacacgaccaccgttctctgtcagcagaggcagtttggaagtgatgttaccaacgtctttagaagaaccatacaggttaccattaacgatggtagcaccattagcatcaataccctggtcgttaatgttcttatcgtcgagcagaggaacgtactcatacaccttaacagtcttaccgtagttcttcggcatgttaatggtgttagccagtggcatgaagtactggtctttacgagactgaataatagctttcttcagccagtaaaaggtattcatctgatcggaaccagcaccatcaatgctagatttctgaccgtcaattggagcgttatagtttaacatatcgtattattcctgtttaaagactacccggtactgggagtttagcgaaatcttcatcactcatagcgagtgggtttacaataggtgttgctttgcgtgtagcagcccgattaagggaagctgctttagcttgctcactgttagccagagtctgcttaggttgtgctacacgcactaccggctgaactgctggtttaactgcttgtaccggctcaggcttagctacttggttaaatgctccctgttgtgcaaggaggttgccaacgtagttataagcctgaatgaacggagtacctaccggaatctgacctaacatctgaagacggttcacttcatttgcaatggtgtcataaataccattctcacgttgttcgtgaatcgtatggagtaagccacgattctgataaagagcatctttactggcagcatcccatgtcgagccaataacacctaatgtagcttgtccttcttgagtagactttaagtcgtcaatttcggttgcaaaatctgcttcggtgtcggtaacacggtgattgccaccctggtagttaatttcctcatctgggttaaaatccagagggtctgtaccagagtctttgagcaacttcttaatggcctcaggattcttcttatccaggtcaatcaggaaagagagtttgtcctcatccattaaaccgttgttctgtaacatcagcattaccttacggtacggctgaagttcttgcatcttacgagtatagttagcacccatctgcatcaggctaatggcctcctccggtgaacggggagtaatcattttgccgttagctttaaaaggagccatcaacttctcataaccttccttatagttgaagtcagcaggcagaccttcagactgtttgccttcttctttctgttcctggccgggttcagtagtagaaggttcagctttagtaatcggcttaccgttactatcaacttctgtgtcaacaactttatcatcaactttatcagaagttaaagaatttgctgcatcttcttcaactggttcggtttcaggggaggtttcttcggttggtaggtcttcaacagcagaggtgtcaacttcttcatcaggagtctgtacgccgttggtttctgggttgttctgagtggaagtatcttcctcagcgataactgctggggcttccatattcagaatctcatcatccgacattgcgagaatgtcggaagctgtggttgcagcttccgtagtcataggaaatatctccggttaattattcatcttcaggttcagcacgaactgcatcgagttcttcttctacctgaagaataacgtcagcttcgttttcgcccatacgaatggcgaggtcgagccaacgacgtaagtgaccagcagcttgagccatgttaagtgcatctgcacggttatttggttcaagcagtgggtcaccagactcctgcacgtaacgtgcacaatcttctacacagaactggcgaagaattactttacggaacagtggattctccagaagtttacgtacatcttctgcgtgtgcaactgcacctttagcagcttccagtcgatgttccagtccagcgattgttgattctttactcatgtgaaggtctgccttacaagttcatgccaagagccgatgctgggtcttggctagggtcatagaattgggaactaagtgaataagctgggtcttgttgtgcagctaagtcacgttctggtatagagttcccgttagtcaaagcgttatatccaacagcagcagatatgttgggggtagtttcaccttctttagtaggtgttgtcaacgccttagttatctgaaggttttggtttccttgggattgtgctttttgtttttccatatcacgagcatgtttagtaccagattcctgttccagataatccaggtctttaaggtcaccactagaagcagcttctttagctttagcattattgagtgcaatcttactttgtaactcttcattctcaagctgtgctttctgaattgccaattgcttaagctgttcttccatagggtctggttgtggttgccaagtacgtaactcatgagcaaggtctggcatacgtttaagttctgcaatcttagctacaagagataacgtaatagactggtcaactgtgttgcctagtgtttgaaccatgaagcccaaatcctgggacttctggttatcaatttcagcagtgttaatatcaacctcaatgtcgaagttacctttaaggtcttcacggttaatctctacatactgttcgttagtaatacgtactacttccttctctgataagaacacagcattcattgcacaaatcttagtaccaatgtctgccatacccttagctaatcgacgaaggattgccatctcacgtttagatgctgcatcaagtgcaccacgaatgccagcagcaacatctccgtaagctgaaccagttacgccgccagagaatgctttaacacctgttagagcttctgcttcctggttttgcatctgagtcattactattgcagactgaggcaactcagggaacttgtgttccataatagactggctaggatttccctgcatcggattatattcatagtcttgcccatcatcatatcgacgacggttcagagtatctaacatccctttaggataaccacgctgaccatttgcacttcggcctaacaggtcaatcattccacgaatagttgcaccaaggattgcttggttatctcccaacagttcagcatcagcttcaccgtaaagttcacgtttacggggcatgtagggaacaactactaatggtaacttgccatcagggaatgggttcttctccatacgaataagagtagaaccaatccaggtagcaacaattggttccagtgaaccatcatcattaatgtcatagaatccccagtactcataagcaactactttcttacgaagtgcatccttaaactggaagtcaccaggagttttgctttcatggtctgggtcagtaatgggactggaactctcccagtcaatcttatccagattgtgataacggtctttgtttttcataaggtctgctttgcaagtctcaaaggagataactgcatacagagccttatccaaatcaccattacagcttgggtcaataactacgttattagggttaagcatctcaacggtaggtctgttaaccagtgctttttctacttctacttcagtgacccctgtctgaattgcataagtagcttctccagtttcattgaagtagttaacagcttctttgatatcttctggcattgtttcgtcatactcacggggattctctgcctgaagctgcaaagcctgttggagaacatctgcttgttcctggttctcaattggatacaactggaagactggagtttctgttttaatcttaatagtcttacgttcccaaccgatacgagcaataccagtaccgtcatctacgacactatgcacgtaatcatctaccagttttactttattaagctgagtacggaattggtagttaagaactagctcattctggcgtgcagctaactcatcttcaaaagtaaccggagttaccttaaatagtttgttagacgagaggaatggttcagacaatggagcataacgccactctgcctgacggcgaaccagtctaggctggacttgcgagcgtcccttaacctttgggggtttagccttaccctttacttccattaaatcattccactcacgaatctgtgccatgattgcatcgtgagcaggtttagcagattccaaatcacccttcagtaattggatacttggttccttcttccagtccgttaacttctctgattgagccgggtctggtaaaggcttaaaagtgtcttggtgttccatagttattcctgttcaaaaagtttacggtcagcctgaatctgtttacccaactcaattagttggctgtcacggagtctaacagttgcccggagttcttcaaccaaacgtctgccttcttcaagactattgtcgagtctggctgcatggcttgcaagacttctgcactcaagggttccggcttcggcttgacgtttatataccgatgctcgtctttcagactgttgcatccggctgtcgtaatcactgctaacgcgagcaagctcgcttgcgtaattactctcagccgtctgcaaccgggaagtgagtaacccgacttcataactatggtttctttggagagcattgtatttgtcctgtaatttttgcgttgccttttggtcttcgaccttttgggcatcccatttcttttgaacagtagactgcccattggaattgccccaaaagtaaatggtggccccaaggaccaccaccagaagataaggccaacctttagagattagcatcttcattacatgcctccagtggcacattgcctattcggttagctacccaaccatacgtaaagtctggcatgtttaatgaggtatagtggttcagttgtttagcatcaagcagcttaatcattacctgacatgctgcaactttgccccgttttttctgtaatgctttatatgcattaacagtacttgtaccgactttaccatcaacctgtattttagggtagtctttgccattacgtgacatttcattaagagacatctgcaaccacttagcaggacgggttacaccagtattaacaccagcatctactagcttatgcgttacagcaggagatatatcagcgaaggctacgaagttaggtttaagtacatagtcatcaatgtatatctcagcagccatctctttagataaacccttcatagaaccatcccaaccatactcagtagccagaacttctttatgagtcttagctactgattgggtaataccatgattagtttccccacctgggtcacgaggattgtttacataacctccttccatatagaacactgcccccagaatagcagcgataacccctcccactgcaccaccttttgcagcaagtttctgtttagctttcatgtgaatcttcctttggtcggaatcgtattaatctgcctatgatgtttaaggcaaacagtgcgattgcaatattggaaccatggggaatatcttccaagatgtgacgaggtaatcctgtcaccattggttggatgatatctacagcagagaatagaattaaaccaaacgtactaatttgaatggatgcccatttccagcatcttttccagttaggtactaactctacttttctttttagcctgcgaaccatgcgaatatctcccgtcttgcagcagccaatacaccaataattgcacctgctccagcccatacccacttaccaaaaattccagcaccaacaactttatgcttaatggtgatgaactcttcaatagtaggttcattcttagctaagctatcctccacattttttagtctattgcctatgtcattgattgaatcccgtaattctcccagagtttcctccagtttctcacggtcctgtctgtctctcgtctgattctcaaacagagtcttcaatcgttcctccagtctgactagaagcagttcgcccgattcattcataatattaccgtagttgtaaagttaagaaccccaatagggtcgtatcataagatgactcttagataatacttagtatgatgggatacatccagacatagtgtctggtatcaactgcgaggtaactatgtctattaaagatattttccaaagtggtaaggatgttgtgtgcaaaatgaaggggggattgttggtcgtgggaagttatggggaacgaatagtttctgctaataacatctcagagatccccccagaactactacctttcccaccaacagagttagaagacacattccttctggacttgtatacatggaccgggagccaggcagtaaatgaccaatcctggttcaattacttttcattaccagggataactaaatcacctggaggtacagcagcactaacaattgaagaaggaaatcttaagttccccattagaaccaggaatacccaggtaatgttcagtgttcgtatatcaggaattattgcaggtggtgcaggtacagcaagggaatggagaacacaaacaagacgaaccaatggaattacgatagtaggttcagatgctagtgttaaagtacagggtacagacattgctaacagagataacgtactggctacttacacacttggttcaactgaccctttcatggtagacggtattcagttaggtatgtttaatatctcaggacaagtaattaccctaacagcagtatcaattagggcaatgcaaacagtaaactctatataagaaatattattaatagataaaaacaaaccccgcctgagcggggttttatacctagataagtaatagcctggtagtacgtaggctactgttaaccaactctactgatctaaccgtaccagtattactcacttagacataacagctaatgcttcctgcatacgcttaatagtacgccgcatcaacgcagcctctaatatcagtacttcctcgtaacgaataccgtagcgggaacctgctggtgtaatcagtttacgagagccattggcatcttcctcgtatacatcatcccaactgtcgaagcacaggaagccatagcgatgtgcatctataccgtgacgttcgaatgcctccttagctcgctgagcgatgatgccgaagtgccatctagctgagtctgcacccttctcctcaattcggtccaagtactgaaattgcacaaagtcaacttcagaccaagcatccagtaaagcatctgagataataagaggctctgttttatccctagcatctgagataacagtgaatgctgattgagtaaaaccgccagaccatgctcgacttgcggaacctaatgcgtatgtatcagtactatctggggtcattgcattagaacctaactgcaaataacctgtgctactggtaggaagacgcacgttaccgttggtgagtgatactgtccgagaagtaccatcagaagtaaataggcgaacttgagaagaagtacccccacctacagctaatgacacagcaccatccccaagcattctgtacttatcagccgaggtaagaacgcctgacggaagtgacatggacttaatccgccattcgaacctaccggacatactgcctatgtactgtcctaatgcaggagcgtgcactacgttactattactagtgccgtcaatagtaactgcaccttcaatagtaccagtagcactgagaaggtcgtttctccttcccggatgctttacctctacgaagttacgggtagaacctgattcgaaagtaataacacctgtagcactgtagctaggaaatacagacgcatagttgttattagctgtatctataaagcgcgcaattgtagcagtttgagcttgccctaaagagttagtaccatcacatcctgacataagcacattgcttattacgttatcagagccttctactgtaacaccgtgagcctgactagcgtcagagattgagaaatctacaagcacatctgagattaagttggtactacctttgcctgcaacaaccgctgcatatttaggattattagccactaccccattgataaggttgttagagggagctattgacccttctgtaccgttgtaagttacatgctggcagtctgcccctataacattgctgactatgttataactggctgtacctttcagttctacagccccgaactgagggtagttcttagcaatgacgttatttatgagggagttaaccgaggaatcagcaagtatgcatccagccgccttattagtagcatagccggagtagctacctcgaatgcctttaatcataagcccatcagagggtgcatcattagggtatgtgattaaactgaaaccagcgcccttaacgtttgagaaattaacatcacttatagtaacatcactgccaccagcaagagatacctgctgcccttgagtggtatcggtcgccttattactttctaccgtaatattacttaagcgacctgagcgtagattgttaaatactaagtagttacctgtacttgaacggtgacttagtacaccactgcctctaccgtctaagttacagtaattactattaataccagaactagagaatacaccgtctgatgctacgacagctttttgagaatttagtgaagcagctatattctccgtactatctgttacaccatcccctttagcaccccagcctcgaacatcaccctcatcacgccatcttgccatctgcaattcagggtaactggacgcaccatccgggtctgaaatctggctgcgcagggctgcatcaccgacgctcagccactttcctgtaccaatatcaggaacagacccagcatctacaacctttggcagtgcgccatcccatcgatacaacccaccctggtattcaagacattcattctttactttaatctcataacccaaagagaaggacccagggactgttataaactctcctcgtgaaacagctagtgcacccaggtcaacattaccagtagagtgaactaacacaccggcagtattaaggcttacagcagtaacccctgaaccaaggtctgcaggtaatgagtaagctcgctgggtagtcttatcataaatgaccttgtattcccctaagtctacacctacagcaaagtaaacaacctcattctgcttaacaccaaacttacgggcaatggcttgtttgttggtaagaataccagtggagcctttaccaccttgtgagaacatttcgttcataagaacctctttgtttttctggttaatggcgtccttgccgaatatatccttatgtacacattggaagattatttaaatttttccaattgccgacgaagaaatgcacacttaagtacgggagatttctcataactaataccgtatccacccctccaccaacttaatggcaaaatggttttgtttattacttctgttcaagagcagaaagtctggcttcgattctttccagttttcttctctgataagcggcttcagcaaagaaaattccgtcaggccgaacaccccactcctcaccctcttcatgaataaccacctcggtgtatacaggttcttccgtagtagtgacattaccctcctcgtcagtgtgttcaacgatttcattgtgtgaaaataccgtatcggtcatccgtggatacttgtcatagcacagaacagcataacgacaattcgtactgttttcatccatcagaccatgtgcaatgaatacatcacgaatttgttgagcaataaccccgaagtgaatacgagcatcattgcctttcagttgaacagcatctaaccactggtacatgatgtagtgaacgtcaccccaggcatccaggaaagcatcatcaaaaactaccggctctgttttcttctctccgttagaagtaacaatagggttacttccgaggtatgcagtggtgaaacggttacttggtccaccaagcgcaatgacgttatcgttataaggcttaacatcagcaccctgaaacagatgttcatttccgttgtaaactatcctgcgagaagctgtgttgctcgcaccgtaaagcgtaatctgtgcaccagtagaagaactggttccgtctcccccgcaaaatatgatgcgctgccctgctgggttattagtcggtacagatttcccgataaacccatactcaccttccattaaaacttcagagcgaatgttactactggtgctggctctaagggtcacatgacctaaacccaaatctcctgtaaattccattggagcaggaacagtgcgaatcccatttgtatcaaaaaacacggggacagctctgtcaggtacagcaccatatctgaaatccctggaaacacgattgtctgaaccaatcttcattttgtagcaatacaaatctgatggatgaccatctgatttgaatgggtctttcgatgagttatctccatatgtccaggggttcagatggtcttccccaccgaacaagtaatagatataactatccttaacgaccactgagccaacaccaacgccagagttgacaatgccaccctgataaatctggtcagtgatatttacccattgagtattatccaggttccaggtgtctaggttcactcgcgtgtaaaacgttcgcgggtaagaactgaaatatcgctggtcgggtgcgtttgcttcccactcgttgtccgcacgttctgttccaaaaagaatgagttcgtttcctaccttagcgaatggcagggtggagtggtggacattattcgggaacctcaatgattgccaggatatacccaaatcgttactacgatgtagtgaactacccagacgatccgaccgagttccacgggttacaacataaagaacaccgtcaaaatatttaacacagggttctgccgcatctggctcatattcagcagggatacgtcgttttatataatgcccaggattgttaaatgcatccgggaaatacagcataccaacttcacgtggagcagcatcaccctggtgatatcccatcataaatgaatcattattgatggcggtaaaactgtgaacctcggtaaccatgggaatcagtccaaggttggttttacgccaaggtgactggtggaacgatgtccccatatgccagactttggtagagttattttggtcagattcctgttgatttggcgtggtgacagtaaatgtgttgcggtcaataactgaagttacagtcatattccccgaaacaccagtcaccccagagttcgagaagttaacaaaatctccggcaaacaatccatggtcaggaatagtaattacagccacaggctgattagcggcttttgtgataccacctgtcggatggtaattacgggacataggacggtcccatatctcacaggtcaccagtgcgttagatgctaaagtacgtgtctcaatcatcgcaaagagacgattacgcatcacccccatactcatacagtggtagttaactgtcgggtaatcaggatgtaggtcggttaaccattccggcgttgtccaggtctgtccgtcatcccctgaacgaacccaggatacatgcagcctgctgaccccatgtctatcactagccatgaacgggcagtaaataacatcatcgtaaacgaacgctttatcctgtggccacgcattgtaataaggggtgtccgttattttgaaaagctcgccctgaacaaattcttcagaggcataataaagcggctgaccaggaatacgctcataaacaaaacgagtgttgacgaatcgactaatatcaggcaaggatgtgaccttatatgtcttcccattgccattaatcttttgtccaactggtgtgtcgtttaatacgttcgttaatgctactgtatcatcatgcacagcgtcccctttaacaccccaaccacggacatctccctgattacgccatagggtattttggtcagtttcttttttggttagtaactcaacctgaatgttacctggagtatatgtaaggatattaccaactacgctggatatatacacattagttggtaattctggaataacgtaaatctgctgattatcgggattataaataacttttttgttatttaaggattgtactgtattagtactgagaataacctcagaatctttttacattagccgcacgagccacttcctgtagagtacgatctgttgcttccaatactcgtgcttcaccaccaatctgtactatcaaacgatcattggttgtcagtggttcggtaagaaaaatacgttggttatctgggtcagcagtataagactcagtagttaatcctttatacaaacgaagaccattcttatacacagccggaatagactggaaggtatacggaatagcaataacctgctcaccccctacagcagcaccattgttgtacaaccaattgatctgaatccagtcattaatgttaggattatccggtacagcaggaacaccagtcagaaggaatactacttcatctccttcctctaaaggttgagccagagttacggacaggctgtctacgttgaactcaaatccacgacctacatactgcatgtcgccattaacaataatgaaaggtacacccaccgtaccatctggtacgttgattgtggtttccccaccagtagcagaaccattactgtatacccaaggaatataagcaccttcactggaagaagtaccaccaccattggaaccagaagtagcaacagtaatccacgaaccagttgcttctgagtcatctgggatgatgccagtacgatcaccttctacgtacaagtaatcagttacctgccggtcacctgcacgggagaaaccgtagatacgggaatatttaacctgcgtggataatgccttcaattcctcttcagagtttacaccgatgaccatcccatactggttcaggaaatcatacaggagtttaagattacccaggttgcagtacacagtacgaaccacatggtaagcattaccaagcagtgcatccaccatttggtcattggaactgctatgacaatatggattggtccaatcctgatttgcatcaaagggggtatgtgcgttcatcgccatcctcgttgttcaaatttagtttcggtaattgaaatacttccattagccaggtcgtaatcaacaacctcaccacagatgctttcatatgtttgcagatgctctgctgctttagcgttagcttccggagtattcaaaccggtgtggtaacgataacccacccagttatgaagtgccgtcattagcgtatcagctaaatcaacttcctgttcttcatcacccgtaagcactgggtgcttggcttgatacattacgttaagtgcctcaaagtgtcgaggacgcatacactgaatagtatcaggccgtggagtgaagatagcacgagggtccgaatcatcgttcagtctacgtcggttccctgagttatcaaatacatttaagattttaataacatcatcctggaaaggtttcatgaacccatccatgatgtatggatactgaacctcaagagtgggcttagtaaatctggagtaagcatatctggattgaagaggataatcggtacgcccttctttcatctccacaatacaactattagttctgagagggaaacgactatgcagtcgaaccaatccttcattaatagctgccagtatctcaggcttactatcaggctcaatacacaatctgtcatccgtgactgcaccagtacccttcaaggtacttagtgccaagccacggtatacttccgataatttttgcatggttcctcacacaatatatgaacgtagggggttaacactatcttcttcttcatcgtcccacatcgggtcacccttgttatccaccatagtcatacctgcctgtggtttccagggattgagataacccagcatagagatagtatcaatacagtcatccttacctttgattccattaatggtagctaatttaatctggcccatgaacaaacccataatagttgaatctctcaactcttccgggaagtacatcttaccagctttgaaccatggaactacctggttaaagcgtgacagcttagaggttacaggacgtatgcctggcttaccaccttcagaggatgcaaagttaaagaagacattacggttaatcatttctttttgaaggagtgagatgaatccaccttgttgacctgtggtttcgaccccaacattttgtggttggtattcctgaaccagacggaataagtcatcaaagtttttatccataagctgacgattagccacaccatcaacccagaaccaatctccattagaactataagcccaaactgaaatgacactgtagtcactggtctgtttctccgaagtagcaaagtcagttgtaatgtaatagttgtagcaggacttcatccttaatagttgttgtctgctataccacctaatttcactatcctgaaccagtctctcatcttcagaactaatacgaagcataagttcctgatagaagccagccaacttaccagtcttaactgccatatcgtattgagctttgatgtagtcatatgagaaacggtcatcccatgcaccctgaaattcttccctgctacaggggaacttctcgcatacaggccatacgttgacatcccatgcaccagactcaactgcttcaatgataatgtcttccttattaaagggagtaccattgaaaattactttacgacgggttgggtcaagagcatggttcacacctttatagacggtatccttaatagcttccatgcttgtcttggagttagcatcaccatcgctaatcaagtcatccagtacacagagtgttggacgtttaccatatatcttcgtaccacgaagacctgtcttagcaccaaacaacttaacaccaagtcgatgtccttctacattacggaactccagaaggttatctgtaaatgtagcctcaggtatccattgctgaaggaactcactattcttgtaacggaactcaatgttcttacgtgcagacttagcaccgttatccattgagtcagatacgtaaatcattccttctaccttacccaggcttggtaaatgaccaaacactgccaggaacaaagtaaagtactccatgaatacagcagttttacctgcaccacggaaacacaggttaactacatactggttcggactaatcatcttatccagcatcttcaagtgaactggaggtgttttgttagattcaccctccttaccattaaccaacttaataaagttggcaaaggtaagagcaaactgactaggaacatagttagaagaattaaggtgggagtaatccacctggtctagccattcatctagttcctgtttaattaattcagacatttgtaatgtcctcatctgcacgtactagtttagaaccagcaacctctttggtaggtacaccactattgattgcattgatttgctgttcagctaatgcagcaagtgttgccttgaggtcagttaacccggagttctctcttaagtccagattgatattcgttacctggtctttcggtttagccaagtgagtaaggatagagttagctgcatcacatcttactttctcacttgctgctgtggtcattagttcaacctgaacgttgatagccttttgataattgtcctggttcacaatccacactggaaccaaactttgttccatgatgaggttaaccaatttacccctatggtaagcagatacataagcactgatatctttctcactggttcctcgtgctacaagttctgcttgtcggttagggaatgtcttaaagtaggcttccttatttgagtagcccatgtgtttgtaagtcacatactgaactgcattcatgtagtcctgtgtcttaaacttaccttccttcataactccagagtaagagatgaagttttcacggaatgcttcagcaaccagttggtcttgggtaatgttgttaattgtgtccaccaactcctgggttacactgttcttgaagttagcaggtagggcattaacaatctgctgcttagttagttcactcatacttatctcgctacaaagttatgtctattaaagaagattcttttcttggggtgagttaccccttgaagaaaccataccatacagttacactttagtcatgatatagaaaaagttcatgatactaaatagtatgtaatgttccgatgaccctattcctaaaaggagtaacatttgagaatctatatgagagtccacgactccaaagatgaatacaaagaactagaccataccaaggctggtattctttcagatgatattatcattacacatgatgaagattcctaccatgaattagctgggatgatgctattagagaatcgtccaggcattaagatcttagaaccaagagaaacttactctttagaaaagagactttcagctcttgtgttcttcacaaaattacctcatagtgtctccgtcaggcgaagcaaagatagtgttcggatgatggtgacgatgtgattagtcatgccgcctagtagacagtggcggtactcgtaaagagttaataacttctacagtcagggttacccggctcctttcctacctagtaggctaacgatacacatgtatctagggtgatgaactgacccgtgattgaaaacggtaaggggtagagtcgagaggctctaccccatttctttttcaggaggtatgcaaatatgagcatctacgcttttgatattgatattactgggatacttcgtaatcaagaaccttattaccttggggaaccagaagtagtaagtaagttcattaccccatggcaaacagtattcttacctgactgtgaagagtcacacgaggttattggttctcttttcctatccaacctgcaactcaatactaagatactcactgaaccaaaggtgtatgacctctccttttacagcgactttagtatgattttccctggtgttaggttctataaaatacctggttgggaattgatagctgaccataatgtctttaataaaacactttccatttacttcagacctattcctaaaggaaggaaaattaatcatgaaattcataatgaccatccccagttttgctgaaagagaatctatgtatacaactgacttctctttagaagaagtaatgaacagcaacccccagcaagtaatcctggttcctaccttagaggactaccatgaagtaaggggacagctattcttagcaggtaatgatcgtaaggttgtatgtattattccaccctctgtctataccaactacagtgcaggtgaccctatcccatatatgttggtatctaatgactaccaatgggatagtcggtatgtaaatgatgaatactgttactactatataaggaagtaagatatgcatctgtattgccttattagctttgctactacttgctatttgtctccatatacattggataatatcctggcaggtaaggggagagttaccaccatcctgtatgagccaagtgaagatgcagatgtgctcataggtacttgcttaatgttggggcaacctatccaattcattaagatagtagattccgtagaaataccggaacacaccagtgtgtacatattgtcagagagtgaacctatggtagtaactacccttactggtagacttattaccctctatccttctacctcatatttatctagcgacgagagtctctaatgaaactaaacacatcaccctacccggtacagttagaagtagtattcgaccaggataccttcattaaaaagtataagaaacttaaagggcatgagccagacttggatggttgtaaggggtatacttcttattctggcaatcgagtattgattggtatctttagggaacctttacatacactcatccacgaactcaaccatttctgtttgtgggcgtttgactacataggtatgcctataaactctgccaatagtgaagcatattgctattactatgaccacatcctctcccagattccttcctcctatttaactgcttataaggattagcatgagattatatttcctatcagatatgggaaggttacatgtaggagagggtatactatggaattggatatgtaacaatattcccaatgtacctgtatatgttcactccgatatagactatcactggttaagaggcgagtgcttacttagaaatatgatagttaacttcataaaactagaaccatgggatagggtatccgatgtatctggcccatgctacttcttagcagttaatgggcatagagcagagaagatgttatatagaactaaatagagggtagatagataccttctcataatatttataaataaggcagaaccggtgacaagagtacaatacctatgaatcctatagcgaaggcacaggcaataaagtgaagccagttctcagggtctgtaggattgtaattaccccaaccatctttcatgttagtaccccaaagttatctgcttatagagatagtgcctataatatttttgcatgtcaaaattgtgatagctatatacagcagcagtgttg

SEQ ID NO: 15 - DNA, 45597 bp, Unknown
  Podoviridae; Autographivirinae
tctgttcgtttcgttcactccgcttgcgctacgttcactcgctcacgtgtaccttaggttattccttgatggatggcttaggttagccttagtgggctgccttagttaaagccttagtgcttcacttagtatcagcttagtagtgtaccttagtaagtcttagtgtcttctcttagtgattgcacatgcaagcatgtaagatgccgttaggtcgcggtcggtagaccgctaaagaaggagaatagtaataagatgcagtaggaggaacaccagaaacctagccaacctaagctatcctagctctatatctatcgcttttccttagtctaacacgttagacaacctatcttattcttagtgatggtaacttagtgttgacaagataatcttagtgtaatactatgcatcacgtaggcggtgctgaggcacctagtagccagctagtaaggcatacgaagagactagcgcttacattgctctttaacaatttgcttagtgtaacctatgtatgccgtggttaactacttattgaatgaggtattaactatgacattaaacaaccgtgaactgtccgttatcttcactctgttgtgctacatgattcgtaacaacgaattacttacagacgatgagttagccttgtatcaccgctttcttaacgaaggttggaccgatacagttaatcaataccgtaacatgatagatgagttgagggagggtaaataatgtatcaacatgaggtcttctttgaatcagctagcgaagctattcgcttccgtgatgatatgatgcaagctggtgtaggcgttgatgtgtatcactatttgatagattacgacactgaatatcaccgagttaccttagtatctgagtatgacaaccaagtcattactgagtatctaggcagtgaagattacgattacgatgaagtaatcacgacaaatctctaaattaactattgacagccacggcatacaaggttacattaagcacatagccgataggcaacgctctttaacaatctggtttgtgtcttgataggctaactaactaaggtaattattatgaaaggtttaatttgtgtagaacgtatggtcaatggtaaacttgaaattttaccactggaaaaccaatctagcttcaaagagtggtatggctgtttctcactgatttaaggtaaaggctggcactagtcagcctatcaaggcgcaaaccaagctctttaacaagttggataaagcttcttagtctggataggttaaacctaggagattctcttgagtctcctataatgtaacctaactaactaaatgaggattaataacatggctatgtctaatatgacttactctcaggtttacaacaccgctcatgctgcattagttgaacgtatctggaatgatgatattgattgtatcgataacgcacatgatgcaatccatgaggtagcggacagtgctgtaccaatctattatgctgacatcttctcagtgatggcgagtgaaggtattgatcacttcttcgaagactccggcctgatgccagatactaaggatgtaacggtcgtactacaagcccgtatttatgaacaactcaccattgatttatgggaacgtgttcaagatatgattgttgcgtacaccaattacgctgaggattcagaagaagaagaggaagaataaggatggaaaagcaatataactttatcttttcagacggtgtaaccctgaagtgttccctacgattcgcacaaattcgtgaggaagtactaggcactacatacaaactatttagctgacactataagagaaggcttaacaaggcgttactaaggtagcgcctgattaaactttcacttactaggagttaagactatggatttagatagcatcattatggcattttctcttattggcttaagctggtgctcctatcacctttaccgtgagttcttatttgataaagctaaacgcaaactaagaaaggaaggcggtaattaccttcgtttgaggggtggcttagtcgaatacattgcacctaacggcagggaatgcgccattaacaaagatgcatttatagagacgtggcattacatcaagtaactagcctatagcctgcctgcgtgggctatgtgatatttacttatcattatataaggtgactattatgactactgaaaacatcctcctgtctgtccgtgaagctgcaactgctgagattaagcagcatttggataatatcggcacttcttacatcaaagttggcgcttgtctgaatgaattgcgcggtgatttcgaaggccaaaaagactttttagcttatgtagaatcagagttcggcatcaagaaagcacaatgctacaagctgatgagtgtagcccgtgtctttgaaggagacgaacgctttaaaggtgtggctatgcgtgtaatgctggcgctcgttcctttcgctgatgagaatataatcatggagaaggccgcagaactcgccgcagatggcaagctggacactaatgccgtaaatgccctgattgatcctaagaaagagacaaaggccgagacggtacaatctaaggctgaggcggtaaaaccgcaggagaacgcgactgagtccgcagaattacaggaaatgcaagcgccgcaggtagtgccacccgcgagcgagcaggaggccgacgaatcagcaccttgggaagaggaaagcaagccggaagcgcctaaggccgcgccactggataacacggctaacaccgagagtgccgctattgctggccttctggcacaaattaaagcactgaccgagcaattacaggcagctaatgaccgcattgcctccttaagcagcgcacgcgaaagcaagaaagcagccgcgcctatgctgccgcaattcaaatcttcctgcttctatgctcgcttaggtttaagcgctgaggaggcaacgaagaaaacagcagttaacaaggcacgccgcgaactggttaagctaggatacggcgaaggccatgaagcatggcccttaatctctgaggcagtagaagaattaactaagtaaccttatcggtggcatcttcttaggtgtcacctattaaggtttctttcactaggagtaaacaagatgcaagacctacacgctattcaacttcaacttgaagaagaaatgtttaacggcggtatccgtcgctttgaagcggaccaacaacgccagattgcatccggtaatgaatcagacacggcatggaatcgccgcttattgtccgagttaatcgcgccaatggctgaaggtattcaggcatacaaggaagagtatgaaggtaaaagaggccgtgcaccgcgtgcattagctttcattaactgcgtagaaaacgaagtggcagcatatatcacgatgaaaatcgttatggatatgctgaacacggatgtaaccttgcaggctatagccatgaatgtagctgaccgcattgaggaccaagtacgttttagcaagctggaaggtcacgccgccaaatactttgagaaagttaagaagtcacttaaggcaagtaagactaaatcatatcgccatgcgcacaacgtagcggtcgtggctgagaagtcagtagctgaccgtgacgctgatttctctcgctgggaggcgtggcctaaagataccttgctacaaattggtatgaccttgctagaaatactggaaaatagtgtattcttcaatggtcagcctgtctttcttcgcaccttgcgcactaatggtggcaagcatggcgtttactacttacagactagcgaacacgtgggtgaatggataactgcatttaaagagcacgtagctcagctgagtccagcctatgcaccttgcgttattcctccgcgtccgtgggtttctccgtttaatggtggctttcacaccgagaaggtggcaagtcgcatccgtctagtaaaaggtaaccgtgagcacgtccgtaagctgactaaaaagcaaatgccagcggtttataaggctgttaatgcattgcaagccactaagtggcaggttaacaaggaagtattgcaggtagtagaagatgttattcgtctagacctcggttatggtgtaccttcctttaagccgctcattgaccgcgagaacaaaccagctaaccctgttcctcttgagttccaacacctgcgaggccgtgaactgaaagagatgctaacaccggagcaatggcaggccttcatcaactggaagggtgaatgtactaaactgtataccgctgagactaagcgcggcagcaagtcggcggcgaccgtccgcatggtaggacaggcccgtaaatacagccagtttgacgctatttattttgtatatgcactggatagccgttcacgcgtttatgcgcaatctagcacgctctcgccgcaatcaaacgacttaggcaaggcattgctccgttttaccgaagggcagcgtcttgatagcgctgaggcgcttaagtggtttttggtgaacggggcgaataactggggttgggataagaaaacttttgacgtgcgcacctctaacgtgctggatggcgaatttcaagacatgtgccgcgacattgcagccgatccgctgaccttcactcaatgggtaaatgctgattccccttacggcttccttgcatggtgctttgaatatgcgcgttatctggatgcactggatgaaggcacgcaagaccaattcatgacgcacctacccgtccatcaagacggtagttgctctggtatccagcactatagcgcgatgttacgcgatgaagtaggtgcgaaagcagtaaaccttaagccttctgacttccctcaagatatttatggcgcggttgcgcaggttgttatccagaagaattacgcctacatgaatgcagacgatgcagagactttcacatctggaagcgtcacacttacaggtgcagaactgcgtagcatggctagtgcgtgggatatgataggaataactcgcggattgaccaaaaagcccgtaatgacactaccttatggcagcacacgtctaacctgccgtgaatcagtgattgattatatcgttgatttggaagaaaaagaggcccaacgagctattgcggaagggcgtaccgccaatcctgtacacccttttgataatgaccgtaaggacagcctgacacctggcgcagcttataactatatgacagctttaatctggccttctatttcggaagtggttaaagctcctatagtggcaatgaaaatgattcgtcagcttgcccgtttcgcagctaaaaggaatgaaggcttagagtataccttgcctactggcttcatcttgcaacaaaagataatggcgacagatatgctccgcgtatctacttgcttgatgggagaaatcaagatgagtctacagattgaaacggacgtagtggatgaaacggctatgatgggcgctgctgctcctaactttgtgcacggtcatgatgccagtcaccttatcttaacggtctgcgaccttgttgataaagggattacatctatcgcagtaattcatgattcttttggcactcatgcaggccgtacagccgatctacgtgatagtctaagggcagaaatggtgaagatgtatcaaggccgtaatgccctgcaaagcctgttagatgagcatgaagaacgctggttagtagacaccggaatccaagtgccagagcaaggagagtttgaccttaacgaaatcttagtatctgactattgcttcgcataatattaataggccattccttcgggagtggccttttcttttacctactaccggtaacatttcattaacataaagtgtctcacatgtgagacttatttaccggacactataggatagccgtcggagacgggaaagaaagggaagataaaggatataaaggaagtaataggtattaaaggttatataggttatctaggaatacctattaccttcttccttcctcttattaccactcagaggaagggcagacctaggttgtctcacatgtgagacttcgtatttaccggacagtatagataagattaactcactttggaggttacatgcgtaaatcattagctcaaagagtagagcaagcaggttatactatacaagacgacggtactatcaaaggtaagcgaggtaacatcttgaaaccttggcttcaatcttcaggttatccagttgtaaatatagtattcaagaaaggtacaaggacaactacccttgtgcatcgcataattgctagtaagtattgtccttgctctgacccgttggctaatgatgtaaaccacaaagacggaatcaagactaataatgcagcttctaatcttgaatagattacacgtaggcagaaccgtaatcactatttaggttttgaggactatatgacacttacggcagatgatgcccgtaagaagaataatgagcgcactattgctcgacgtaaattacttaaacagttgaataataaggactaattatgcgtactaacttcgaaaagatggcccgtaaagctaaccgttttgacatggaagaggggcagaagaaaggcaagaagctgaataagcctgtccgtgaccgtgcatctaaacgcgcagcgtgggagttctaagttatggctattattcagaatgtaccgtgtcctgcttgccaaaagaacggacatgatattactggcaatcatttaatgatctttgacgacggggcaggatactgtaaccgtggtcacttccatgataatggcagaccctactaccataagccggaaggtggcatcgagataacagagttacctattactggcaatatcaaatatacaccttctcaattcaaagaaatggagaaggaagggaagataagcgaccctaaattacgcgccatcgctcttggtggtatgcgtatgaaagaccgttgggaggtcatgaatgaacaagaaagggcagagcaagaagcagagtggaaacttgatgttgaatggttcctcacgcttaagcgtaagaaccttgtttccagacacattcgcggcgacatttgcgcattgtatgatgtacgtgttgggcacgatgaagagggtagagtctcacggcattactatccacgcttcgaaaaaggtgagctagtaggagctaagtgtcgtaccttacctaaagatttcaagtttggacacttaggtaaactctttggtatgcaagatcttttcggtatgaatactttgtctcacgtgttagacaagggaagacgaaaggattgcttgcttattgtgggtggggaactggatgcactagcagcgcagcagatgctccttgattctgccaagggtactaagtgggaaggtcaaccttaccatgtatggtctgttaacaaaggggagtcttgccttgaagagattgtgcagaaccgtgaacacatcgcccaattcaagaagattatttggggcttcgatgaggatgaggtagggcagaagcagaaccagcaagcggctcgcctgttccctggcaaatcctatatccttgaatacccctctggttgcaaagatgctaacaaggcattgatggctggcaaggctaaagaatttgtagatgcatggtttaatgccaagtcatctgatgaagtctttggtagccagattaaatctatcgcatctcaaagggataagctcaaggctgcacgtccagagcaaggactatcatggccttggcctaagctgaacaaggtaacgctaggtattcgtaagaaccagcttatcattgtaggtgcagggtctggtgtaggtaagactgagttccttcgtgaagtagttaagcaccttattgaagaacacggtgaatctgtaggcatcatttctacagaagacccgatggtcaaggtgtcccgtgcttttatcggcaagtggattgataagcgtattgagttaccgccaaccaacgacccgaaagaagatggataccgtgaggtgttcgactacaccgaggaagaagctaacgccgccattgattatgtagctgatacaggtaagctgtttgtagctgacctagagggtgactattcgatggaaaaggtagagcaaacttgcctagagtttgaggctatgggcatttctaatatcatcattgataacttaacggggattaaattagatgagcgtgcttttggtgggaaggttggtgcacttgatgaatgcgtcaagcggattggtactatcaaagaccgacacccggttactatattccttgtatcacaccttacacgtcctccggcaaaccgtacccaacacgaagaaggtggcgaagttatcctttctgacttccgaggctcaggagctatcggattctgggcatcttacgccttggggattgagcgtaatacaagagctgaaacgcttgacgaaaggactaccacgtacatctcatgtgtcaaagaccgcgaccaaggtatctacactggaaccaaggtcatgcttaagggtgacattcaaaccggacgtttaatggaaccacaagcccgtactaagtcatttgatacaggtgaagcaaggcaacaagaagtaccagatttaccggacactatagaagagactaacttcgatgaagaaagtgagttctgattagtgtatttatcagggcttgtctcacatgtgagataggctcttattaagtacattaaataactggagattgattatgtataacttagtgttgaatgtaggtgataaggttcgtaacattaatggagtctcacgtcactatcgttgtcgtggtagagtgatccatgtaagtaagaatatgtatcgtgtagcatatgatgataagggtattacggcttattattacaaggaaaacgcgcataagtatcttgagaaaattgaagaaccaacacatcaatgtaagtgtgtgcatgatgaggtttgcgataagtgcgctcgccagatgcgcaaagcattactgttcccacttcgctatggtgctggtattcaaacattagcagaggcatatggaccagaggtgtatggaggaggtaagaccacactcaagaaagatcgtcgcaatgtaatcactggtaagactcaaagtgagatgattaagcaatgtggcactgcattaggtgttacacagtttaatactcgtgctctaggtaaaaccacaggacaagctatggtgaagattggcgaagccatgatgcatccaaatgtacctgtgcgaatcatggatgttgaccatgcaatcacagaacaaggtacgcaacgacgtgtaattaataagcattttgccgacactatagaaggtattattcgtaagcaagggttgaaaggtcttcacatcttaaatggtgaagaattactgtacctacctatcgttactgaagaaacatacgtgaatatctaaggagttaatcatgactaaggtattaatttatatgcgtggacctcataaatgctatgcagttgtagcaccaaatggtgttaagccttatcgtacttcaaaaagattggcattaataggtgctagtagtagtgcaagtttccaaatggaactttttggtcattggactgaaaggcaattccgtgaggattttaaagtcattggcagcttcatggtgaaatatgcagaataaacatagtcttagaatgttcgatggtcatgaagacctgcaagccaagattactaaccaagccttcctgttcgcacagttaactatggctgaggccaagaagaatagtctcactcgtgaacaggttatcaaggaggccacttgggaaccacaccaaggtaaatatatgggccacaaattaactgtaacacgcagtcgataagtcaagggttgtccaacgtgttggacagcctttcatcatattgattgggaggtattaaatgactaagtttactatgcaagacctcattaaattacgtgatgaaatagaatcaccggaagttaatacagagtttcactacattgatccacgagataaacgagagattcctgattatcagattgagacggagttaatgtatgaagattattgattggaagaaggaagcagaaggccgtatcctagtgatggatgcagaggctaaaggcctgctggatgctatccgctacggtcatcgtgaagatgtacacattatttgctgcatggacttgctcaccactgaggagttcctcttcttcgacccatatgagatgcgtgaccctgaagcaagggaacacctgaaagagtgggaaggccatcaagatgggaccttggttgatggtgttaacttcctaaagcactgtgaagccatcgtctcacagaacttcctaggctatgacgggcttctctttgagaaagccttccctgacatctggaagggatttaactacaccgagaggcgcggcaagggcagactacgtgctgacctgtgtccggtacgcgtcatggatacgctggtcatgagtcgcctgttaaaccccgatagacgcctccctccgcaagcatacgccaaaggtatgggtaacgtagcccctcactcaattgaggcgcacggcattcgtataggccgttataagccggaaaacgaggactggtctaagctaactgaccacatggttcaccgtgtacgtgaggacgtggcgattggtcgtgacctgttcctctggctctttaacggagaatggatggagcacaaacgccgtggcgtgaataaacgtaccggcctagggattgagacagccttccacatggagtccattgtggcgctggagatgagccgtcaggccgagcgcgggttccgtctggacatcgacaaggctttggcccgatgcgaagaactggacgctaagattgatgagacggtcgcagcgtttcgcccacacatgcctatgcgcattaagtctaaaccttttaaaccggaagaaaagaatgaagtatgccaacgcgcaaatgagtatggagctagcaacaatatacctactgtccttgacccctcacactttcttcatgccgagagacgaggagatcgcaagacagtatggagtgtcactactaagtctggtgattggtcgactagtgtcaagaaagactttcctcaccttagaggaaaccgtaatgacacgccaagcatcaagtggattggcgcttactcgcctgttactttcgaagagattcccttgggtaacagggatacagttaagcaagtgctctatgattatggatggaaaggtgttgaatttaacgataccgagcaagcgcatctcgatgagcacggagtgttacccaaaccttggagtggtaagataaatgaaaagtccattactttatggcaagaaagagccgcacgtgaaggtaaaacagtccctgattggtgcttgggtatcgctgcatggtacatactcgtatcccgtcgtggtcagatcctcaaccgtggtgacgttgaagccttcgaccagaagggggtgtggccttcgcaagctggtatacgaaagtgtcgcggccttgtacctgtagcatttaacaaggagttaggaatcaatgctcagcaatactacgaaaggtacggatgctggcctacgtcagacaaggatgacggagaatggcgtgtgccagctattgctattagtattggaacttctacgttccgtatgcgtcatcgtaacgtggttaatattcctgcccgtggcttgtatcctttacgtgatttattcatagcagggagaggcaagctaatccttggttgtgacggtgcaggtcttgaactgcgtgtcctgtctcacttcatgaatgaccctgagtaccaagagattgtactgcacggtgatattcatacgcataaccagatgaaggctggtcttcctaagcgtgatatggcgaagacgtttaacacaatgggcgtctataaactcctctaattcggtgaacatccttcgggacaataccgagctaagccatccagttacctcataagaaaggaggtgacatgactaaatcagaaacaaagagtgctgcgtaccgcaagcgttgtgatgagaaaccattccacatgtacaatatcacaaagagaagtggttgtcgtactaaaggtttaatctataaccttgatgcagcttaccttgaaagcatatggacaggtacatgtcctgttttcggtatacctttggacataccaatgaagcaagcgagaggcaaaggttctcacaatacagctcacttagataggattaatcctaaacttggctacattaagggtaatgtagcttggataagtggtcgtgctaatagaattaagtatgactcaacacttgaagagttgaaacaattggttaactggatggaaagtgtaacgactagccgtaaggcgtagcctcaagcgaggcgaaacggggagcacttcggtgaagagatagtctgctctacatggtaacatgtagctgttcaaatagaacggggtaggattagcgaacctacccgaacattaggtatatatgccttcctctatggctctggtatagctaaccttgcagcagtatgtggtgttactgaggaagaaatgaaggaagttgtggcaagattcgagattgaactaccgtctcttgcacgtcttcgtgagaatgttatcgcacaaggtaacaagtttggctacctgcaagcacctgatgggcattggggtcgcatccgcatgtctggtggtgaacttaaagagcacacgatgcttaacgtattactccagatgactggttctctgtgtatgaaatacgcattggtcagagcgtttgcagtgatgcgcaaggaaggtgtagctttggatgctatgggaaatccttgtggtgtggctaacgtgcatgatgaaatccagatggaagttcctgaagaggaggtcttgtatcttaactacgacctacctttcaccttagatgggttcgaaacagagaaggctgctgtgaaagcagttttcgatgcagaggagaaacgtgttcatgtggattctgaaggacgtatgtggtctgctgcaaacctcgttagcgttgatgctgatgctggtgtgttgcattgccagcgccgttatcaccgtgcaggtcatatcattgccgacgccatgacttgggcagggcagtatctgaagatgcgttgcccgatggcaggagaatataagattggcgcaagctggaaggaaacacactgatggacaggtttgatattgtttgcctattctctaccttctttcttatattccttatgcttgcttgctatggaagtatgcgattagatatacctgatgaagaggagggttacgattgatgcaggcatcttttattattcttggagtcatattatttatggtagtattctgggctttctctggcattgacccagattgtgatggtaactacgactgagttatactcaaggtcacttacgagtggcctttatggataacttattcctacttattttgtctaacatgatttactggacactatagaaggaaagcataggtaatctaggtttataaggtagtataggtaattaagtaaatataggagatataaatatgtctatggtaactactctggtattcgtggctcaatactttcgtggtcttgctaataagttcaagtccaaggctatcaaagctattgaggctcgcatcgaagcagtacaggcagagcaagttaaagttgaagaacatcgtagttctcaaatgattgactgtcataaccgctactatgcatctcgtgatgaactaaatgcacgtcaagtcaaagaggtagaagatatgctggcacgtcaccagcaagagcgtgacagcctgaaagctgaatttgaagagaacaaggcatcaattgctcttgtacatcaagctgcatctgacagtctgaagaaagagattgttatgctggaaatcgaactggataacctgaccaaataaggggttatgatggaagaagtaattcaagctaaacatgtaggtattatctttcgcgatctagagcagcgtaaagttgcaggtcatactcgtctggctaaagaggaagacaccgcaatcactactgtagaacaagcagatgcctatcgtggaccagagttcactcaaggtgaaacttgtcaccaattgagcctatcaatttgtgacactatggctattgtaaatgtgcaagaagtcgaagagggtgagtgtgtcagttacatctaccctttagatactattgcacgcattaaggtaatccataagtaattactagacactatagaacaataggtcggcttagttcggcctatgattgtgtagtgtaacaataggagactaaataaatggcacgtggtgattttgattttggtgctcagattactaaatctgaaggtaaagtctttaagaatccagaagtaggtgatcatgaagcagtaatctctggcatcattcatgttggttccttccaagacatctttaagaaaggcaataccactgaagttaagaagccagcaaactttgttctggttaagattgtcctgatgggcgacgatgataagaacgaagatgattctcgcatggaacaatggatggctgtgcctctgaagtctggtgataaggcaacactgactaagttcctgaatgcagttgaccctaaagagttgctgggtggcttcgatgatttcattggtgaatgcctgactgcaacgatggttggttctggtgacaagaatgacgatggctcattcaagtatgttaactggaagggatttggtggtatgccggacaagctgaagaaactggtcattgctcaggttgaagaggaaggtctgtctatgacaggtcacattacctttgacaagctgacaaaagaaatccttgatgacatcccagctaacttggtgcgtcaatacttcctgaacgagacacctcgtggtaagaacctgtctgttgctggctctcatgtagaagcaataattaaagctgctcgtgaagaagacccagagtggaagaaggctaagaagaaagatgacgaggatgctactccagctaatcgtaaatctctggatactggagagtctgttccacaggaagtacctgaagcagaagatactcctgcaccggagatggatgaggacgcggaatattaaggagaaaggatgaaagtacaaatcgtaaccctgcactgcaagaaaggtatcacaacgctaggaggtggcactttccactctttctccgaaggggagatttatgctgacctgcactacatctggcgcgacggacagcacgtggtgaactacagcgacccagctacggggaaacgccacggcgtatcgcttccggcgcatgacattgctcaggtgaacacagttttataaagtctcacgtgtgagacaaatcggtgtccggtatttactggacactatagaagagaagaattttaatcggcgataatgccataaccaacaaaaggagaatttaatatgttcaagattgaaactatcgtaaaccgtgttgttaaaggtgctgctctggtatccgttgagtctttcattatcgtcgatgaagctgatcaactggtagctggtactaaggcttacgatacccgtgaagaagctcaggctaagattgacagcatgggtaacttcgctgctggtctggagttcgctcgtgcttgcttccctgagcaggctgacaaagctcagattggtaaggctaatatcgtagctgaatatctggattgggttgctgctggcaaaccagtgaaagaagttaaggctgctgaagaagctgaagctccagcagaagaagtagctgcaccggaaactccggtaagcgaagaggaagaattttgataatagcaggtgttgcctctgttagtcctggttgactatcacgctcacctcatctaatgccctgtctgccttagtgtaggcagggtcttttgcgtaatagttattggagaatgaattatgccgactattgaatctcgtttacgcgctgactataatagatactttagccgcttacatagggattatatgacacacgttacagtatggttagatggtgagatattcttagtgtatgagtatttacatgatacggatgaccgctatgaccctagttccctccaagtagcaaagtctattgtagagcacatcttgaaggagtggcctacatgcgaccaaacttcgacttcggagctacagtatcggaagacaataacctgttgctgtggccaactgaaggtaatagaatcgctttaatagatgctgacatgttacccctacatcgtaggttatacaatcagtgacatgacttatgtacgagccacaactcgtgttaagtcaggacaagtcccatcaatcaaagatacacctgagtgtaagcaagcgtgtgaccgtgtgaactccttgctcaactcttgggtgtatgcagcagagtgtgatgcagctaagttattcatgacgaaatcagaagctaacttccgtgttcgcctagccttcaccaaaccttataagggtcaacgtaagaccgagaagcctccgttcttctatgaattgcgagagcatctcttagaggttcatggtgcaatcttggcagatggagaagaggctgatgacctcatgagcatcgcacaatgggacagccaccgccgcttccagcaagatacaggtaacgagttccctatcggtagtccagagcataaagcattctctgatacttgcatcgtttccttggataaggatttgatgattgttcccggttggcatcttcagcctggacaagagaagaaatgggtagagcctatgggttggcttgagttacgccgtaaggctaatggtcaggttaaagaccttaaaggtgctggcctcatgtttcattatgcacagatgattatcggtgatgatattgataactatactggcatacctggacgtggtgctaaatacgcctatgaccttctcaaagattgtaagacagagaaagagttgtacatggcagtgcttggtgcttacaaggctaagttcggacatggacaagttaagattaagaattaccgaggtggttatcgtatcggcaaggcttttgacctgatgctcgaatgtggtcgcctagctcacatggcaagattcaaaggtgatatatggcgagccgataagaacccaatcttgtggggagatgatgcggaatggttagcaaattaaaatcatcggaggtagcagcttataagagggaattgctagagaagcaaggatggaagtgccccctatgtggcggcagtctcaaggctgttactcctataaaccgtgtacttgaccatgaccatgagacaggattctgccgtgctgttgtatgccgaggctgcaatggtgcagaaggaaagattaagggtgttatctctggttacggtaaggctggtaacaaccgttacttccagcttcaatggttagagcgactatatgaatactggaagttacatagtacgcctcagacagataagttatatcacaaacatcaaacggaggcagagaagcgcgaggctaagaaccgtaaggcacgccttgcttatgcaagaaagaaggaggttaaagttgggtaagcttcgcagcttgtacaaagactccgaggtacttgatgcaatcgagcaagctaccgacgagaaaggtaatgttaattacaatgagatggcacgtgtattatcgtgtcaccctgtgggtaagaagattacccgccagttggctcgatactggcatggtcaattcaagaagaccaagaagaatggtgattattaccagacccttctgcaagaagataagcgtatcaaagaagagcgtaagctcaggactcctgaccgctacgaggatttggctattgttccattgcctgactcgcctcatcgaagtgtactggtgatacctgatactcatgcaccttatgagcacccagataccctagagttccttgcagccgtggcagcacgttaccgtccagacacagtggtacacctaggagatgaggcagacaaacatgccttgtcattccacgattcggacccaaatctggatagtgctggcatggagttagagaaggctcgtatcttcatgcacaaattgcacaagatgttccctgtgatgcgcctgtgtcactccaaccacggctctatgcacttccgtaaggcaagcgccaagggcatccctgtgcaatacctgcgcacctaccgtgaagttttcttcccgcagggaggtggcgaccagtgggattggcagcatacgcacgtccttgagttgccgaatggtgaacaagtggcattcaagcatcaacctgctggctctgtcctagcagatgcagcgcatgagcgtatgaacctggtgtgtggtcacttgcacggtaagatgtctgtggagtacgcacgtaatacacatgaacagtattgggctgtgcagggtggctgcttaattgatgagtcatcccgtgcatttgcctatgggcgtgagtctaaatacaagccagcattaggttgtgtggttattctggaaggtgtgcctcatattgtcccgatgcaaaccaatagcgacaaccgttggattggcaagatttagttgacactatagaacaaagggctaggtaagactttatcggctggcgtatccaaatgatattgcactagcccttgattgtatagtgaatggaggattcaatatgtcacactatgaatgtaagaagtgtcataagcgttatgattactgtacttgtggtcaagagaaaacatcttttaaagttggagacaaggtatttcgtaatgaaaaagattctattccttggaatcaatactgcaaagaagctggtattgaccctgatagccctgtaaccatagatgatattgatggcattaacttgtgctttcgtgaggtgaggggtacaggttgggattccaaaaaattcaaacttgcatctgataagttagacaacaatatggtaactcagcctaagcactacgagttctttgatggtgtagaggcaatcactatcattgcccgcagtatgactgaaaagcaattcgctgggtactgcatgggtaatgcccttaagtatcgcctgcgtgcaggtaagaagttcaatactgaagaagacttgaagaaggcagactattataaagagttattccagaagcatcgtcacgaatgtattgatgaggatatttaatatggaaggtaaactgtatagagggtacttcggtaacttatataaagtaagctctcgcggttttgtattgacctctgatgatgaaggtgcaatgtggcacctaagtgcatatggttctaacttagcacactttaaagaggcaatagtcaaaggtgtgatgaaggaggtgaaatgaacatcttccaattcctaggtcttccagaagaccaccgcaatcatccattcatgctggtgaagcatcgcggtgaagttcctgagaagaaacttacttttccatgttatgcacaggtgaaacgagatggaatattcagtgctgttgtggtgcgcaatgatggtgctgttgccgtctttggtcgtactggtaagaagctcgcaaatgttgaagccttggaaaagacatttagtgtatttcctgtcgggttgtatcttggtgagttgcaatctatggctgttgatgtttatcttgaagctctgtcaggagtggtaaaccctaatcgtacagagccacttgacttcataggccagcagattaaagacaacctgtatatcgacttcttcgatatgttaactattaaggcattccatgatggattcactgatgtttcttatctcaaacgttacgatgctttacatcgtcgtatcggcactcatcttagcgggtgcaacgctatccttcctatcactccttgccataatgagcgagaagttgaagcgtttgcgcaagagcaaatagatgcaggacgtgagggtgctgtattcaaactggactgcgattatgaagcaggacacaaaggttatcgtcagactaaagaagtccgtaaggtaacttatgaccttacttgtattggctttgaagaaggtaaaggtaaatacaaaggtaaggtagctaacctcattttcaagtggaaagggggcaagacaatcaaagctatgctcggtaaagggtggactcatgcagatgcagaacagatgttccacgatattaaacatggcggacggttgaatgtcattggtaaaatctttgaagtcaaaggtcttcaggattcaagcaagggcaacattcgtctgcccaaagcgggagaattaagacatgacaaagatgaaccagatttcttttgatagcatgaaggcaactcgtgctgttgaggtagcagaggccatcttcgaaactctatcctgtggcatggaagtgccatatactttactggctgatgcagaagaacttggtctttctgtagaagctatccaagagaaggttgacgaattatatggtacagacgaagaagaaaccgacgatttcatttgaaggaatggagatgcttgagatgattctcaagccttcttctcctaaggtgactaagactcatgaagagttaatcgttgatgaagttaagcgttacatcatggattgtgtcagagcacaactggtggtccaatgatacgtccagcttccttcctagatattcctgagattataaaccttgggaataaatatgtggaagaggaagtcaaggttgtagcccaccactcagcctcatggaatgcagaacaaagtgcacataacctttgtgcatctcttagtagagaagatttattcctatgggttgctgtagatgaagggcagattgtagggttcctgtgggctggctatcacgagttggccccttggacacctgtaagagttgcctctgacattctcttttatattataccagagaggcgaggaacacttcttggtatgcgtctcatcaaagccctaaagcaatgggctagtgataatgaatgctctgaggttcgcctgtctatcgcctctggtattaatgaagaacgtgtcggacgtatgtataagcgacttggctttgaaccgtttggcactgtgtataacatgaagttctaaggagataacatgggtgttgtaaagaaagcatttaaggctatcggtcttgctcaagatgcaccacgtattgaagccaaagtaccagcacagcagcttgagcgtaagcctgagactgaagctgaagatattcaaattggtgcaggtggtgatgatgcgactgcatctgcaaaaggtaagcgcggccttgtccgtccggtagcttctagcttgaaggtgtgatatgaaacagagcacagatttggagtatggaggtaagcggtctaagatacctaagctatgggagaaattctccactaaacgtagctctttccttgatagggcgaagcattactccaaattaaccttgccctatctgatgaatgacaaaggtgataacgagacttcgcagaatggatggcaaggtgtaggtgctcaggcaaccaaccatctagccaataagctagcgcaagtactattccctgcacagcgttccttcttccgtgtagacttaactgcacaaggtgagaaggttcttaatcagcgtggcctgaagaagacagagctagctaccatcttcgctcaagtggaaacacgggcaatgaaagagttagagcaacgtcaattccggcctgctgtagtagaagcatttaagcatcttattgttgctggcagctgtatgctatacaagccgagcaaaggtgcaatcagtgctatcccgatgcatcactacgtagttaaccgtgataccaatggcgacctgttagacattatcttgctacaagagaaagccttacgtacctttgacccagctacacgtgctgtagtagaggttggcctgaaaggtaagaagtgcaaagaagatgacagcgttaagctgtacacacatgctaagtatcttggtgatggattttgggaactcaagcaatctgctgatgatatccctgtgggtaaggtgagtaaaatcaaatcagaaaagctacctttcatcccattaacttggaagcgaagctatggtgaggattggggtcgccctcttgcagaggattactccggtgatttattcgttatccaattcttatctgaagcggttgcccgtggtgctgcgctgatggcagatatcaagtacctgattcgtccgggtgctcaaactgatgttgaccactttgttaactctggcactggtgaggttatcactggtgtagaagaagacatccatattgtacagttaggtaagtatgcagacctcacacctattagcgcggttctagaggtatacactcgccgtatcggtgttgtcttcatgatggagacaatgacacgccgtgacgccgaacgtgttactgctgtagaaatccagcgagatgcgttagagattgagcagaacatgggtggtgtatactccctctttgctactactatgcaatcgccagtagcgatgtggggtctgctggaggcaggggagtccttcactagtgacctagtggaccctgtgattatcacaggtattgaagctttaggacgcatggctgagttggataaactggctaactttgctcagtatatgtcactgccattacaatggcctgagcctgtcctagctgctgtgaaatggcctgactatatggattgggtgcgtggtcaaatctctgctgaactgccgttccttaaatcagctgaagagatggcacaagaacaggaagcacagatgcaagcacagcaagcacagatgcttgaagaaggtgtggctaaggccgtgccgggtgtaattcaacaagaacttaaggaggcgtaatgtctttctcatttactgaaccgtcaaccactcaccctactactgaagagggtccggtagaaaccaaggaggtaacaactgatgctgctactactgatgctactgctgacgctggcactgctgtacaagatgacaatgctggtgcacaacctactgaagacaccggaggagaagcttctggacagccttcagaaaaaggagacaatggcggagagaatggtgaatctaagccagatgataccgcgaccgacactgaggaagtgcaatacttcttcggagaacatgaagtaacaatagacatcccacaggatgtaactgacagccttaaagagaaaggcattgatgccaagcaggttgccaaggaactatattccaaaggtggcaagtttgaactgtcagatgcaaccaagcagaaattgtatgatgcttttggcaagtttgcggtagatgcttacctgtcaggtcttaaggctcaaaatgaagccttcttcctgaaagaagccaacgcagctaaagagttggaagcagctaacacccaacgcttctctgatgtttctaaggaaattggtggcgaagaaggttggtcccgtcttgaggagtgggcgcttgaaacgctatccgatgacgaactcacggcattcaatgctgtgatggagtctggcaaccaatacctccagcagtacgctgtgcgtgaactggagagccgccgtaaggctgcacagggtgatgataggccatccctgattgagccatcagcacctgctaaggctaatgaagagaatggcccactgacgcgagatcagtacgttcaagcaatcgcaactcttagccagaagtacggcaatgaccgtaaagctatggcagaagctcaggctaaactggacgcccgtcgccgtgctggcatggctcgcggtatctaattcagtatttactggacactatagaagggagaaaagttctccctagttatcaatttgatttataaggagattataatacatgtctacaccgaatactctgactaacgttgctgtatctgcatccggtgaggttgacagccttctcattgagaagtttaatggtaaggtcaatgagcagtacctgaaaggtgagaacattctgtcctactttgatgtacaaactgttactggcactaacacagtgagcaacaaatatttgggcgaaactgagttgcaggtgctagcaccgggtcagtctcctaatgccacccctactcaggcggataaaaaccagttggtaattgataccactgtcattgctcgtaacactgtggctcacatccacgatgtacaaggtgacatcgatagcctgaaaccaaaattggctatgaaccaagccaagcaactgaaacgtctggaagaccagatggcaattcagcagatgctgttaggcggtattgctaacaccaaggccaaacgtaacaagccgcgtgttaaagggcatggcttctctatcaacgttaacgtaactgagagtgaagcactggctaaccctcagtatgttatggctgcggtagagtatgctctggagcaacagcttgagcaggaagtggacatctctgatgtagctatcatgatgccgtggaagttcttcaatgctctgcgtgatgcagaccgaattgtagataagacttacactatcagccagtctggtgcaaccattaatggcttcgttctctcttcttataactgccctgtgattccgtctaaccgattccctaccttcgctcagcatcaggctcaccacctgttgtctaatgaagataacggctatcgttatgaccctatcgcagagatgaatggtgcagttgctgttctgttcactgccgacgcactgctggtgggtcgtaccattgaagtgactggtgacatcttctatgagaagaaagagaagacttattacattgacaccttcatggctgagggtgcaatccctgaccgttgggaagcagtgtctgtagttaccactaaacgtaatgcaacttctggtgctgctgaaggttctggtgatgatcacgcaaccgtactggctcgtgcacagcgtaaggctgtatatgtcaaaaccgaaggtgctgcggctgcattctctgctgccccagcaggtatccaagcggaagaccttgtagcggcggtacgtgctgtaatggcaaatgacattaagccgactgcaatgaaacctactgagtaacacctatgccctatctaccttgcgtaggtagggttctttttgttaggaggattcatgcctgtaattagacaaaccagtaaattaggacatatgatggaagatgtggccttccagattattgatagtaagctggaagcggtaaacttgtgtatgcgagctattggtcgtgagggtgtggattccctcgactcaggggacttggacgcagaagatgcaagcaaaatgatcgacatcgtatcccagcggttccagtacaacaaaggaggtggctggtggttcaatcgtgaaccaaactggcaacttgcaccagacactaacggtgaagttaatttacctaacaactgcctagcagtattgcagtgttatgctttaggtgaaaagaaagtacctatgactatgcgagcaggtaagctctactctacttggagtcacacctttgatatgcgtaagcatgttaatgctaatggtatgattcgtcttaccttactcaccttactaccctacgagcatctacctacaagtgtaatgcaggctattgcctatcaagctgctgtagagtttattgtgtctaaggatgcagatcagactaagctagccactgcgcagcagatagccactcagcttcttatggatgtacaatctgagcaaatgtcacagaagcgattaaacatgctggtacataaccccactcagcgtcagtttggtatcatggctggtggctctcagaatgtacctgcttactctcattcaccttatgagagttgggcgctccgtccgtgggaggatcgttaatggaagtacaaggttcattaggtagacaaatccaagggattagccagcagccgccagcggtacgcttggatggtcagtgcacagctatggttaatatgatacctgatgtagtgaatggtactcaatcacgcatgggtacaactcatattgcaaagatacttgatgcggggactgatgacatggctactcatcattatcgcagaggtgatggtgatgaagagtatttcttcacgttgaagaaaggacaagttcctgagatatttgataagtatgggcgcaaatgtaatgtgacttcacaagatgcacctatgacctacctctctgaggttgttaatccaagggaagatgtgcaattcatgacgatagctgatgttactttcatgcttaatcgtaggaaagtagttaaagctagtagcaggaagtcacctaaagttggaaacaaagccattgtgttttgtgcgtatggtcaatatggtacatcttattccattgtaattaatgggaccaacgctgctagttttaaaacaccggatggtggaagtgcagaccatgttgaacaaattcgaactgaacgtatcacttctgaattgtactctaagttgcagcaatggagcggtgtgagtgactatgaaatacaaagagacggtactagtatatttatcgagagacgggatggtgctagctttacaataacaaccaccgatggtgcaaaaggtaaggacttagtggctatcaagaataaagttagctctactgacctactcccttctcgtgcgcctgctggttataaagtacaagtgtggcctactggcagcaaacctgagtctcgttactggctgcaagctgagcctaaagagggaaaccttgtgtcttggaaagaaacaatagctgctgatgtattacttgggtttgataaaggcacaatgccttacattattgaacgtacagatatcatcaacggcatagctcaattcaagataagacaaggtgattgggaagatcgtaaagtaggggatgacttgactaaccctatgccctcttttattgatgaggaagtaccccagacaataggtggaatgttcatggtgcagaaccgcctatgctttacagcaggtgaagcggttattgcttctcgtacatcatacttcttcgatttctttcgttatacggttatctctgcattggcaactgacccctttgatattttctcagatgctagtgaagtctaccagctaaaacatgcagtgaccttagatggcgctaccgtgttgttctctgataagtcacaattcatactgccaggcgataagcctttagagaagtcaaatgcactgcttaagcctgttacaacatttgaagtgaacaataaagtgaagccagtagtaactggtgaatcggtaatgtttgccactaatgatggttcttactctggtgtacgagagttctatacagactcttatagtgacactaagaaggcacaagcaatcacaagtcatgtgaataaactcatcgaaggtaacattaccaacatggcagcaagcaccaatgtcaacaggttacttgtcactaccgataagtatcgtaacataatctactgctacgattggttatggcaaggaacagaccgtgtacaatcagcatggcatgtatggaagtggcctataggtacaaaggtgcgaggtatgttttattctggtgaattactttacctgctccttgagcgaggagatggcgtgtatctggagaagatggacatgggtgatgcactaacctatggtttgaatgaccgcatcagaatggataggcaagcagagttagtcttcaagcatttcaaagcagaagatgaatgggtatctgagccgctcccttgggttcctactaacccagaacttttagattgcatcttaatcgagggttgggattcatatattggcggctctttcttattcaagtacaaccctagtgacaatactttgtctacaacctttgatatgtatgatgacagccatgtaaaagcgaaggttattgttggtcagatttaccctcaagagtttgaacctacgcctgtggttatcagagacaatcaagaccgtgtatcctacattgatgtaccagttgtaggattggttcacctcaatcttgacatgtaccccgatttctccgtagaagttaagaatgtgaagagtggtaaagtacgtagagtattagcgtcaaaccgtataggtggtgctctcaataatacagtaggctatgttgaaccgagagaaggtgtcttcagatttccactgagagctaagagcacggatgttgtttatcgtattattgtagagtcacctcacacattccagcttcgtgatattgagtgggaagggagctacaatccaaccaaaaggagggtctaatggctataggttcagccgttatggctggtatgtcttctattggtagcatgtttgcaggcagtggtgcagcagccgctgctggaggtgctgccgcaggtggcggaggtttgctaggttcactaggtggcttcctaagcggctctactgctggcttctctaatgctgggcttcttggtgctggccttcaaggtttaggcttgattggtgatctctttggtggaagtgatgaagccaaggcaatgaagaaagcacaagaagaacagtggcggcagcaacttattgctacacaagaagcatacaaaacagtagcagatgcagagcgttctgctgctaaacaatatcatgcagatgcaatcagtaatcaggcttcactgctacagcagcgagcacaggttgcattacttgctggggctactggtactggtggtaattctgtgtcctctatgcttaatgacttagcagcagatggcggcaggaaccagagtactatcattgataactatgagaatcagaagattaatttcaccaaccagcttaagtctatccaacgtggtggtcagatgcagatgcgtgagtttaagaagccttctgctatgaataccttggttaaaggtattccaagtctggcatctgcctatgtaactggtagtaagtctggcaaggcattgggtaaagccttaactgattctcgcacatattcatctggaacaagaggtatttaatggcaattgagcgacaagcagtacaaggtctgccacaagtgcaggccacttctcctaatgtcatgacctttgcacctcaacaagtgggaggtgtagaggctggcgtggcttctacctccggtagtaggtttatcgaagaccttattcgtgcagcaagcagcgtggctgatgttaccactggtatccttaatcagaagattgaggaagataaggttgttcaaatggaacgggcatataacggattaatgccttctgaggatgcaactcgtggtggcgctcgtgctaacatgcttgtcaaagctcaactgctagctaatgatgaagcagcacgaatgaaagacatggctactcgtttccaaggaacggatgacgaatggacacaacttatggttgactctcgtaatgagatgcagaataagctgttccagcaataccctgagttgcaaggtgacaaagatactatgcgtatggtcactaatgtcttccaagaacagcagcctcagatttgggctacacgaacccagcataaacttgaccgtgaacaagcagaccgtgaggatacctttgacgggcgagtggcttctacttgggattctaatattgaccctgaagcctctggctatgctttacaggaacgaatccgcgaaggtcttactcaaggattactacctgaacagatgcacaagaagttagtccagcgagcaatttcacttgcacaaggcggtgatgttagcatggctgaagccctgaagtatgtgaaggacgataagggtgtttctgtttatgctaagaatccacagcttatcacagccatcactagtggtaatgcagtttgggctaggaataatgtagctgatgtaactcgtatgtctttcgaagttaaagaatcctaccttgcaggtgatttaactgatgaagaactgttggaacgagcacagcacattaataatctgacaggtaactctgtcttctctaatccagagctagaggcactgatgcgccaacgggctaagcagaatgcagagctaggtgcaatgcaggatatgcgacgtgagctttactctgaccgcctgactggcttccaaggtaagactgataaagagaagaaggcttacattgatgttatcaaacaggatagccaactttatgcagaccagcaaatcaaacaacgtggcttggacccttacagtcaagaggctgaagctattcgtggtgcagtggaagtgcagcgcctgcaattcatgaactccaaaggcttagtggatgatacctttgagtctcgtatcaaagccatggaatctatgctatcgcctgagcactttgccaagggcgaaccacaggagttgatgactattcgccagttgtgggaacagttgccagaagagagccgaggtgtctttggtgacacggtgaatggctacatggataactacaacactgcactacaaatgggagagacacctttgcaggctgcaaggtttgcgcgtgaagcacagcagaaattctctcgtactgagaaggaaaccaagaagttcaactcagctattggagatgcactggatgaggtatctggtgctggctggtttgatggtaaaaccgaagtgtcagacttaggtaaagctattgcggaagaagagttacgagctaaagccaatatgttgtggtctagtggtatgcgtaacatggattccatcaagaaggctttaattacttggggcaataaacgctacactcaatcagaggatgcaaagacttccggtggctatttcattaaaggtgattacacttctgcatctgatatgcttatgtcagttgggaaaggcgtaaaccctaccgatgtacctctggcgcttggtaggtatgtagaaacacagatgccagaattgaagaaggagcttcaagagtgggaaactaaagatgatatatacattgattacaatgaacagaaaggtactttcgtgattcgtgctggtgcagcaggtcgccctctttctggagtaatccctgtaacctctttagataccacttcactactagattctgcctatcagaagaaagtagaggaacgagataaaggcgagtatgttcacccttatcgtacagatattggtgcacaagagcctatgccagctaaaccaactgccaaagatattggtaaatttggactagctaacttcctcatgtcttctgcttttgcttctggtgagaatctgccttctaacttcgagattaactatcgaggtaatatgcaacaattctatgacaagctagctatggatgagaataaagataaagttggctttaataaggcaactggaacctttactccatataaagatgctcacggtgagtctatcggttacggtcatttcttaacggaagaagagaagcgaaacgggtatattaaggttggtgatgaactagttccctatcgagggtctatgtctcagcttacagagagcaaggctcgcgctcttatggagcaagatgccaagaagcatgtgcctcctactcgtgactggaagattccgtttgaccagatgcatcctgcacagcaacgtggcttgatggatttaacctacaatttaggtaaaggtggaatccagaactcaccgcgtgctcttgctgcattcaaagctggtaagcttacggagggctttatcgaaatgctgggcactgcatcaagtgaaggtaagcgtatccctggtttactgaagcgacgcgctgaggcatacaatatggcatctgctggtggtgtgcctaagattaccgaagtggagactcgtgaagatggctccatgtgggttaggtttggtggacctatgccagcaggttctgtctcggcatggactcataaacgtattggcgcggatggttggtatcaggtttatgaggctgcacctaccaagttagctaaaggttctaaggtaggtaaatttaagttgtagtatctaactcaaggcttgtctcacatgtgagacaggtctttatgataggcactatggaggaattatggaacaagacattaagactaattgggctggatatgtccagtctactcctgagccgttttctattgaggcggctccggtatcggctcctacgatacgccagcgtaatgagttacaagagcaagttcttgaagctaaagctgatgctgatatcttaggtgctgtaggtgctgccttccagaatgagtggttggcattcggaggcaagcggtggtatgaccgtgccactgctgatttcacacctcaaccagacttcgagatacaacctgagcaacgtgaagcactacgtttcaaatatggtacagatatgatgcagacaatcactgagggtgttcgttctgaggatgaattgaacttccgtattcagaatgctgatgaagaccttgagcgcaataagcgcattgctcaggctggctgggttggctctgtggcgacgattggcgctgctgtgcttgaccctgtgggatgggttgcctctattccaaccggtggtgccgctaaagttggactcgtaggccgtgctgtgcgtggcactatcgccgctggcgtaagtaatgccgctattgaatccgtattggtccaaggtgacatgactcgtgatttagatgacattatggtagcactaggctccggtatggctatgggtggcgttattggagctgtagcgcgtggtagggccactaagctcagtgagcaaggagatgacagggctgcgagcattgtgcgcagtgcagacgcaggggaccgctatgtgcgtgctgttgctgatgatagtatcggtgcgatgcgtgttaagggtgaagaggtactcactgagggtgcatttgatatctctagcaaaggtgaagatttgctgaaaaccctacagcgggaaggtaatgcaattgatatgacccctcgccgctgggccggaactctgtctgcccttggtactgtcgtacattcctctcaggatgcaagtgtacgcggccttggtgctcgcctgtttgagtccccccaaggcttaggtatgcagaaggcatctgctagtctcatgcagaatactaacttgaaccgtctgaaatctgctgatatgaatcgtttcaacgatgggttcgatttatggctcaaagagaataatatcaatccggttgcaggtcatactaactctcactatgtgcagcaatataatgagaaggtatgggaagctgtacgcatcggtatggatgagtctacgcctaagtctatccgtatggcagcagaggggcagcaagctatgtatcgtgaagcattagcattacgtcaacgctctggtgaagctgggtttgaaaaggttaaagcagatgataagtacatgcctgatatttttgacagtatgaaggctcgtcgtcagttcagtatgcacgataaagaggacatcattgagttattctctcgtgcataccagaatggttctcgtaaggttccaaaggaagtggctgatgatattgcacgagcacaagtaaaccgcgttgctgatgccaccttgaccggacagcttagctttgaaaaggctatgtctggtcaaaccaaagcagaatatgaagcactcatgcgcaaagcaggctttagtgatgaagagattgaaaagatggtagaagctctggataataaagaaaccagagataatatctctaaccgagctaagatgagtttaggcttagatgttactcaagagtacaatggtattcgtatgcgtgactttatgaacactaacgtggaagagttaacagataactacatgaaggaagcggcaggtggtgctgccttggctcgtcaaggtttctctacctatcaggctgcacttaatgcaattgatcttgtagagcgaaatgcacgaaatgcagctaaagatacaaaagcacacgcacaatttgaagcggagtcggctaagatccgtcaatcagagcctgattacaagaaggcacaagagaagattgaagagttaaagaagcgacttaaattgaaagagaaagatgaagcagctggtctggctattgatgaagaaatccgtcagatgcgagaagggcttcgcttgattatgggtaaatctatcgattcaaacccacaagatttgtctactaaaatgctgcgtcgtgggcgtgacattacaggtgtacttcgcttaggtcagatgggcttcgcacagctaggtgaacttgctaacttcatgggtgagtttggtattgctgccaccactatggctttaggtaagcaattccgcttcacctctaaggcgttgcgtaatggcgatggcttcttccgagataagaacttggcagaagtagagaggatggtaggttacattggtgaggataactggctaacaaccaagggtgcacgtccagatgagtttggtgatgtaaccacagtaaaaggaatgatggctcactttgaccaatccatgaactcaatacgtcgtgctcaaaccaacctatcactcttccgcatggcacagggttctctggagcgaatgaccaataggcaaatagctttgtctttcattgaccaccttgaaggcaagaagattattcctcagaagaaactggaggaacttggtcttactcaggagttcatgactaacctacagaagcactatgatgctaactctaaaggttctggcttgctcggctttgatacaatgccttatgccatgggtgaaactttagctaatgctattcgtcgtaagtcaggtctaattatccaacgtaacttcattggtgatgaaggtatctggatgaacaaagcactaggtaagacatttgcacagcttaagtcattctctcttgtatctggtgagaagcaatttggtcgagggattcgccacgataaaattggtcttgctaagaagacagcttacgggtttgctttgggttcaatagtgtatgcggcaaaagcctatgtgaactctattgggcgagaagaccaagatgaatatttggaagagaagttatcgcctaaagggttggcctttggtgcaatgggtatgatgagtacaactgctgtatttagtctaggtggagatttcttaggtggcctaggtgttctaccttctgagttagtacaatcccgttatgaggctggctttcagactaaaggtttgatagaccaaataccactagtaggtgttggtcaagatgcatatcgtttagcagattctataactaaatatgcagagggtgatacagaaggtgtagatgtggcacgtagggctttacgcttagtgcctctaactaatgtaataggaatccagaacgcattgcgttatggcttagatgaactggaggattgatgagttatactttcacagaacatatagccaacggtacgcaagtaacctatccctttagctttgctggtagggataaaggttatcttcgtgcctcagatgtgatagtggaatctcttcaaggtaacacttggattgaagttacatctggctggcaactaactggcacgcaccagattacttttgatgtagcaccagttgaaggtttgaagttccgtattcgaagggaagtacaaaaggaatatccatacgctgagtttgaccgtggtgttaccttggatatgaagtctttaaatggttctttcattcatatactggagattacacaggagttacttgacgggttttatccagaaggatacttcattaaacagaatgtaagctggggcggcaataagattactgatttggctgatggcacaaatccgggagatgcagtaaataaagggcagcttgatgccatcgacaagaagcatacagattggaacgccaaacaggacattgagattgctggccttaaggttggtatgacttctggtattgcgcacagaactgttccttggtacacgatagcccaaggtggtgagatttccgtaaaaccaccttatgaatttcaagatgcactagttttccttaatggggtattgcagcaccaaattgtaggcgcatactctataagcaacaacactatcactttcgcagagccgcttgtggctggtacagaggtgtatgtgttggtaggtagtcgtgtggctacatctgaacctaatattcagttagatttgaactttgacttagtagaaggccaacaagtagtaaagattggctctgcatttaagtatattgaggtttatcttgatggactattacaacctaaacttacttatcgggtagatggtgacactgttactttctcagagggagtgccagaatgccggatgactgctaagattatcacagaataaggaggtgggatgattaactccgaactggtagatagtggtgtgaagcttgcgccacctgcacttgtatcaggtgggtacttcctcggtatcagttgggataattgggtgttaatagcaacattcatttataccgtgttgcaaattggggactggttttataataagttcaagatttggagggagaagcgtgagcgtacacaataaacatgcagctacagaggatgaggttggcattctgcatggtgctattaccaaaatctttaataagaaagcacaggcaatactggacactatagaaggagatccagatgcagcattacatttagtgtctggtaaggatattggtgcgatgtgtaagtgggttcttgataacggcattaccgccacacctgctgcacagcaggaagagtccaagttatctaagcgcctcaaggctatccgagaggcatccagtggcaagattattcaatttactaaagaggacaactaatggctaaggcaagagaatcacaagctgaggctcttgccagatgggagatgctacaggagttacagcagacctttccttacacagcggaaggtttgcttctctttgcagatacagttattcataacttaattgcaggcaaccctcatctgattcgtatgcaggcggatatcttgaagttcctattctacggacacaagtaccgcctcatcgaagcgcctcgtggtatcgctaagacaacactatcagcaatctatacggtattccgtattattcatgaaccgcataagcgtatcatggttgtgtcccaaaacgccaagcgagcagaggaaatcgcaggttgggtagttaaaatcttccgtggcctagactttctggagtttatgctaccagacatctacgcaggggaccgtgcatccgttaaggcattcgagattcactacactttacgcggtagtgataagtctccttctgtatcctgttactcaatcgaagcaggtatgcagggtgctcgtgctgatattattctagcggatgacgtagagtcgatgcagaatgctcgtacggcagcgggccgtgccttgcttgaggagctgactaaggagtttgaatctatcaaccagtttggggatatcatttaccttggtacacctcagaacgtaaactctatctacaacaacctacctgctcgtggttactctgttcgtatctggactgcgcgttacccttcagtagagcaagagcaatgttatggcgacttccttgcacctatgattgttcaagatatgaaggacaacccagcacttcgctcagggtacgggttggatggtaatagtggtgcaccttgtgcccctgaaatgtatgatgatgaagtcctgattgagaaggaaatctctcagggtgctgctaagttccagcttcagttcatgcttaacactcgcatgatggatgctgacagatacccattacgcctgaacaatctaatcttcacctcgtttggtacagaggaagtccctgtgatgcctacgtggagtaatgattccataaacatcattggtgatgcacctaagtatggtaacaagcctacggatttcatgtacagacctgtagctcgcccatacgaatggggtgctgtctcccgcaagattatgtatattgaccctgcgggtggtggtaagaacggagatgagacgggtgtagccatcgtattcctgcacggcacattcatttatgtgtatcagtgctttggtgtacctggcggataccgagagtcgtccctgaatcgcattgtgcaggccgcaaagcaggcgggtgttaaagaggtattcattgagaagaactttggtcatggcgcgtttgaggcggtaattaagccgtactttgaacgagagtggcctgtaactctggaagaagattacgccaccggacagaaagaattgcgtatcattgagacgctggagccgctcatggcagcccataggcttatcttcaatgcagagatggtgaagtcagactttgagtcggtacagcactatccgcttgaactacgcatgtcctacagtcttttcaatcaaatgtcgaacataacgattgagaagaacagcctccggcacgatgaccgcctagacgccctgtatggcgctatacggcaattaacttctcagatagactatgacgaggttacacggattaatcgcctcagagcgcaggagatgcgagattacatccatgctatgaacacacctcatctacgcagggcaatgctatatggggattacggtactgagcgaagagtgaccaacacttccgtagcgatgcagcagcgagtttacgggcagaactaccgaaataaatcggcaagcagaaatacactttctgcaaggatttcaaggacttattaattactggacactatagaaggaaggcccagataataagagaaaataataggtaatatatatatataggttaacctaggttatataggtatgccttagtatgggtgtactcctgtacaccctattccttactaccttactatatttacataataggagagagacaatggctaatgattatagtagtcaaccattaacaggtaagtctaagagaaagcaggtacaacctgtaagtgaagaactaatgcttccggtaatcccaaaagaggaagctagtaagaaaatcaatgttattaatgatgccaccaaatcaggtaaacagaaaggggccatggtgtgccttgaagtggacggtggtgcattgaagattgctatcgcggttgatggcaaagaagattcagagtggaagttagtgacagtggaaccccctgttaccccagtttaagagaaggaggagattacatggctaaatatggtactacaggttctgttactggtcaggcttttcgagtaaaagcagtacaaactattgcaacggcaatccctatgcctgttgttaaagaagcagaccttaagagtaaagaccaccctatcaacatcaaacatttatcaggtaagcagaaaggtgcaatggttgctcttgagaaagatgacacaaccttacatattgctgttgcacgtggtagtgaacccacagacccttgggatgtaactggtatggaagaggacgctgttactccagcagggtataataatgcttaataaatacttcaagcgtaaagagtttgcttgccgttgtggctgcggtacatccactgttgatgctgaattactacaggtagtaacagatgtgcgtgagcacttcggaaagcctgtagttatcacttcggggcatcgctgtgctaagcacaatgctaatgtaggaggagctaagaactccatgcatcttacgggtaaggctgctgacattaaggtacgaggcatcttaccttctgatgtacataagtatcttactgataagtaccaaggcaagtatggtattggtaagtatacctcctttactcatattgatgtacgtgacgggtgtgcacgatggtaggttgtgttgcatggtgtgaacgcatggttgctaaggcttcagaggaaggcaactatgaagattggcagaactactcaactttattagctcaatggaaagggagatgcaatgaaaaagctgttcaaatctaagaaggttgtaggtgcactagttgcattggcaattgctcttgtttctgtaggtcttggtgtagaccttggctctggcacggaatcctctgtgacagatgtggtctgccaagtgatcacctgtgaataagtttctagaagttctggcaggtcttattggcctgcttgtctctgctaagaagaaacaagaagagaaggaggcacaaagtgaagcgaatcatgttagtgacaacccttctgattggttcgctgaccacttccgggtgtcagcaggcgttaccagagaaagcaatggtgaaacctctgaggccgacgctgacggcagtttacgaggtagacgataaggtctgctttagtaagcctgacgctacaaaacttggtttgtacattctctcgctagaacgcggatacaattaatacatagctttatgtatcagtgtcttacgatttactggacactatagaagagataagatagcgccgttcttttgagcggcctattactagccaatcttcatagggagggttggaaagtaataggagatagcatggctaaattaaccaaacctaatactgaaggaatcttgcataaaggacaatctttgtatgagtaccttgatgcgagagttttaacatcaaagccgtttggtgctgcaggtgacgccactactgatgatacggaggttatagctgcttcattaaactctcagaaagctgtcacagtctcagatggtgtattctctagctctggtattaatagtaattactgtaacttagacggtaggggtagtggcgtgctaagtcaccgttccagtacaggtaactacttagtatttaacaatctacgtgcaggtcgcttaagtaatattacggtagaaagtaataaggcgactgatacaactcagggccagcaggtatctcttgctggtggaagtgatgttactgtaagtgacgttaacttctcaaacgttaaaggtactggtttcagtttaatcgcataccctaatgatgcgccacctgatggacttatgattaaaggtattcgaggtagctattccggctatgctactaataaggcagccgggtgtgtacttgctgactcctcagttaactccctcatagataacgtcattgctaagaactaccctcagttcggagcagtagagttgaaaggtacagccagttacaacatagtcagtaatgttataggggcagattgccagcatgtaacttacaacggcactgaagggccaatagctccttctaataaccttatcaatggggtgatggctaataaccctaagtatgcagcggttgttgcaggcaaagggagtacgaacttaatctcagacgtgctcgtagattactcaacttctgatgctaggcaggctcatggtgttaccgtagagggatctgataacgtcataaataatgtgcttatgtcaggatgtgatggtactaactctttaggacaagggcagactgctacaattgcacgctttataggtacagctaataacaactatgcgtctgtatttcctagctacagtgctacaggtgttattactttcgaatccggctctacccgtaacttcgtagaggtaaagcaccctggcaggagaaacgacattctcagttctgctagtactattgacggtgcagctactattgacggcactagtaatagtaacgtagtgcacgcacctgccttagggcagtacataggtagtatgtcaggtaggttcgaatggcggattaagtccatgtcactcccttcaggagttcttacttctgctgataagtacagaatgcttggggatggtgctgtgtcattagctgtaggtgggggcacttcttctcaagttcgcctatttacttctgatggtacttctcggacagtgtccctcaccaacggtaacgtgcgtctttctaccagcagcacaggctttttgcagttaggtgctgatgcaatgaccccagacagtactggtacatacgcattaggttccgccagccgagcatggtctggcggttttactcaagcagcattcactgttacctcagatgctcggtgtaaaacagaacctcttactatctcagatgccttactggatgcttggtctgaagttgactttgtgcagtttcagtatttggatcgtgttgaggagaagggtgcagactcagctagatggcactttggcatcatcgctcagcgagctaaggaggctttcgaacgtcacggtatagatgcacatcgctatggcttcttgtgcttcgacagttgggatgatgtatacgaggaagatgccaatggctctcgtaagctgattacaccagcaggttcccgctacggtattcgttacgaggaagtgctgatattagaggctgcgttgatgcggaggactattaagcgtatgcaggaagcactagcttccctgcctaagtgagcaacaggcagtgcgtaagcactgcttttagcgcaacttttcttaaaggttatcacgatggtagcctttcagaaaaggaggttacatgattcaaagactaggttcttcattagttaaattcaagagtaaaatagcaggtgcaatctggcgtaacttggatgacaagctcaccgaggttgtatcgcttaaagattttggagccaaaggtgatggtaagacaaacgaccaagatgcagtaaatgcagcgatggcttcaggtaagagaattgacggtgctggtgctacttacaaagtatcatctttacctgatatggagcgattctataacacccgcttcgtatgggaacgtttagcaggtcaacctctttactatgtgagtaaaggttttatcaatggtgaactatataaaatcacggataacccttattacaatgcttggcctcaagacaaagcgtttgtatatgagaacgtgatatatgcaccttacatgggtagtgaccgtcatggtgttagtcgtctgcatgtatcatgggttaagtctggtgacgatggtcaaacatggtctactccagagtggttaactgatctgcatccagattaccctacagtgaactatcattgtatgagtatgggtgtatgtcgcaaccgtctgtttgccatgattgaaacacgtactttagccaagaacgaactaaccaattgtgcattgtgggatcgccctatgtctcgtagtctgcatcttactggtggtatcactaaggctgcaaatcagcaatatgcaacaatacatgtaccagatcacggactattcgtgggcgattttgttaacttctctaattctgcggtaacaggtgtatcaggtgatatgactgttgcaacggtaatagataaggacaacttcacggttcttacacctaaccagcagacttcagatttgaataacgctggaaagagttggcacatgggtacttctttccataagtctccatggcgtaagacagatcttggtctaatccctagtgtcacagaggtgcatagctttgctactattgataacaatggctttgttatgggctatcatcaaggtgatgtagctccacgagaagttggtcttttctacttccctgatgctttcaatagcccatctaattatgttcgtcgtcagataccatctgagtatgaaccagatgcgtcagagccatgcatcaagtactatgacggtgtattataccttatcactcgtggcactcgtggtgacagacttgtaagctctttgcatcgtagtagagatataggtcagacttgggagtcactgagatttccacataatgttcatcatactaccctaccttttgctaaagtaggagatgaccttattatgtttggttcagaacgtgcagaaaatgaatgggaagcaggtgcaccagatgatcgttacaaggcatcttatcctcgtaccttctatgcacgattgaatgtaaacaattggaatgcagatgacattgaatgggttaacatcacagaccaaatatatcaaggtgacattgtgaactctagtgtaggtgtaggttctgttgtagttaaagacagctacatttactatatctttggtggtgaaaaccatttcaacccaatgacttatggtgacaacaaaaataaagacccatttaaaggtcatggacaccctactgatatatactgctataagatgcagattgcaaatgacaatcgtgtatctcgtaagtttacatatggtgcaactccgggtcaagctatacctactttcatgggtactgatggaatacgaaatatccctgcacctttgtatttctcagataacattgttacagaggatactaaagttggacacttaacacttaaagcaagcacaagttccaatatacgatctgaagtgcagatggaaggtgaatatggctttattggcaagtctgttccaaaggacaacccaactggtcaacgtttgattatttgtggtggagaagagacttcgtcctcttcaggtgcacagataactttgcacggctctaattcaagtaatgctaatcgtatcacttataacggaaatgagcacctattccaaggtgcaccaatcatgcctgctgtagataacaagtttgctgctggtgggcctagtaaccgattcactaccatctacctaggtagtgaccctgttacaacttcagatgctgaccacaagtacagtatctctagtattaataccaaggtgttaaaggcttggagcagggttggttttaaacagtatggtttgaatagtgaagcagagagggaccttgatagcatacacttcggtgtcttggctcaggatattgtagctgcttttgaagctgaagggttagatgccattaagtatggaattgtgtccttcgaagaaggtaggtacggtgtgagatatagtgaagttctaatactagaggctgcttatactcgttatcgtttagacaagttagaggagatgtatgccactaataaaatcagttaagcaagctgctgtacgccagaacacagaagagcttattcaatcaggacgtgaccctaagcaagcctatgcgattgccaaggatgtacaacgtcgtgctatgaagaaaccttctgcatcttaaaggagattgatatggaaacgtgggtaactgtccctggctacccacggtatcaagtgtctactcatggacgtgtcaaatcactcattggtaatcacaagatactgaagccgggcaagtcaaagagtgggtatttgaacgtagttcttagtaacgaggagggcaagaagacattccgtgtgcatcgcttggttgcactgtgtcatttgcctaatcctcataatcttcccttagtgaaccacaaagatgaagacaaggcacataatcatgtagacaatttagagtggtgtactgaagagtacaatctcaagtattcacgtgactacgataggtcttctcttagtgtaacccaagggcagaagaaggtatggcttccagtagacctgtaacattcaggtaacaaagtcaaaattttgatatatgcgtgtgtcagctctctcgccctcgccctcgccgggttgtccccatagggtggcctgagggaatccgtcttcgacgggcagggctgatgtactccttggatagtacaagggaggcggagggagcgcctaggacggcctagggaatggcttagtggtggacaaggtgattaccttagtgaagcctcttagtgcattcctgaggccattcagggcgtttatgagggattgacagggtggatgggtgtgggcta

SEQ ID NO: 16 - DNA, 72689 bp, Unknown
  Podoviridae; G7 virus
tggctggggctacacccttacactcaactagcccccccggtatgttgacggtgtagccactaccctaccccaccttacacgttacacatgctccgcatgttatggacatgtcgtcctatcatcaactattggagctatcatcatgactactaccgctactgtacgtatgaccgcaggaactttacttggtactgttaactcagctgctactactgttgcagatacatttggtacagcaactaaagcagtaggtatgcttaattcatatgtaagtactatggcagagaaacaagccatccgtactaaattagaaatgcatacctttgttaataaactggcagaggagacagctatgactgagactctgcgtaagaaaagtattgaagaattctgcaaggataaagagaacgctcggatctataacgcagaatattcaaaagtaatcgacatcctgactaaaagctaagtcacataggaggctcttcggagtctcctgttttgaacattagatagatagtcaaaagtagataaatatctactttaggagaaataaaatgtccctgacagattgcaaatctgaatctccgcaggaagcattagaacgttttgaagaagccgttcgtcagcaagagcaatatcagtctgacatccatcattatggagaatcagacatagatatctcagacgaaactgtagaaagtaagtatcagaaagctaaggctgaattactaacctggttgtcctacattccgtaaaaaccaagacgctccgcgtcttatggatgatgtaaatgcatccactaatcattgaacttttatccttttgtttgggtgttctcaccgacgagttcacccgtaaatcacataaatctggagagtacaaaatgtctattcaaaaattcactttcggtcaatctaacaatgctgctacttctactactaaaactgataagcctaaagctcagttctggctgaacattggctatgtagctaacgaaggttctgatgatgagaaattcatctcattgcctactggtattccgctggatactcaggaaccgctgcctactaatagcagcaatgctgacttccgtgctatgcgttgtgcacagaacgacttgctggaacagttaatcgaatatgctcagaacctggaaccaggtgaagaaggtatcattaacctgcaagttcaacttcgtcgtgtgaaagcagaggctgctgacatcccagcagacgagaataaatatgctcgtaaactgactttctaatcaaccactagactcccttcggggagtcttttatttttaactagacgataatctatttctactttttgagtatctttagacgaagggtactgaaacagtaaccagatagatatagatttatattagatgaaggagtaaccattatgcgtacagtatgtaaccgttataactcacaaaagttgattgttatgttacaaccttggggtagtaagatgtctcttaatgctcgttggcaggtatctgtagaagataagaatggtcagcattatgaccacttctttgtagctaaacctactcgtaaacaaatccgtaaacttcataaggtgtaagactatgttggacttcattgcgtttgtaatactctgttatgtgctgtatcgcctacgtggttacattctcaatggagccaagtgggtaagaactaagctggtacttatctgtaagttacctgttgtattcgttaagtgtctgtttgcttccatcgtagctaaagaggtacgcaagcaactatgggctaaagaagcagaagagtttgcaaagaggaaccagtgatattcactaacatagaagatgccattgaagagtgtatctttcgtagatatcacactggtgtacagaaacgacactatggtgttgtgcaactcaatggctatcaaatggttgtaagaattgtacgtaacagcaaaccttttaactttatgtggagtactaaacatgcgtaagtcattaatcatgggaaccaaagctgacgtacagagaatgaaggaacgtctggctgctaagcaacagacatctgaaccagtacgtaagattgttactttcaatcataggtgtatcaaataataaggagtcctccaataggaggctcctattttttatttttgaatagttagatatgtatttaaataggagaaataaccttgaatgaaatagtatgtatacttcctcaccaagctaaagtagctgacaggaatatacgggtacatttaccattcccattaagtaatccatttgctcgtaacgaaagaaccacggtagaagatatagaggtagcttatgaggcttaccttcgtaatcgtcttattaatggtgacaagttaattacagcagagatggaaaggattgctggctttgtaactgatagtacaggtaaacctgttggtttaattggtactgaatctgatgttaacgttattcgtaaaatactgatggaggcactcggtgaacaatcttagtgatgtcatcgtagataaaacaatattagtaaatcccaaagggtatgcctggttcatgctaaagcatacccgtaaggtatatgttagaaaggtatatatacgtaactttggtaagttatcttacagagaagtacgtattaataatgagatgtactttctagatgaatcagtgattatcaaatcaactgaagacagaaaggctccttactttaactattacggattcaactaaaatgatgtactcaactgattatggtgtttgccctgtatgtaacaaacgtaaaggagttgctaatcataagcgttgtagtcgtatattacagaaacaacggaaccagaaagaatgggataagctgttggaaaaccagcataaagaagaaaatcaacagatggctgttaaggcatctactcaacgtattcgtcgtattaactatatacaggggtatcagaaatgagactaatcgtagctggtggaagagacttcgtaaataccaatcttatgattgaggaattacagaagttagtaaattcagtaaatatacctgaatgcccagaattagtatgtggtatggctcgtggagcagatatgcttgcatataatctatgggctaataacaaaatgcctattcataatttcccagcaaactgggataaatatggaaagtctgctggttatagacgtaaccaggaaatgggtgaatttgcagatgctgctgtatgtttctgggatggtaattccaaaggaaccaagcacatgattgatatcatgtataggcttaataaacccgtatacgttgtgaggtactaaatgattattacatatcctacaggcaagactgtggaatatatgaagcacaccattcaagtacctcactgggttaagtatatagctttattaccacgtcaatataaaagtgctaatacctcattaataggattctctaagaagcctaagctaacagaaaacaatatctgggtatcctctgggagacaagaagaaattggtttttgtgatttgagtattgtcgataataacatctatgggacattgagaaaggtatgaaaactattctagtagttcatgattctacatttacagatgtagataaaatgatgcgtaatattgattatgtatctcaaacaagccaggcattcaatgaagaatttaccctctactgcaatgctgaatctccactggttcctatccttaaagaatcaggtctaccattctctacagagaacttcccggaagaaccagactatgtaatctcattcatttatgacttacatgatggttctgaaactagtgaactagctatgaaccagtggcgtagtaaacgtcctgtgttcgcattccaggtacttaagccatgatttataaagaatattatgtattcaaaaagggggatgattttatagctatgccggatgattatatagattggcatacaactcccgtattaaatgaagcattttctgtacctaacctagaagaggttaataaagtaatgaacggggtaatgttaacaagagggttagcttacaaaatagacgcattagaaggaactactgtatgtaaagtaagtacatctattgaggcattaaaaccatgaagactattacattaggggacgacaccaatgctttgctgggtgtagctgcacgtccaattatcattgttaataaacatcacggtaaatccggtgagtatatcggacgtggttcaccattaggaaatccattcgttattggtaaagacggttcaagagaacaggttatagccaaatatcgagtatggcttaatgaacaaatcatgaggaagaatcaagctgtattggatgaacttaatcgtcttggtaataaagccattgatgagaaagggttggccttacagtgcttctgttatccgaaaccatgtcatggtgaggttattaaagagaagctagtaaaagctatgtataactactttgtggagaatccaaaggggtaactaatgaaagaaatattcgtattcactaccaatacactaggacaacataccaatgcttctgccaagttagcttataagaaacatggtgctcgttggggcatggcctatggtcactatggtaatagctttgctattccagtaagagatggcaatggtaaccgtatcaaagagggtgctatctatggcttcattgagggctttattgcttatgcatctgccaatccacaatgggatttcaaagtcatgagtaatgactacctggacccataccagttcattaatgtaaccggaaatgtactgttacccgaagcatggcgtaaacacttaggcgatgcttacaactactggagttaataatgacttatgaagaactgtgggctgctcaagtcagagccagagcacttacacggcatgatatctattgtgcattacaaaacgaactaaaggatcgtactaaactaggtcacatatctggtttaattaaaatacctatgcgtagtctggtatggccttaccagaagaaaaataacgagtttagtggtaatggtttatatgtacgtattgactaccttggtcaagagaacagtattcgtattaccttttggactaaacgttaggtaatagctgctccgcagcttttggttattaatcacatttaggagaataagcgatgtactcatccattgaacatcagaagcaactcgaaattcttttcaacaaaaatcaattactccctcgcatgaggaaggaatttgaggactccgaagaaattgactttaaggcattcgctgcctatttggaaattgattataagctgctcattgatgcaatggtgcagattgccctacataaacgtgctgaccttcagactatgattggctctcttatgagccattcagatgatgctcagtacatcgctgactgtctgtataagatggcagagaatgactgcttcaactatgaccctaccatcgacaagttcggtgttatctacgagattagtgaagatgttcagatggaactggaagcattccagtatccattacctatcgtaagtgctcctaagcctgttctgtgtaaccgtgatacaggttactatgagagcaggggaagtattatcctcaagaagaaccatcatgagatggatgtctgtcttgatcacatcaaccgtatgaataatcaacgtctaagcattaactgggacgttgctaactatgtaaaagactctcgtcctaatatggataaacccaaagagggtgaaacccgtcaggaatatgagaaacgtgttaaagcctttgagaagtacagccgtactgctaaggaagtaatggagttagtgaccaaagaaggtaataacttctcactgggtcacaaatatgacaaacgtgggcgtacttacgctcagggctatcacatcaactatcagggaaccagttacaacaaagctgtactggaatttgctgataaggagttagtaaataatgattaatcatcgtgcagtaaaagacttctatgcccatagggaattggtactaaaacgtatcaatgaagcaatgaaacgtgaagctgaagctaaacgtaaccgtaaataaattcaaatgcgagccaagaggactaatcccaatgagtgagttattaaaactatggcttattagccagaatgagcgtaaggggtgggatacgttcgactctgctgtggtagcagctaaaaccgcagaagaggctcgtcttattaacccagatggagaatggagtacatactccgcttggtgttcttccccagataaagtgcacgtcgagtacctgggtattgccaccgaaggtgtggaaccaggaatagtattgtcatcatttaatgctggctaatacatccaataagcaggctctccatagtggggagccaagaagcaaaaggaacataaaatgcaactgttaaccgctcgtgaatacctgaaagtagatattgccaataactatggtctggataaaaagacctgggatgagcgtattgcttggttcgatgagaatgaagctaacttgcttaatctggtagatgaagctgaggaatctgcactgttctatgctggtgtaaacgcatggaaagatatgaaagctggtaagcctatcggatatgccgtagccctggatgctacatcatcaggcttgcagttactggcctgcctgactggtgaccgctctgctgctgaactgtgtaacgtagttaattacatgggagagaatggtaagccattacgacgtgatgcttatacagttatatatcacaagatgctggacatccttggtgaagcatcccgtattaaacgtagtgataccaagcaggcagttatgactgcattctacggttcagaagccaaacctaaagaagtattcggggaaggtatccgtctcaagacttttgaaaatgtaatggaaacagttgcaagtggtccttgggcacttaacaagttcttactgcaatgtggtaacccggatgctaaccgttacatatgggtactccctgacaacttccacgctgtcattaaagtcatggttcttgaagtacagactgttaacttcttgggtaaaccatttgacatcactcgtatggttcagggtactgaagagaagacccgtatgctctctgctaacatcactcactctattgatgggatggtagtacgtgagatgctgcgtcgttgtaacttcgaccctaaactggttgcctatgtacgggaactgtgcgatatcgggccaagtgaataccccgttattgaggggaaccaagagaagactatggaaatctggaatcattatgaaaggtcaggattcctgtcgctgtctatcctagacttccttgacccgaatactattgcactggtagaccgtcaagtagtagcagatatgatcgacactatgcctaagaaaccattccctgtaatgactgtacatgattgcttccgttgccaccctaactatggtaatgacctgcgtcgtcagtacaatcagattctgtctgacattgctaagagtgacttactgggcttcattctgtctcaagtactgggacaagagttctctgctggtaagctggatgacagcctctggcaagacattctagaaacagattatgcattaagttaataaactagcctcattccttcgggagtggggctttattttttgcttggaggtagcaactatgcttatcaattttgaagtaatctctcagctaatactgatagttttatctgtactggttctggctacgatagttcgtgcccacaagtctaagtttgcttactgctactatggagcatactcactaggatgctttgtaatggcaggatggatagcttttgctatctactgtgtaaacaactaaccctcttaacggagggtttatttttttacatgtcatgtatactaatcctgctatttacttatgaggaaattcatatgccaactttaaaagtaggttttaacaaaaccaccaatgtcgcaactgtactggatgcgagtggttctatcccgggtggttcagtagaagtaggtacttttgtacacccggatgccacttacccagatagtttagttatttttcatggtgttcgtgatctgctgtataaacgttctgctaaagacccatctgaagaaggcttctggcctaacaacatcgtagatatgcagtccatctctattgatatgcaagctactccacgactgactattgctactaagctgcctcgtgtagtctccgctatcgaaggcgaagatattaactggcatgttgatgtagcaggcggtaaagcaccatttacttataaatggcagttcaaagctgatactgctggtgcagcattcactgatattagctctagtactaacccatctgctgctactgcaacattaacccttaatgacgtaaccgctgcttctgctggtacttataaagtgattgttactgatgccaatggaaccactgtagaagataagtctctactggctgttggctactacgaagcaagctcactggtagctactcctgcttcattgtctctgtctgttgctgctgatgctacttctggtaagactgtaaccattactaatgtgcctattggttcatctgctggtactttgtctattaagactgccccagagtctggtcgtgctacggctaccattgctggtaacgtattgacggttaaacctgtagctgctggtgaagctacttctgtagtagttaccaacggtaaggtcgatgtaaccatcgctattactgttgtagaataaaggtagcctttatttggggttgtaaaccctgatataaaactcccaagcttgacctcccagatgaagggaggtctttttttgacttaaacattctggagccaggaaatgtataaagagattgcatttttctcattcttactaggcggtttattaggtgcaggatttgtagctatttctaatacctactttggttctactccaaattctgtaacacaaaccctcaagcatgaatgtgaattgaatatccctcgtaatcaaaactgtgtaatgcagttcgtaccggagaaaaaatgaatatccacaatctacgtttggttgagaaactgtacgaagaatacaacgacaaccgacagcaattagctagtttgaagaagtcaccacatatggtgaaagtatcattcaatggtacggatttaggaccgcaagctcgtacaagaatacttcctgaactgctgtcattttatcaaaagagaattgctgtcttagaaaaacgctttgagcatttatgtgtagatttatcaccactcccagatgaaggagaagatgagtgaaattaacccagtcccaagcaatcttccttcgtatggttcaaggtggttctgccaccagcaaccgcaataataaaaccgcacagtctcttaagaaactgggcttagtgcagttcaatgctggtcttgggtggtcattaacccctactggagtacttcaactcaacgagttaaaaggtaactaaatgaaaactttaattgctgttgctgtagtagctttatcagttctgtcattcaatgctcaagcatccagccgtgaaactctgttagacgctgctgccgactacaaagccaataatgcaaactttgtgaaccagggttacttcatgggcatggttactatgggtgtagaggcaggaaataattgtgtaccggagaatatgaagttaggagccatatttgacagagtagcttctattatcctgtacgaccgaaaggttaatgcagtaaaagtgccatcagacatggttctgttagcaattgatacagcatacccatgtattaaatcttaattagtaattccattaactttaggagagtaagtaaatggcgagcattgactcactgaccgtatgtaatacacgtcaggcccgtaactttattatccgtgccctgcaagcaggtaacgtaccgttcctgacttcatcaccgggaatgggtaaatctgcaattattcgctctgttgcagaagaatttggtatgaaactgatagaccatcgtctgtctacttctgccccagaggatttgtctggtctaccattccgtaatggtgaccgtgcagagtttatcccattcgctgacttattccctattgagggggatgagataccggaaggatataatggttggctcctgttccttgatgagttcaactcagccagaaaagaagtagtagctgctgcatacaaactgattctagaccgtatgactggtcagaaaaaactccatcctaatgtgatgattatatgtgctggtaacaaagctactgaccgtgccattgttaacccactgggtactgcaatgcagtctcgcgtggttcactttgaaatggaacttaacttcgacatctttgttgaagacgtaatgattccacaagaatgggatgaacgtctggttgcattcttacatgctaacccaggttatctgcatgacttcgacccagcccataagaacaaaacgttctgttgcccacgcacctgggactttgttaacaaagacctcaagaaccgtcctgaaggtgctctgccagatgaagattctatctactatgcaggacacgttactgctggtaaggctacagaatttgttcagtttactcaggtatacaatcgtgtgattacgattgagaaagtagtcaaagacccgttaggctgtgcactaccagaagataacaacctgtgttgggctaccgttaatcatctggctaacaaaactactgaagagaacttcgatgatgttattcagtacattgaacgctttaaaacattcacccataagattctgtacttccgtacagtaggtagagcattaccagaacttcaggctacccctgaatggcgtaaggctgctgctaacatctctcgttacattcacggataatcacagcatgaaccggatacctcagcacacactcagtgatgaacaactcatgcgtgagtatgaccgtactcaggccaacgctttcctaggaagcagtgcagcgttctttggttcattactgtgtagtcttaaattctcatggaaacgtgaggattgtcccactgcatgtactgatgggatagagcttcgtttcaatccagacttctttatctggatgtgtccagatgcaagaaaaaccgtactaatgcacgagctatggcatgtggcatatttacatggcatccgacgtggaagccgtgacccagaaatctggaatcaggcatgtgaccacttcattaaccttcagttagaggaagacggttacaagttcactggtatcgacgaaggtatttgcaaagaccctcagtataaaggatgggtcgaagaagacatttatgatgacctgatgaagaaccctcagaaaaggcagaagccgtcagggggtgttggagcaggtcttgctggcgacatgaaatccccctcttcggggcagtcccagggtgctgttgtcaacaacgtagtacgtgcaatgcaaagtcagaagatggctggtggaacaatgcctggtaagggtgctggtcgtatggaagaggttattacccaattccttaagccagtggttccatggcaagaagttctgatgaacttctttaccgacattgatgatactcattatacgtgggccagacctaaccgtcgttacactgacatctatctaccttcactggaagatgatgaaggacgtttacgacacttggcctactttgaggatgtatctggttctattagtagtgctgactctctgcgatttaactcagaagttgcctacgttaagagccagttcaatcctaagaagatgtccttaattaccttcgacgatattatccaagaagaaatagacatcactgaagaagatacttttgaagagattaagattactggtcgtggtggtacaagccttgtgccagtacgcgagtggattattaagaataagccaaccgctgcaatcatattctccgatatgtatgttcgtccaatggaagaattaccatttgatattcctatcatctggtgtgttctgaataatcccaatgctaccgtaccttttggggaggtagttcatatccctaaaggaatgaaataatggttgttaatggtaattctctataccgttcatctcagttgctggatatcccagaccgtaaggtatcagagcatggtgtaagctatggattaggtgaagctggttatgatattcgtatcaaacaagatattaccttctatcgcttatttgggctgattccaatggtgaaagtcgttgatggaaatcaagtatcacgccatctcggtaagttcgccttggcctcagcaattgagaagttcaacatgtccccgtcctgtgtagcaatcgttcacgataagtctacatgggcaagacgtgcattatcagtgttcaataccgtaatagaaccaggatggaaagggtatcttaccctcgaactggtctatcacggtcgtaagaaattgcatatcccggctggtgctgggatagctcaagtattatttcatctggttcaggaacctgctaattacaatggcaagtatcagaaccaggaaaacaaaccagtagctgctagaccttcaaaataaaaggctatccggcttaattaaggaaaactcatgtctgtatttcaagtaacacaagaaaatactggtattcgcctgacccttaatgcgaaccaagtaattgcagtgcaagaacttaccgcaggtaactctgctattactaccgtaggtggtgatgtagtaattaccaaagaaacctatcgttcagtacgtaattacctgaagaaagctcttgctcctgcaagcaaagatgctgagtaagtagctgcttaaatagcccagcatagttgggctatttgtgaagaaactaactcaaccccacataggaaccatcatggaatctttagcagcaatccttgttctgttatttgtattagctgtataccttatccctactatcattgcttttgcacgaggccatgcctccaagtggggcattggtgtactcaatattgtattaggctggtctttagtcttctgggtagtagcactgatttggtcactgtccaacaaaggtcagaaccaagttacaaacgtaactgttgttcaaaccaatggtggcagtaaatcagagtaactaacctaagcatcattacatagtgatgcttgtggaagttacttccagctcattgcttatccatctcctaacccaagcccacctaacccgtgggcttttttatttacaggtactcttatgtcaagcagacaaaatggtaagtctatcctgcaagggctggacttaagtaagctggaacaaactgcaatgcttactctaggtaaaactatccatgatcaagtagagaatgaaattgagttagatctttacacgacaatgcaggctcttgttcaaaaaggatggactattagcagaccttttccttcatacattcctccggaacctcatctgaaatctaaggtagaccgaatcatagataagttctggcttagcccatgtagggatgatacgtatctttacctggctcaaatacaaaagaatcctcgtactaaggatgtgttcaaaggcaagagcactacccatcattacccttggtatagaagaggtagtaaatactaatgcgtatcccattcctacggaaaagggaacgaaatcctgttctttacaataaaggcatagaggatgagtatgaactcaaccgtaaagctcgttcctacacaacaaaattattcatggggactaacaatcctgatagattactggactttgtttttgaacaaatctttatcatatacagcttagctatgtctgctggttcacaagaagtaagtgataaggcaagagatgctctctgtatgctccgcagggagtatgaagccctcatgtatgaagacttatactcctttaaaaaagaaaccgctgtagcgtgttctgtggcccttactgaaggtgtagcagtattacaagaactaccccgtagtgagtttaagctggtatatgttcaggttaagaaaattacagaaaaccgtagtggtatcaccaactatctaaggtcattctaatgattaaggcaactgtcattgcagattccgttcacccagaaacaggaactcgtattactacctttgaattggtttatccccgattcattcacagtgagtttatgacccaccgtgtattcaaccgtaatgcctcaagcagtcgtgctattcccacggctaagttcatcgaacaagttcgtaatgaaccagtgatgcctagtcactggggcaagaaccagaaaggtatgcaagcagaagaagaactcactcctatggagattgaggatgctaagtttatctgggataacgctgcatctgctgctgctgtgtatgcagaacagctacgacgtgggcaagtacataagcagattgttaaccgtattctggaaccattcacgcatattcgtgtagtggtaacttcaaccagctgggctaatttctatggactgcgtgaccacaaagatgcgcaaccagagattcgtgaactggctcaagcaatgcgtaaggcacaggaagaaagtacaccgagagcattaccatatgggcaatggcatctgccatatattgctcatattgaccgtgttggggcttacaatttctgcaaacgcaatcgagttacacgcgatgaaccaagtgatgcagaagtgcatggactacttctcaaagtaagtgctgcacgctgtgctcgtgcttcctataacaacttcgaaggacgaccatctactatcgaggaagaccttggcttattcgctaagttagtagaaaaccagcctattcatgcttcacctactgaacatcaagctacacctatgaaccttggtgaaaagtatgtgaataacatgaacccagttacatgggaacaaggtgttacatccatggataaagaaggaaatctgtactcaggtaacctgcttcactttatccaattccgtaagttaattcctggtgagactattactgaatgaaaaaactagctttgtacgcaatgctaattagtaccctattaacacttaactacgcatacaaagttgcctttgtcgtagaaacagatatgcagttcattcgagctagtattctgttctttgtgagtgagtttggattatggtgtgtttactactttgctcatgactatgaagctattcgtgagcaagaggaagtaaagaaacgcatgagacgtttcattgaaggaaaatagtaagtaaacctaagacctcctcctggaggtctttttttgattctattaactcttttaggagggcgtatgcctgctaaataccgtatcaaagacacaccagtaatgtgtgagggtgagaagggtgacattgtatatgcctgtatacaggatgacttcaatgctgctctgatgttaactcaaatgacaaatacactgcatgtatcagtaacactggaccctaccggtgactatccatgctttcccatccctgctcataacctggagcaaattcatgattaatcctgaagttattcatagcaaaactggaaaagctgttccactcagtgagattgcagttacaggtgatattgctgcttgcccagctaacatcgcttccttatgtaatgtgcattgctgcactggcagaagaacgtaagttatggctggaaccaagcaaggaaatgatactggctggtatgtctgaactaaatgcacttctgaaagaaatgtatgacgaggatgggcaactagttgaaccaactgatgaccaaatctcggatgctgttgtattcacccttcaagcaatggcaagtaaacgttaattaaatttaagaagcaacacttaaactggagagtaaataaatgttagttgcagataccaatgaagtagctacctcagcgacactgggtggcaaagaaactattgcctttggcatttccgatgacccggcattcttccatgtattaagtacttccttgtataacaatcctactctggcagtagtccgtgagactatctgtaatagttgggatgctcatattgaagcaggtaagactgatactcctattcgtatcactattgatacagacaattttattacattccgtgactttggtaatggtatccctgatgaactcattggttccatttatggtgtctatggtgcatctactaagaaatccaacagtagtgttactggtggttttggtttgggatgtaagtccccattcgcttatacagatagcttccaggttacttcatggaaccgtgggaagatgtcagtatataacgtagctaaggctgcgattgagaatgacggtaagcctggcattgttcctattgttactggtattcccactgaggaatcaggtctggaagttaaattccagttaggtaagcatgacgtaaatacctttgtgcattacattatatctattgtatttaacggtgagattaaagctgaacttagtatccctaaacttgttaaaacagaagaaggtaatagtattcagcaaggtgactacactctactgaatacattaggtatgtcatttgaacctggttcatatgatatgtctgatagctggtataagggttatatgggtaacagtaacatattcgttcgttacggtaacgtaatgtacccaattgtatccagcccagctagtgaagaggctgtgggtcttatcctcaactttatgaacattattggtgctgctaatttagtagttcaggctgcaccggatactctagctattgctcctagccgagaaacactgtctaaccaaaagttaaccgacgatggtattactactctatgcgtagatttagtagaccgtatggagaaggagattaaggctaaaattcctgaagctattaagcagattgaagaatacgcctctaaatcatctacccgttattgggaatattcatctttcttacttgcagttacagacagaactgttcaacgctatatgtcctctagcttgtgggctaaacaacgtaaacatcacatcaaacattggcgtaacttatccaataaagcattattagctcgccctgaatatgcgggtcttaagaagctgtatagtaaggctatgagtgctcttaaagatactcgtgcggatggtacaagctacccattccaggaattagtataccggcatctacatttacctcagcttgctgctttaaaagaaactggtattaagtggtctggttacatagtgaaccaaggtaaccgtgttgatctggtgagaggtaaacttactgattactttaagatgggctataactgccatttgggtattggtattttcactaccaagaacgttgtagttactcgacgtttatctgattgtgcggactctttctcatacttccctgaatacaaccgtggagacttagagcgtacagcttttgttcacgtcgttggtcctaagaaaggtgcagcagaagaagctgtagctaagttcactgctatgggttatcgggtaattgacctcactcaatataatgagtgggacaaaccaactaactaccgcagagaacaagctaagatagctgctgagaaacgagctaagacgatagctgccaataaaaccaaagcagggggtaaaactaatgctctgatttcgttgaatgcagttctcggtactactcctgtacgaaataaaagtggggattgggattctaagccgtacattgacaaggattttactgacccaagcttccatgagaagtacggtttcactgaagtggaacaacctaagtactacgtgttagccaatcaggttagttctggtagtccagtaactgcccggattggaaccatgtggaaatggtatgagttatccgatgagatgaaagcagagactgttgtctgccgtaatcaaatcgaagctaacaaggctaaacgacgtggtgctatccacattgacgatgttcgttttaaggaactgatgcctgtcattaccagcaagggatttaagaagtatgtcactgaacaccgtattggtattctggaatacgtaggactggatgacagagagtattgggaaatcctagatattcttggtctaacgttcaaaccattacagaatctgatttttaaaccagagtatgaatgggcttatgatttcttaagaaatcgaccacataacaacaaagaaaaacttgttgaaatgggttgtattaagtcagttgatgacttagagccatatacaatgatggttaatccgcgtaatcataagtactttgaaatacttaatcagtacaaggggttattcagctatagctggagtgctggtgacatactacagagtctggacttggggagtttagttaaacacctcaagaaaaatccagaggatattcctgggtttaagtccctctaccgtaatcgtctaaataaactgaaaggtaactaatctgatgaaaatcgaactgatttctatcatcgcactggcagttgacagtcgaaacttaacattgtggaagcctgatggctccacaattgtatatccacagagcgacccacgggttgctcgtatcgtatctgaagcacaaaccaaaggcttgggaattaccaaagacctgatagaagtaaacattgcaccagaagtatcactgcgtaatgagtatctggaagcagagaagaacactaatggattcgtccgtttcttcaaggtagctaaagctaaactcaaagagttcttccaggatggtacagatgttcaacctacccaagccgtttctgatattaagctaggcaatcccaccaagacattagtatctaaagctatggatacattcctggctgtacaagctaatgaaccagaagtaacagtatcagatggttgctacgacagacgtgacaatctgatgtggattactggctgggataaggaccataactatcctgcactggttcgttttattaacgacgtaatgggttgggggtatgaacaaaccaacaccatgctcagacaggaatggcctgttgcagttcgtgcagtatccgatgatgaaatgggtgagtttgctaaacaagccaagcacatcaaaggtgtacatattgtatttaccagccgtaaacataccccaccaccttacattgaagtagctaaaactacgaaccaggataagctggctgctgcatccgagaaattagctgcattaggtgctattagtactgataacgctaactttcacactgatgtgaaggaagatgaagtggttgttgctgttaccaacgatggggttatccctggagttgagaacctgcaacgtcacttacgtcagtctgccaagttgaaagactacaagggcttcactaagttccttgagcgtctggctccggttattaaagaccgtctgcactcagtagaagacctgatgaagttcatggaaactgctgaattgcctatcgctgatgatggttcaatcctgttccttaaacgccttcagtataaagggaaagaagatggtaaacgtgtattcgttgactgtcactcaggtaacatcaaacagtgggtaggctgtaaagtgcaggtacgggaagacctggtagatcctgaccgtcgtcaggactgttctaacggtctgcatgtagcatccatgagctacattcgtagcttcggtggtaacgtaactgtccttggtaaagtagcaccagaagatgtgtttgctgttcctcagtacagcactaataagatgcgtgtatctgcgtatcacattattgctgaactacccgaagaggaacgttgcaatgttaacagtggtatctatttgtctaaaactgaagtaggtaagaaactacttaatgatgccatcgttgggaaccatagttcacctaccacacttattatggttggtgggcatcgtggtactaacctcaaatacactaatctcacatctggttctgtagagcaattccgtacagttgctagtaaagaggcactgaatatggaagagtcactgaatgaagctgtagcttctgaaccagtgaaagctactgaccttaaacccgttattaagaaggctcctactgtgaaagaacaaatccaggaactggttaaagagttccttaatgcaacaacaccagaagataagttagctgctgctgaccttctggtagaactgcgttccaaagctcgtaagccttgggctgcatttgatgtaggtagtgacgtggtagctaagattgctgatgtacgtgctacctatacaactaagcctattggtaaacctaaagctgttaagcaggatatgacagttaaacctacccgttctgctgctgccactaaagtagctccttctggtaaacacgttgataatctgcgtagcatcctgaacgatacgtcatattctgactatcagaaaggccatgctctgcaagactataaacgtcatgctaagaagtcattcactgcaatgggtctgactgaagaagaagctaaattagctaccaagctggttaaagcagttaagtaatagcctgttcaaatgccctcacttgtaataaagtgagggtaattttgaggaggaattgtactatgagtaaagtattcagaagtaatcgcaaagcaactgatgaagacatcattcgtatgaatgctgttgggctgtccctcgcaactatcgctaagacgttgggggttcaccccactacggttactttgcgattgcgttctttaaacattgaaccagccgacacacgtcggacgttcatggaaaacgtattacgtcctttaccaacccatgtggctgattggctatcagaacaagttggtcctgcttatgaaattcgttcatatgtaagggacttgattctggaggcatataataatcgccaccttaaccaagagagtgagcatgacaagttcatccgtttgtacgctggcaaatacggaagcctggttccggaaagcagtaccaaatccgacgagtaagaatattagtacccagattggttgtcatctggaagaagtagtagagatgctagacgagttatacgctaactcagaagatgcttacgatattcttcacaatgccattgcagcattaaccgaattgtctgatttaatgaaaaaagatgacaaagaggtatatgcaccgaacagccatcgtttagctatccttgatagtcttgctgaccagattgttacagcaaccggcgtcggtactttccttgggatgaatgtccctggagcattggctgaggttaatcgctctaactattctaagtttgaagatggggaacctgtcttcaatgagaacaagaaagtcatgaaggggaaagactacactcccccagatttgtccagtttcatttaacgaaagccccaaatggggctttctttctatggagtcatatatgaattggcacgctttatttgaatacatagatggaaagctctattggaaagttaatccatctatggcagtgcgtataggacacgaagcagggtccataaatggagatggttacattcaagtaggttacaaaggccatgtttatcaagcacacatagttgtgtgggaaatgcacaacggcccggttccaccaggaatggtcatagaccatgacgacaggaacagaaccaataatcgaatagataatttgaacttagttactcaattacaaaacaatagaaacaagaccaaaagtaaaagaaacacatctggtgttactggagtgtactggcacaagcgtgaccagagatgggtagcatcaatcaggatagaaggtaagctgaaacagttgggtcagactacctgtctggaggaagctattaaattaagaagggaagctgaaataaaacatggcttccataaaaaccacggtaaataactggagatttaaatgttttccaaacctaccaaagccccactgaaccaggggcaagaagcggttgcgaaggagttcttcgacttcctgctcgaccctaatgctaccgaattcaatattagtggcccagggggaactggtaagacattcctgatgtcgcacctcattgatgacactatgcctgcatacatggaaacttgttctttgatgggaaccaagcccctgtataacgaagttgtcatgactgcaaccacgaacaaagctgctgaagtactggctcaagctacaggacgtccaacatctacctatcactccttccagggtctgattgttaaaaatgactttaagactggtgaggctaatgtcgtaccatctaaatcattcaatattaagaagaacaaaatcatcttcgtagacgaagcatccatgattgatcgtcagttacttaagtatgctcgtgaaggtactcaccagtgcaaactggtatttgtaggtgatgcttctcagcttttacctgttaaagagaataagtctccagtgtatgcaggtaatatcccaacacactatctgactgaacagatgcgtactgatgcaccggaacttaaagcattgcaccagcaattgcgtgatacggtggaaggtaagacaggcttcctgccaattaaatgtatcccaggtatcattgactgggtacaggaggaagagatggagaaattggttctcagtcacttcactcaacctaccaacagccgtattgttgcttacacaaatgaccaggttattaattacaataactacattcgtgaagctaacggttatgtgggtgaatactccatcggcgagcagctggtatctaactctgctgttcgcttgggtgtggataatcgtttatctattgaacaggacgtaaaactcattgaccaggatagtagtactcgcatgattaaggttacaggtgacctggaactggaagttcgtgatagtactcttgacctaggctatggtggcattgtaagtgaagttccaatacctactgacccagactacttcaaccgtttagttaagtggttaggtaaagaaaagaactgggaaccttacttccgtcttaaagaaaccattccagacctacgtgctactcatgcgtgtactgtccataaatcacaaggctctacttacgacacaatctttattgatgcaaatgacctctcaagctgtcgccaaccggatatggttgctcgtctgctttacgtcgctgtgtctcgtgctcgtaagcgtgtagtgttctatggcaatcttgccagtaagtacggtggcctaactttctaagggaggatatatgcctcagattggttcagcgactattggtcaagttgccaatagcagcgagatagtcaagcatctgttcttagcagaactggttcgtcttgatggtgtgttaaacggtatcattgataagaatgatcgtatcaatggtgtagatgtatcagctggattcctttaccagggtgagttctatcagcgttctaacgctaccagacctccaacctacggtgagcgattaacgcttaatccagaactgtggcctgcaatggacaagtatctgaaagcctccagtcgtttgattatggaagtacaccttgtgaaccagactgtatatcgtctggttcgcggttgtatgtcctatcaggatgtacgtgatgctctgcctgagtgtctggtagcacaagaccagacgggtcagtacaaaggtctgcctcgtactcgtgaagcagcctggacacttgctggtgatgctatggcaatcaagcagtatgagaagattctgccctctattgagtattatgcagcttcccatctgattttctaaggtaaagctatgcgttacatcacctctcaagatactggtaagtatcctattgctatcctcggtcatcaaatccgaagggaggagatgattaaaacctacctgctgccttatgacctaagcatggaagacttcatctttattgaacttcattctgcccctggcaagaagaagactcctgcaagggagattaaggagttcatacagcaggaattacagcaagtactggatgatgcagaaactcaatatattatctgtactgattctgactacttcaaaatactgactaaagaggctaaagcagaggctaacctcggctatgtttgtgattcagtatggggtaagcagaaggttatctatacgcctagctacaggcaagtcttttatgacccacctgtagtgagagccaagattgctcagggtatggatgcattgcttaaccacattcgtgggcagtatgctgaaccaggccagggaatcattgagtttgaagcatatccggatactccagaaaagattaaagcctggctagaccagttgcttgagatgaataagccattggctatagacatcgaagcattcggtttaaagcactataacgctggtataggaacaattacattctgttggagtaagacgcaaggcatagcctttaatgtggactacgagccaattcctggggctacagaagcaccatatgggcgtatcaacagaaatgatattgttcgaaaccttctgcgtgagttcttcattaagtacacccaacggcagatgtatcacaacattagctatgacgtgtacatacttatctatcagctgttcatggataacctgattgatacggaaggcttactgcacggcatggagatcatgctacgcaattgggactgtactaagttaattacctacttggctactaacagttgtgctggtaatcaccttagtctgaaagaccaggctcaggaatatgctggtaactatgctcaggatgatattaaagacatacgtcttatacccaatgagcaattgctacgctacaacctcattgatggattgtgtacttggtacacttatgagaagcactgggatactctcattgccgatgaccaactagatgtttacaacaacatctttaaaccagcctgtgaagacattattcagatgcagttaaccggtatgcccatgaatatggaaaccgttaaccaagtagctgaagaaatggaaactgacaggaaccaggctctgaaaactattcgtgagtctaacctcatgaagaactttaccctgatgcttcgtcaggaatgggtagacgataagaatgctaagttgaaaaagaaacaggtaacactggctgattgtaacatcgagtttaatcctaactctagtccacaactacagaagttgttatttgattatatcggcttaccggttcttggtcttactaagagcaagcaacctgctactgacggtgacactattaaagcactgcgtacacatacgcagagtgaagatgttaaggaactgctcaatgcacttatcgactataagcttgtggataagattatcactagctttataccagctttcaggaatgcccaaccgggaccagatggctggcactacctgttcggtaacctcaatctgggaggcacagtctccggtaggttatcggcttcagagccaaatctacaaacaactccatccggctctaaatatgccaagaagattaagaaatgcttcgaagctcctccaggctggatattttgcggcttggatttcgcctcgctggaagacagaatctctgcactgacgactaaagacccacagaagcttaaggtatataccgatggttatgacggtcatagtcttcgcgcatatgcttattttggtgagcagatgccagacattgaagacacagtagaatccattaactccattcagcataagtacaaatcattgcgtagtgactcgaaggctccaaccttcttacttacctatggtggtacttatatgggcttaatgaaaaactgtggcttctccgaagagaaggctaagactacagagaaacgttatcacgatctctatgtagttagtgatatgtgggttcaggctaagctagatgaagctgctaagactggttatgtaactgctgcatttggtttgagagtgcgtactcctttactggctcaggtattacgtgggacatgtaagactccatatgaagcagaagcagaaggcagaactgctggtaacgcattaggtcaaagctggtgtctactgaataaccgtgctggctcagagtttatgcgtaaagtcagaaccagtgagttcaggttagatatacgcccttgtattcacattcatgatgcccaatacttcatgattcgcgataacatggacaccttgcagtatacgaacaagcacttggttgaagccgttaactggcaggatcatcctgatattgctcatccagaagttggtttgggtggggaactatccttgttttacccaacgtgggctaatgagattgaaattccaaatcacgctaccccagaagaagttcatcaaataattcaaaaggcattcgcatgaccaaaagtactaaagaaactgtagtcaaaaagtatcattggatggtggcagcacaggtaatcttccagcttcctaaagctgatgatggctccctgcttaccatgaacacaatgctgctcactgacgaacctcatgtgacctataaagatttggctcgtgccaatcactcactgaagattagtctggatcagcgtttcgatacctcagttgatttgaaagatattgtttatctatctattaacaacctgggcctgatgtctgaaccagagttccaggcaaacatgattcccaagggggaataatgactaagctctccggtggtcttaataactactatgtagttacaattaagaatccccaacggaaagagcaagagccataccaagcagagtgtgaggatattatccaagcactaggcatgaccttcgatgaaggttgtgcctttaaagctctatggcgaaatgctgctgcccgtatgggtaatggtaaacctggaaacacttcagtttatgactgtgagaaattggttcattacgctaatcgtattcttactaaagagaagttagtagatgaattacctgccacagatatcactgctactgggagatgctggcattacccggggaatggaaagccttatctaacagtgaactttcagttcattgaggtagcgtacaaaggtgaactagataacatagtcagctatagcttcgatgaggtagagagtattcgttggaaccaggtgcatagatacaggattacttactgatgaagataaccaacaaccatgatgtctcgctggccctggctgtatggctattacatgacgagtatgattatgtagacaatcctaagtatctgtctgtaaccacactgcttaagccacttaagcaaatcgtcatgaagcatcgtgtagacctcagtgaccagtcaattgatgttatggattttgtctccacatcaatgggtactggcttacacgattctattgagaaagcctggaagttaggccataagactgcattgaaaaagttgggttatcctcagcgagtaattgatgcagtagtcattaacccaaccaaagcagactttgatgctaaccctgaccttatcccaatctacattgaacaacgtggaaccagggtagttaagggttggactatcggaggtaagttcgacatcgtaacagaaggtctattgcaagactttaagtctacctcaacctattcctgggttgctggttcccgtgatgatgaacacaagatgcaaggtagcttgtaccgttggattcacaacgacatcattaccgaggatgtaatccgtattaactacatcttcactgacttcatgaaacacatggctaatagcaatccgaactatcctgctaatcgtattatgcataaggatattccgttgttatctgtcgataagactgaacgttgggtagaagagaagatacatctcattgaaaagtactgggatgctcctgaagaggaaattcctgaatgtactgatgaagagttgtggcgaacagagccacaattcaaatacttctctgatgcttctaaggtagatatgcctggagccagaagtaccaaaaactttgacgatatggcatctgctcgtatcttcatggctgaaaaaggtggcaagggtgctatcaaggtcgtggaggggcaggttaagcgttgtttatactgccctgtcgcatccatttgcaaacaaagagagagatattttccatcatgagtattgaccttaccggagtagtgcatcatcaggcgattgaagaaatcgtagatgtgctctgcaataaaacccagaacaatgaccggggattcttccgtgtcgaagtagcctacttcttggctaaaatggcatcctgcatgggtgcaaccatcgtaactaaagaccgtggtgacctgccggtaaacatctacgctatagcgttggctacatctggtttcggtaaaggtcactcagtaaatatcatcgaagacgggttcatgtctggcttccgtaaacgctttatggaagacaccatgcccgtcatcgcaaatgatcgtctatggaagattgctaacgaacgttctgctcgtcagggtactgaccagcaggaagagtttgataaagttgaggcagagtataaacgtgcgggagcatatccatttacgtttgactcaggtactccaccagcagttaaacaactacgccataagctgttaatggctgggtgtggttcaatcaatcttcagattgatgaaattggttcaaatctgttggctaacatggatgtactaaccctgttcctggagttatatgaccaggggaaagtaaaacagaagctaaccaagaatactgctgaaagcgttcgtggtgaagaattggatggcaaaactccaactaacctgctgctatttggtacaccaagtaagctactggatggtggtcagactgaagaccagttctatggctttctagatataggatatgcacgtcgctgtctgtttgccactggtcacttagacaagagagcacatgcaacattaaccccggaagaaatctaccgtaacctgattaaacaagataacgtacagactcttggtaagtgggctaaccatttccatagtctggctgacccaaacctatttggttttaagatggttgtagaagataccgtgggtattgctctgattgcttacaaaattgattgtgagaagcaagcagaagctatggctgaccatgaagatattcgtaaagctgaaatttctcaccgttatttcaaagcacttaagctggcaggtgcactggcgtttgttgaccaaagttcattcattgagatgacccaccttaaacaagcaattctgcttgtagaagaatctggagcagcatttcagacaatcctcaatcgtgagaaggcttatgtgaagctggctaagtacattgcttctgtaggtaaagaagtaacccatgctgatttggtggagtctttgccattctataagagtggtaatgcagctcgtaatgagatgatgactcttgctacagcatggggttacaagcagcacatcatcattaagaagaccttcaatgaaggtattgagttcttccgtggtgaaactcttaaagagacagacatcaatgagatgattgtggcgtatagtgatagctttgcttatgactacattggtgaacgtgtaccgttcgaccagttgcatgtattaacccaagctcccggtatgcactgggtaaaccatcacatgaagaatgggcatcgttctgaagaaaatgttatcccaggatttaacatgattgttattgactgtgatggtggagtacccctgcatacgtgccatgaactaatgaaggaatataagttcatgacctataccaccaagcgtcatactgatgaagagaaccgcttccgtctgattattccaatgaactatgagttacacctcgacactgaggaatacaaagagttcatgaataacgttatggcttggctaccatttgaaacagatgagtctgctaaccaacgagccaagaagtggatgtcctgtgagactggttcctatcattacaatcttgatgcgaatctgttagatgtgcgtgactttattcctcgtactagtaagaacgagcagttccagaaccagatgaaggaagtacagtcgttggataatctggagcgttggttcgctagtcgtattgcctccggtaatcgtaataatcaaatgattaagtacgcactggcattggttgacagtggttgggacttttctcaagtacagcaagccgtccacacattcaataagaaactggctaatccattaccagatgatgaattgaatgcaaccgtaatggtcaccgtggctaaacgctacgctggcaaataagtaaacaggagtctttctttggtttgaaggactcctaaattaaacgaggaaaaataatgtccgaagaaatctccaatgatatgaacactcagctaatcctgattgcaggattctcagcgagtggtaaatcagcatcactgcgtaacatcaggaaccaggaacgctggctctatctgaatactgaagcaggtaaacgtctacctttccgtaacaagtttaatacctacaacattgaagacccatatcagatttgggaagcatttgatgttgcatccccaggtggtgaaatggcagacgatgttgatggaatcattatcgactctgctaccttcatgatggatatgctggaatctcagtatgtactgccatctgctaatactcagaaggcatggggagattttgcacagttctttaaaatactgctgcaacagaaagttgttaaatttggtaagccagtaattattactgcccatgccaaagatgaactcgacgaagctgctggtgtgattaaaacattcatcccagtgaaaggttctctgaagaacaatggtcttgaggcttacttctctacagtggtttacgcagagcgtgtagacattaaagagctggagaagtatggcaacaagatgcttgaaattaccgaagaagaacgtgacttaggttataagcacgtattccagactcgcccaaccaagaagtctgttggtaaacgtctacgttccccaatgggtatgttcgataagtctgagacttacattgataatgatgcccagaaactcttagaccatctggctgaatactacgcttaagcgtttgcctggttgttaatcacttattaggaaaaatattatgtcactgttcagtaacttgaaagaaaaaaccaaaaacgttgaagctgtaaaagactcccttggtggtggtggcttcggtgcaaaggagtcagatatctacaccggtactgtaaaagtagcttacgtaggtaaagctgactctggtgcagactggatgcagttaatcattgaaaacctgaaaggttctgatggtaatgatgctggcgagttccgttcacaggtgtacttcacttctggtaattctaaaggcaataagcctacttacgagaagaacggtaaagaatacttcctgccgggatacaccgtcattaacgacatgatgctgatggctaccggtacggaactgcctgaagctgacttcgaagagaagattgttaaagtctatgacttcgatgctaaagcagaagttaataaatctgtcatggttccagtagacctggttggtcagactgttaccttcgccctggaaaaggttctggaatctaagcaggttaagggtgacaacggttacgttgattccggtgaaacccgtgaagtaaacgagattcagaaagtgtttcacccggaactgctggtcacagtcgtcgaggctcaggaagcagagaaggctgagaaagaactgaccccagaactggctgtattttatgcagcatggttagaaaagaacaagggtaaaacccgtgataagaccaagggttctgctggtggtaatggcaaaggtggcttgcctcctaaaccaagtgctggcacgggtactgctcctgctggtggtaaatcactgttcggtaaacgttaatgaaaatcccaattgttggtgcagacattagtctccgcaattggggtttagctcgtgggatgctggacattgagtccggcgtcttcgagcaggtcgaacttaaactggttcaaactgaagttgaccacaacaaacaagttcgaaccaactccaaagatatacaagccgctcacgatttgtttcttggttgtgaagaatggttacggtctgctaaagcagtattcgtagaagtaccagtaggctctcagtctgctaacggtatgaaatcctatggcgtatgcgtaggattaattggtgcatttcgtgcattgggttgtccaatctttgaagtatccccaattgaaaataaacttgcactggtcggtgataaaactgcatccaaagacacgatgattcgtgctgcccatgctatctatccagaagccaactggctcacagataaaaaaggtaaacttctgaataagaatgagcacttagcagatgcaatcggtgcaatccacgctggtgtaaatctcccagctttccaaaaccttcttaatttaataaaggcgtaatatgcaaatcattttgaaccagtccgaagtagaagctgctgtacaggcttatgtcgatgatcaaatcaatcttgctggagacattagtattgtcatcaatgcagatggtacagcctccgttggtattaacgaagaggtaagtcataacgatgatactccacccttggtagagaagaagacacgtcgttctcgtaagaaccctcaggaagctaaacaccgtccggtagaaccggaaccagaagaagtggttgaagaggtaaagggagaagaaacccagacctctactggtggtccgaacaagagttctacgccggaacctgaagaagaagcagtaactgaaccagaagcacaagaagaagttgtgcaggaagaggttaaggctgaagaaccagcagagaaacctgctactaagccttcactgttcgctggccttaaacgtagttaatctggtaggtggctcagaagctgctgctaggtgtggtagtgtttatagtcctgatgctactactggtcaggattatagacgtgtcggctccatacatagcttttatcatcactgtcattatcctgtggaaatgcagtggtaaacacggtggtgacaagccgccagagtaacaacaaccgaaccagtcccctttaatactctccgaaggggattggttcaaacagggttaacatgaacaaatttactattcactggctcaatggaaaggttagttctttcatgggtggagaacctgctgaaggaaaaaaaagcattccacattgactcagaaggctgcaaaatcttaataccgtatgcttggtataaagatggtgaagtagaagcattgaagaagagcagttaatatcgtgaagggttctgttagaatcctttgagataggaactcctatcataacctttcttaacttaatctttgccgtatggcactgacgctaggggtggccccccatccgtcagacagactattttaagaatcggttatcacagaaaatgtaaagcaacattcgggttaatcaatggcctcttcctataggggccatttctgaatcttaggctatatcccaaaggttagtatctttaggataaggcttcagatcccttatcaaactaaccgctcaatgttgagcattctaatcacataagcccctatatgggctgggttaaatgtcggatagcctagctacctacaacatcgaactgttagatcttacatgcaatatagggtataaagggaggattcgtcccctcccccctattatgggctatcggtgagtgcattagttgattagctgtggaaggtaggccgatgtccacaagcgtggcccagagctagtgtactctccgatagttttcgtaagcgattatgcggttttttagaaacgaaccaataacataagtgcaaacgaagaagcgtatctgatggcagcttaataagccaagcgtcagtcaggagtgagtcgtcctgattatcaaacgaccgtggagttctcccgtccatgtattagaaacgggggactaattatcagttgcacgagatggcttgacatgttcaagtttggactaagtgtgacaccgctagattggagggctgctgcggtaagctatagactccaaccggaggttcgaatccttcactgataaccaattcaaagtagcattgtatatttaaatgtttcccggcatttaaagcacccaccgtgacagtgctactctaaattggaagaattatgggggtaagtcgtaaccatacgacggcgtaagtaccagatgagacttctggacgcccctaccatatttgaggtgtaacagttaaatccagttgccggaagtgcaattctagatacgctgccaatgtgtgaacggtaaggctgtacaggactcggactcccacctcaaaccaaagtcgccaggtacttatggcaaacgggtagtaacgaactagtcattcgtcaaacgcccaacccaattatgagtcagcaagaacgccttcacttaaatttaaacaaaaaagcttaacgcaataattatgtaggggtatgtaaggattgcgaagaaggagccagttagagtctggcatgactcacctattaatacccggtaggcttagtggtaaagccccactagtaaaccaactaggacgcaggttcgaatcctgtccgggtaaccatattatgtccgcttagcttagactgggaaagcaaccgactaataatcggaaagtcactggttcaaatccagtagtggacacccatttagcagtaacatagtcctgattgcatcgcactctaaagacaacactggtaagacagtccagtggctgctattgtattgttattcccttcgacgggaatttcgctggagaatgggaactccttaaatcctagcctgagtaattaccacaggaacgggactatcaatcccaagcctggtcagcgtggactgtcttcgtggtaagaaccaaaagcctcccagctatgggtaaatagtactaagtcccctggagccgtcactctgggggacttttttatttgagtattaataattggataatcaatatgattgacctaatctcaaccccgtatgcctatgaggtaacggataatcgaggacgcaagtctttggtgtttgcaggtagcgtagcctataacaacgcagtcatgtttaagtacaaactcaaaccactctatgaggctaataatggcaacagtaagtaaagaagcaatcgaagctaagattaagagcgtctactattttaatggagctgatgcagtgaagtctgcatttgttgatccatctgcactcccggcagatgatttggctaacctgggtctgataacctattgcattatcatcttggaaaatggcttcaaagttgaaggtgtatctgcctgtgttgacccagctatctatgatgagcaaaaaggccgtcagtatgcatatgaaaatgcattcaataagatttgggaattagaaggttacctgctacgtcaggcactgcatgagaaagaagagactgctaaagctctggcttcctttgcagaaaacaacacctgtgatggtggtggttgtacaatctgattcaaaagtgtaaggtagtttttaccgaaaggtactgaactacccgacatgtggtaaggctcatgaagccaaaacaaaacaagccctcctagtgagggctttctcatttgaggtagttatgtcagaagaaattaaagtccattttaccaattatatcggaaccaagtgtgtaaatggtttccgaatgaacaaagaaacatactgcaaacttcgtggctgggatgtacctgctaatgaagacccattagaagaaggttacttagtagagtacccagactctaagtctaaccatcctcagttccgtggctatattagctggtcacctaaatctgcatttgaaactgcgtaccatgacgtagaaaaaggttgcacctttggtcatgcagtagagcttctcaaatccggcttcaaactagcacgtaaaggctggaatggtaaaggaatgtacattgagtacgttgctgctcaagaatggaatagcagtagcttagagcgtacaggacttgctgatgaattgaaacctcgtccatggttaggaatcaaaactgttgatgaccagtttatgccttgggtcccatcccaatcagatatattagctgaagactgggtgttagtttagtaaaaattaaagcccctctaatgaggggctttttcatttagttagctagattgagccaagggttaaggttatgggcacgaagtccctgaccgaagccccaggagtaaccgagattgccttgtgcagcaatactgaagatgttgtcctgaataggtaaaccaacattaccaaacatggtaggagttggagccaacatagccatagctgcgtgtaccgggttgttacgaatcatggatactgcaatttttgcagaacgaatcttaaagttatagaaccacataagaccaacactttccatatacccacggaagcgaccaggcagacggtcatagttaatgaactcttccgttacacgtccaagtgcttcttcacgagtcttacctttacgctgagtcaaatcatcatagatgattgctttagcaataaagtcagagtactcaaccgtcttctggataccctggaataaagcagtatccttggtgataagggcataacgtccagcattacgtacagacttaggtaacttatcagccagtttatccatgtattcgtgaagtttaccttcagtaatcaggatgtcatctcgtccaataccagcatctgcaattgaagaaaactcaccagcttctaacagaggccagatactcatacgcttatgactatcagtgatggactgaatttcagccttaagcttacgaatctggttcgggttagtagctgcacgtaactctgcttctgcatctacctgacgcagacgagatttcaggtactggttaatctcagcagtcttctgtggaatgctcttagcaatgttcttaacaggtacaccacgaccaaccatctggtaaaggttagccaggaagttaacagcaggaacaactactgatttaactacaatcagagtcttagcttctttaactaagttttgaaccaggttctcaccacccattacatacttataagcacggttgccgaatacacccaacatagctttcttgaaggtatccagtgtttctggtgaccaacgagaattgccagaccaggcatcacctacggaagctgcacgatagcccagtgcatcattcagcatgtcacgacgtacccacaactcaccaggaccaaacagactttctgctttctgacgagtttcactgttcatcagcttaagggcatcagcagttactgggtccagtttagaaccaagaaggttaacgtactgtgacttgttagaggcagacattttaatgtcgttttcatacatgctatgcaggttctcaatcagcatatcattgaaacgctgagccttagcttcctctacctgacgaccacgccatacaccaattgcacgagcaagatggttctcaccctcaatgtgcttcagcatgttagggtcaatagattgctcatatgcaactacattacctttgtcatcatatacaggcagcagtggttcattaccacgctcaccacgagccagtgctttagtgatgcggtctacggaaggcttgtcagtgatacgaccagctaccatagaacctatcgtaaagcctgtaccaaggtctacaccgccagcagtattgcgaacgttctgtagaataccttgtgagaatggagcctgtgcctgtacaggtgcgaagtagtaactacgtgctggaccacgactagcagagctaccctgataagtacccagacgtacataagacttctcaatcaaatcagcaaactgactatcttcagcaacaatcaggttaacaccctgtttagtctcaccaggaatgtaacctttatactggttcagggttgcacgcatgtcagatttggctttagccatttcatctttacgctgtccaaccagataagaagtagcaaaatcaatcccatcagcttctgattgagccagtgaagataacatctcacggtcagtcttactcattgcttccagtgcatacagagtaatcagtttatccagttgagctacatctacagtagaacgtgcagcctgtcgttcacccagcatacgagagattgcagtagcattacgcagcaagttattaccaactgtgccattaatcatgtactgagccagttgcttagatttacggctaatcaaaggccagttacgtcctgcttgtttctgcaaatctgcttccagcttattcacttcacggtcaacaatcttttggtcagtcagcaagtcacgaatttcacccagagacatagtgtcacgcagaacagctaagtcggttttacccataccggtatgcattgctttccactcatcattagtaagcttacggctgaacttagatgcaatagtggtaggcaaatgttcacggaactgctgacggtcagcctgtacctgtgcacgcactgctttaatcaaatcatatacagaagcattgctcttagtacgaccagttaagtcattaaccaggtcatggaaaggttgccataccttaccctggttcattgcagccataacaccctcagctacgattgcaccatttttctctgtagcaatagcagctattagttgtgcagcatgagcagcacctttaaccaacgggttcttggtattagctgcaacttcacgagcaccctctaaagcacgggtagacagtacatcaatagaatccaccagatactggttagcacggtcgatagcattaccactaggagtagcaatggaatcatagaaggactgtgcattgagactcgtctgcatgattgtctgagccagtgcatccataccttcctgtacgttggtagctttagtatctcctgctacacgagcattcagactagccattgcagcagtaccgatgttagtcagcattgcatcagcggtattgccagatttcttgtctactttcataacaggaatgtcagccagtactttacgcacttcttcacttaccattgccagaccaacaaaggtaggcagtaaggaagaacggccttgtgcatcaaactcaatgttgttagcacccatgatggtatcgaacttctgctgtgcatagtaacggtcagcagggttagtactatctgggtcagccatgaatgactcaacggtcaggttcttagtaacatgtgtgtagtattcctgtgcacgagccagagcagcaggattaatagcagcttcagtagccagtgcagcaacaatgttagtaaagagacgttgttcctgcatattcatagtgaagccatgagcctgaacatcacgagttactttagtcgcattaaccactgcatcagagaacttacctttacgaattacttgctgtactggttcagaaccaatgtagtctgtaatcagtttatcaaaggttttccctagctcttccagacgagtattgtcaccatatgctttgttatggaacaaagtagtatctttggctacagcagcagtaggtgcttgaccacgcataactacagcagagttaaacagtaagcctgagaacatatcatctgcattagccggagctttcttacgcccgaataccagacgtttgattgcttcatatacagcctgaaccatggttttcagtgcagtggttttcttctgcttgctaatcaattcacggttggttaaaccccaagccatgtactcgttaagtgcagcagctttagccattgctggttcaatgaagccattagacaaatgaccattaatggtattaagagcatctgcatatgcttcacgtactgcaggagtttcatccttaacatccagagtgcggaactggttcatcaggtcttcaatgttctgaactgcttcattaggagtaccttcatagtgagctagtacagattcaaaagtagaagcatgcaccaattcatgaaccagagtctctaaggaaggagtaactaagtagatggtcttatcttcaaagttagtccaaccgtatgcattacctgcttcagcagcttcaatatcttcaggtgctgggcgagtaatgttcttctcaatagcgtaagcatccagttgaaaaggggttccatagacaaccttgtagtctttagcagcaagagatttctgtacttctttcaatactgcttgctgttccggagacatctctttagccagcttagagatagcagtattagatagtagacgtacaccagacttcagtactcgaccaacctgttccattgccggtgcttctttcactggttctgttttagcagcacgtactgcatcacgacgcttgtttaactcagcatcaaacagttcgttcagcttagctacttgctggtctacagtcagaccttccagagagattttaccgttgttcacataaggagcaccaacagcagccatctggtcaacagtagtctgtacctggttcattactttgtgacgaatatctacacccagagcaatattacgcaggttacgttcaatctgttcagcaccaacacgtaacaggtcatcggtagctccttcacgctggtcatattccagagcagatttagcgatagcctgtttggtttcatcagacagtttgctgaagtctacactcttcatgaacttagcgaaggagtcataaacattcttgatagggttaccctgccaggaagtgtatacagcctcattagctttacgacttgcatcagtgatgttgttgataccaatgttcataccatcaaagattttcagggtattcttcggagcacctttcatagtagaaagggtctgcatcatcatgccatcgccagtaccaatggtcataaaaggaatacctgcaacacctgcctgtgaaggagcatagatgctcattggcacacgcatacggtcatctaagttggtagccagtacttggttagcaacatcagtgttttcactaccggcaatgtagaaagtctgtgaaccagtctcaatcattggagctagtggggataatgattcctggatttcattcagttctttctgtgttaagaaatcacccttcttccaggttgggtctttttctttttctgccagcttagcctgtactgcttgttggaacatgtcttgtagaaccaaagactgaatctgggtagccttctgcaagttctcagtagaatgcatcagaccttccccaacagtattccggataccagtacgcattggttcaacgaacaggtgaagcatgttctcttgtaagttcttcagggcattacccgatatggtaaacttctgagggtctaacttaccagtcagagcaccttctacctgttgaatagacaattcacctttacgcataactggaacattaccagtcagtgcttccatagaagtaaggaaagtatccagcatagcctgagcatcagcctcagacgcagcctccttaccaaacattgccatagctggggaaatactagggtcagcagcacgagcttgcagaacatcactgaagcgttcatagatggtatcagtaattgcactaaccatcttgccagcaataccacgagcacctgaaccatagatggtaatggtcagtgggtttttagcgataccacgtttcaggtccagagtaccgtcttcattcaggttaaagtctttaataaacaggtccattaacttctgaagatgattcatttggttcataaccggaacgttgttacggtaagtagtacgtaactcattaagtgcttgttgcagaccattggtagatgcttcatacaggtcaacactgtcatcctgtgaacgatgttcattcatagtcttaccagctttaccgaagaacagaccacctttagcagtattcttaatccagtctgaagtgaacttaccaccagtcattaataccattgcgttgattggtccgttggttacaccatcggcttcaacgtacagtggggtattaaagttggcacggtcatcactgttcaggtaacgggcatattccataagagccatgagagctacgaatgatttatcgccacccaaagaagtcttcagaatatctactgcatcagctggtaagtggccagacttatcaaactcaaccatcatatcaacagcaggtttcagattaccttccagagctttggtcagcttttcagacatagcttcacgggacatattatgtaccttgatacccaatgcctgagccagtcctagctggaagtcagagaatgtttggctgttttcattactcaagtcaatagtagagaaggttggcagaattgcttcacgaaccagtttactggattgtgggttgttcttacctaacatctgcatacgacctacacgggtcatgttgtaaccatagtgaataggcgtatccagaccattctcctgttcctgtaactggttgattacaccgaacagggaatcatatgccatagacactgacaggtttttaccctccagtgacttagcagtgttcacgttcagcagttcaggattaagagtaccagcacccatcagttccagaatgttgtcacgacctaatgcttcatagaagttaaccatcggcatgtgtacacggaactcggtagcctgttctgctttaagagcagctttctgctctggggtattcttaacagcagggttacgtaactgagtttgagccacggaaggaatatcatcaccaaagtacattttctcttctggttctacgagaacagcttcctcgatagcagtaggaaacttgttaatggcatcgttatcatccagcttctcaatggtatacagaccgacggtcttattagagtctgggtcaatctcagacacatcaagcatagactctttaacttcacccatctcaatgagagaagacagaatctctgtagccattgccattggaatacctttggtataacccagtggtgcattaggattacgattcaatccccagtaagattcaatcttttgagccagtgagttagtagcttcaaccagagtctgagcattctcaaattcagccaggataccttcaggtaacaaggatgcttctactccagtaatagcagctacatctttcatgtctttaacagcagcattctgtgtagcagtcagtcgccattgcagaccagcaagtacagcagtctctaacaactggtcattgaacttaaaggtgtctccgtctttctctacgatattaagtaacttaccacctacccaacggttagcctctgtgccttctgcaaagcgtttaccaacgttcttattagcaagaaacttagccagacgatcagacagagtagtcttcagagtttcaccaaagcccattaagtcctgataacgcttaatcacatcacttgtgagagcgttattttctttttgagtgaatgcttcaaagcgtgcagtagaagacagtgcttgcttaatatcagtcaaaggggattcagaaccaatggtgcgagacttaggttcttccggcagggtaaatgatttcaggaactggttcggtgtcttgtcattgttatagacagggaaaactgtttccattttcgttttagtttcagctactttttgagtggtatcctcattggtgagggtagcatctactgtttcagacttagtagtagagacttcttctgcttttgaactagcctctttaacaggaacagtcttattttctaccactggtttagctttaggctgtacagtagtagtagtctcttgcgctggtgcaggagtttcatcaacctgattcactggttcattggtctgttgagactgagtggcatcaagaccaccttgacggaactctttaactacctgggcagcaggcttgtccagacgtgaatctaatggagtaaccttcacatgagaaacattaagctccgggtaagccgtagcaagtgcgttagcaatatcagctacggttttggcctccagtcctacttgctgggcaaacttaaccgacttggtatcatacggattgacaccaagaccagtacgactacgtacccattcacgggagggagtaagagcctgataatggacagacttattcttatccgcattcccagaaatcagatgctcattcaacgctccgaccttattctgcatgtgctgggcgaacttcataaagtcgtcgaggtaagcggaagccaaatcgaagttaccagagttgtacgcagaacgaatgcgtttagcatgttgcaacgcagagtactgaccttcattagaacgagactcgtcggttttaatctgtttactaacaatgtcttgaggacgtaagcctagttcttctgctttagcgtcaaattctcgtgctccttgcaatagagcagcagcagattgcagggcagcacgctgatgattccccagtgtaatcttaccttcacttgcatgtttcagaaccatgttcactgagtctgcatccagtacttctggagacatatcagcagccatagcaatgttgtttgcttgggcttggttagcttcttcggtagctttcagtttacctgcttcagcctgttcctgaatcatagaatggatggcacggaatgcacgaagtacctttggtgtattctgaacgttagccatcaggccggagaactggtcaacaatattagcagcaggagaaccctgttccagattagctaaagcaccaggatcacggttaatgaagctatccatagacatgatgttgtcatacatctggattgcagcttccatttgaacgttagggtcttcggcagtattaaccaggtcagccatcttctgaatagcttcaacacggttagtggaaccagaaacagcttcacggattgctgggttagcttgttccagttctactgggtcaaatttcattgcctgagttaagtcagcagcatactgagtagcagcagctttctcttcaggagaaatatccattgcatctactgcttcttgtacagttgcttgtgcttgttctgcttgagcagtagcttcttgtgcagcagcattaaccgtagcatcagatacaggggaagcttgttcattacgcttagcaacttcttcgccacgctgaaccaggatgttagtaataggagaggcagcttttgctaatgcactaccaaccagagaagcaccagccagagtagtacgtaaagcaggcccagcagaagcaccaacagctttaacagttgtacctggagcctgagcaacaccagcactaccgaagccgtagagtgcaccaagacctgcttgctcaccgacacctttaagcaaatcacgcttagcatctacattaccctgaattgccttgttctgtgcaaactgacttgtaccagactgaataccttcttctactgtttcacgtagcatgttagaaccagcaccagccagcgaacctaccttaagtgggttaagttcaaatttggataccagaggaccagtagcagcagcaaccggagcagttaagccagcagcaatgatacccgtttcagatgcagtttggcgacgtgcttcatcaggagataaaccatcagcgatatgctgttgataaacaggagacttacttgccaattcttgatgggacatcttcatgatttcggaagcagtctgttggtatgcaccaccagcttccataccaccaattgcaatagcaggtgcagcaacacgaccagcagacaatgcaacctgtgcaggacgtgaacctaactcagcagctaaggtaatacccttaacagctttatcaccacctaccattactttaccgagtgcagatacaccacgaattaatggaccaccggtaaagagagaaccaacaccttcactcagcccatcagtagcagccataccattatcaagcgtattagcaacagaatcaaaagcatcacgaccaatacgagacagagaggcaaccaaactgctctctccatttttaatgtcttcttcgtagagtttctggttcttttgtgcagaaatctggttctgattctgaacaaccttacgggtagcattcagagcatcagactgtagattgtgtaccccttcattcagccaatccataccggaagcaatggatgccccggcattatcattgaccagacctgtgccaagagcagcaatgcccccaagggtattagcaacaccaagaccaacaccagaaagagtatcaccaaatgcttctgcgttagtacgttgtttagataagtcctgacgtacagcatcagcagcattagcccggctattaagaatctgtagaccttgctcattaccgtatttattaagaatttctaatggggaggcttgagtgaaatctgcctgaagtgaacctggttcgaatgcaccgattccaagattacctacacgaccagtttggagattgtaagcattctctggggttaattggaaagggctttgcccttgtgcagcttgcttctgagaggttgcagtagagacatcgacttgcttagcattagtgatgctgtctgcgaaacctgccagacggtcaaatgttgacatagcatgtttcctgttcaaacttatatcgtatatagaaagcttactctacagtaagccagtgtaagaaaaaagccccgaagggcttttgttagtattaccgattttgtcttggttgcatatactcaggcaaaccctgtgcctgacgtaaataccgtgcagcacgttcttcatcttccttggctcgtgctctgtccacactagcctgtgaccggaaacctcttggagccaggttagatgggtctgcttgaacttgtgcttgagcagcttgtagcattgcagcagctttagtaacagcttcctgacgagcaggcaacaatgcagtaagtcctgtttgtccggtgttaatcttgttctgggtatttgtcagtgcagctacagcagcatcataagcagtctgtgctgcctgaatattctgcatggcttgagcacgaccaaggttacgcacactgccttccagtggttcaccacgttgtacaccctcaattaactgatctaccagacggtcattaagacgcataccattaccagcttcattggtaatgaatgggttaaccgcatcaatagcacggctaatgtaaccttcaggtacaccagtctgtgcacgttgcataacagcagcagccatagctggagacatattcccacgttgagaaatatcagttaatcggttaagtacccagttacggtcagcacccttaaagtcaccatccagtagacgattagcaatctcacctactggagtattatcggtgacagtacccaggaaatcggtattaaggctaccggtattatcctgcatagagcgagtaccaatcataccctgagccaaggtagatactgcctgatttccctgattattctgaagcagagagaatgggtcagcccctacttcagcttgggcaataacaggtttaatctgttcccaagtcatatccttataagcacctggggtagagttaggtaaagcagcccaggtatctttaaggttaccattcttacgagcctcaaaaatagccctaccaatcttctcctggttctcaggggaaagaggttggttctgccaatctgaaccaagaactttgggggcaaagtctttcaaggtagcttggttaatctgaaatgcaccaacaggagaagcaccctggttcgacttcataccatcctgatgcttgattacatcaccgatactcatttgagtaataggagtggaagtaccagcaaactggtaagtaacatcataaggggaaccctgtcgagtaccagcagtaccaggagcagatgtagtacctacgccattaccgtatacacctgggtaagcattagccagtaatccttgcaaacgtgcctgagcaaccggagacaggttcctgctatatgcctctgccaacagacgtgcatcattgggattctcagcaccccgggtaatctgtgacattacacccatagctgcctgactatcagcatcattacgctgagacacacccaaatcaaaacggttctgtgcttggttaatagcctgaccaccttgaccttgaagacgtcccatcatctccagttgctggtcagcagggagtgcagatagtgcctcacgggtctgccccaatgcagcattaatacggttctggtcaccagactggtaggcctcggacagtaaacgaatagctggggaagcactatctaatgcagcatttgtatcctgtaaacgaccaaagagataagcattatagtcattggttccctgctgaccttgttgagtcagaagagtacctgctcgctcatccagattctgtagagtacgctggtttaccagtgaagggtcaaccccctgaaacagtgcaccagatgccaaagcattacgatactcagtagggtcttgatactgcatagcattcatcatgacggcattgccagcctcctgcttggcagcgttctggaaattacccagtgcatcacttaagccggaggtggcgttacctatcatgctaccaaatgtgcgaatgctgtcaccaactccagagaagttaggtgcatcaacattacgccatgtaatttgagccatgatggtttcctattaacgggttaatttattagctgcaatataagcatcagcagtagactggtcacggttctctgctgtagcacggctacgagcacgatcttccagtgcagtgttataagacttaatctggttattcaggttagtgttagtaacactcttagtaaagttcaactggtctttggctaacttattagcctggaaaccactgtagatattagctaatgaaccaagtgcacccagtcctaattggaaggtaggtacattcaatcccaactgatcagctgaaccagacaggaaagaagcagggtaggctactcctgtatttgcccccataccaatagttgcacctgggttatagttcatagccggggtattaaagttctgattgttattagacatccaagacatagcagctggctgtggagttgggttgcctgttaagaatgacaaatccatggggattctcctgttaaacaaggtcagtattaagagtcatatcagagtagttgccaaccatgtctaaagacaagtcagctatatctgaaccagtcatgagagtacgtgacaagaatgaatccaacgactccattgacacgaattgcatggggtcaatcacaccctgtccagcagtaccgaacatctcttcatactgcttattgattgccatcatatcagtattgtactgctgcattacactctctgctttctgaatagtagcagccgtggatgcattaatatactgactaatgccattacccactgaactggtaagttgcatgatgttttgagcactcatcatttcaccagctaaagaggataaggatgtaccagtagacaaagcagtaccaacgttcatggctaccattgaggcaatagcagcaatgataaaacctagcttatcaccgaacagtgaagtagatactttagtaataatggataccagaatcattgcagctatggcgtttgctacagcaccaactattacagcagctaatccaacaaaaccaagtgatgcaccgactgcaccgtatgccccaagtatacctgcaccaccagcacctgctgtaaatacagagacaactacagctaccactacaacaacaattttaaatgccccagtctgataccacttctgcttaaccttcttatatgagttcatcactaagtaggagcaggcagtggataactgagtgctacgaaccagtgacattgaacggtagatattggtgtgcagtggaataatgaatccactctcctctgcatcacccattgcttcggcaacatcaatgtgcactgacttatttttatataccctgttgttgtgatttagacccagtactctaagtttacgataggtattattaccatcctgccaaagcaactcgtattcctgcattgaatagaatgtgtatgttacctcaagtttcttagcagaaccggagttggaagctgtccttatgttcttacgagtaagggttatatctcctgcatacctggctcgaagttgcccctgcttagcaccagaccatgcttgacctgaatgggtagtttcagatacatagttccagccaatagtcatgtcgtacttgtactgcttattactatgcaccctaaactctcgcttaggtataactgggtattctggcagtggtggaggtgttccaataatatgcccttcagtcctgttccaccattccacatatgtgtcaactgcatcatttgctgcctgatagcctgcaatcactgcttccagtgttgggtaggttgggtcaggtgggaatgcttcagtagccatctgaaagaaacgatagatgtattccttagcactatcctcgggggtattaagggatacaccaaatgaaccatagatgtactgaatatcacctatgtcatcattcttcttaagctctgtgactactttatcaatttttccaccagtagctttataaagggctttcttacagtgtgggtagattgggtcattctctacccattgcttatcatttctgattggaatgaatgggtagaatcggttatcagtagcttcagtctcgaacaaagaatctagtgcaacgttaccggagttctgcttataaataagcattttaggtgtactaacagcagtcatctcggtatcagtacgggtagtctgggatgagtacttacgaaccagtgtctctgtggttgtagtgattgtatctgtacgagtaacacctccacctatatcaaccacattagtagttacagaagtactggattgaatctcaccaaattttgtatgagtcattaccctgtcagatacaactacagtcacatcatcaggtttctcagtgaatcctctacgataaactttaacgtaagagttccagttatccacacttggttctgtgacagtactgtcttcatccggtctgccatcagagtaaacagaatgagtatgtatagtcttagtaagattggttgtgttagccgtcgtatcacttgagacggtagtccataacaaagtggaaggtaagtcatcctcatcatcatagacagtagtcggtcctactaccggaggattagtagaaggggacttatagaatgagtaatcagcatagagatataaagcacctggttcaaagttagtaggtgtgaatgtaatagtagagcctccatctaaggaggtcatagtgatttcattagtatcttcatcaatatctatgtcgaatcgttccatgattcgacttggagcattctcataaagatactggtcacaccattgctcaaagtcagcaaagccaatctctgctgcctgaacatagactgattcaccagcagggggtgtaatttgaccctctataacggtagggtcaatcttagccaatacacccaatgaagaaccagccataccaactactgaatcatagtggttcttactccagctggagaacagtcgcatacgaatacctggcccattcagataactatcagagatagtatctgccatagtgaatcctgtattggaaacaatattacctataactacagtcttcatatagttagggcgtttatgtatatcccctgccatgttatagacagaggatgctacgtatactttggtcttcccactgaataagcccatattagttcagcccgttgttagacttcagcttggtcagaatggtgtcaatacttgcgttagtgaaaccatttggtggattcaagccttcatcaatagtcttctgagtaatccatgcatcagtaaacagcttagatgctttaacctctgcatcacgttgataagaagtaatctgttgtgagtacaactctttctgtttacctacagaaccagtaacagtagctccatcactacgggtatcaagtgtctgtgcacgttgtgcttcagtctgctcagtaagcaatttaagctgttgaggtaacatctgactaacattaaacaatgcagcacagtatgtttcagactcagtagcaatcttcatcttagtaagagcatactcactcttagcagacagtgcctgaatcttagccagcacaaactgtgctttaaacgttgccagttgaacacgagcagtaactgcctgaatctgtgccatagcagcagcccagtatgcctggtcacgaccaagtaagaactgaacagcattgctcatgcaagattccatcatagcaatgtatgctttggtatattcaccaccggtaatacggttagctttaaactcagctttcagatgattgtgtgcagattccattaatgcatcaaacgtaccactaccaccaacttcacgggtagtgagtgattcattggatattttatcaatagcaccaaagattggggaagcatccccaccagggatatcccattcggggccagtcatatcaacatcaggaagggtaaagtcatcacccttagttaactcttctaggagtcggttagcttctacctcagcagaacaagacataatcattcctcttggttcaaaaagaaacggcccacggagttaccccagtgagccgtgttgaactgtagcttatacgttaatcgttcaggctaccagcagcaatctgtgcctgagctagttgagctaattcagcttcagtcaacggaggcagtacctcaatggagaactctcgtgcttcagttgcacgaatatccggtaagccattcttacctttacgggtcgtaatgttgatgaacttacgctctttaaggaactcgtagatacaatacggaatgtgataaccattgtcggttacttcaccgaatggaacaaacttacgcacagtacccatatattcgttagctacggtgataatctcacctggcaggtctttcttcttagggtcaaggttctggatacgtacacgaatcagtcgagtctgttctgcacgaatcttttgaccaagagtcatcttcttaacaccagcttcctgtttttcacccagcggattaacggcagcttcttctactactggttcatcttttacttgtgcagcttcaatcttctcacgaagcttttcaacggaaatgttgttagagaacttgatattcatcaacgttgcacgttgcttaagaacttcaagttcgctaggcattgcaatatcgttaacggtatcttcgttgccctgtacgttcacttctacgtcagtggtcggtttatcgttaatgctcatgttcatatttcctgtggttcattcagttttattaagagggggacattagtcccccttgttttatttcggactattacagaggagcaacagtcttaatcatagccagacgttctgggcgtttaaccaggataccgtagtaccacttgatagaactgaagccagtttcaccatacgggtcattacggtcagcagtttctttaccaggcatcttagtcatgatggagaacttaacagacttaccatcagtctggaagccaatggtagagaaggagtcatcaccaactaccagcatcgggaatacgtcgtagtgttcctgaccaccaaccatagtagaacgatagcctgggttagaagtagcctgagcaccagcacctgcccaatgcagcatctcaggaacctggataatacggaacttgtcgatacaaccaacttcaccattcatcagagtaccggcatcagcatagtgctgaatttcgatgaatgctttgttaccgaacagatctttcatcgctttcagttctggaaccaattcagaaccaacgtacattacacgagtaccaccaagtactttggtatcagtcagtttagaaccagtgataatagtagtctgagtcggggtacggttctcagtaagaatctggtcaagacgcatcaggttcttataagaaactacagacggagtagaaccttcaccggtgatggtagcatcagaagtagcagcacctgcatacaatacagtaccagcagcagcaagcaggtctttctggagaacagcttcagtcagctgtacagcaccgttcatcaattcgcgagacaggtgttctttcagttgatcatcagaatcgaagtccagggactcttgggtaaattcgtagaagaaaccgaacttatggatggagccttcacgagacagacgggtaaagcctacacggttaacacgaccaccgttctctgtcagcagaggcagtttggaagtgatgttaccaacgtctttagaagaaccatacaggttaccattaacgatggtagcaccattagcatcaataccctggtcgttaatgttcttatcgtcgagcagaggaacgtactcatacaccttaacagtcttaccgtagttcttcggcatgttaatggtgttagccagtggcatgaagtactggtctttacgagactgaataatagctttcttcagccagtaaaaggtattcatctgatcggaaccagcaccatcaatgctagatttctgaccgtcaattggagcgttatagtttaacatatcgtattattcctgtttaaagactacccggtactgggagtttagcgaaatcttcatcactcatagcgagtgggtttacaataggtgttgctttgcgtgtagcagcccgattaagggaagctgctttagcttgctcactgttagccagagtctgcttaggttgtgctacacgcactaccggctgaactgctggtttaactgcttgtaccggctcaggcttagctacttggttaaatgctccctgttgtgcaaggaggttgccaacgtagttataagcctgaatgaacggagtacctaccggaatctgacctaacatctgaagacggttcacttcatttgcaatggtgtcataaataccattctcacgttgttcgtgaatcgtatggagtaagccacgattctgataaagagcatctttactggcagcatcccatgtcgagccaataacacctaatgtagcttgtccttcttgagtagactttaagtcgtcaatttcggttgcaaaatctgcttcggtgtcggtaacacggtgattgccaccctggtagttaatttcctcatctgggttaaaatccagagggtctgtaccagagtctttgagcaacttcttaatggcctcaggattcttcttatccaggtcaatcaggaaagagagtttgtcctcatccattaaaccgttgttctgtaacatcagcattaccttacggtacggctgaagttcttgcatcttacgagtatagttagcacccatctgcatcaggctaatggcctcctccggtgaacggggagtaatcattttgccgttagctttaaaaggagccatcaacttctcataaccttccttatagttgaagtcagcaggcagaccttcagactgtttgccttcttctttctgttcctggccgggttcagtagtagaaggttcagctttagtaatcggcttaccgttactatcaacttctgtgtcaacaactttatcatcaactttatcagaagttaaagaatttgctgcatcttcttcaactggttcggtttcaggggaggtttcttcggttggtaggtcttcaacagcagaggtgtcaacttcttcatcaggagtctgtacgccgttggtttctgggttgttctgagtggaagtatcttcctcagcgataactgctggggcttccatattcagaatctcatcatccgacattgcgagaatgtcggaagctgtggttgcagcttccgtagtcataggaaatatctccggttaattattcatcttcaggttcagcacgaactgcatcgagttcttcttctacctgaagaataacgtcagcttcgttttcgcccatacgaatggcgaggtcgagccaacgacgtaagtgaccagcagcttgagccatgttaagtgcatctgcacggttatttggttcaagcagtgggtcaccagactcctgcacgtaacgtgcacaatcttctacacagaactggcgaagaattactttacggaacagtggattctccagaagtttacgtacatcttctgcgtgtgcaactgcacctttagcagcttccagtcgatgttccagtccagcgattgttgattctttactcatgtgaaggtctgccttacaagttcatgccaagagccgatgctgggtcttggctagggtcatagaattgggaactaagtgaataagctgggtcttgttgtgcagctaagtcacgttctggtatagagttcccgttagtcaaagcgttatatccaacagcagcagatatgttgggggtagtttcaccttctttagtaggtgttgtcaacgccttagttatctgaaggttttggtttccttgggattgtgctttttgtttttccatatcacgagcatgtttagtaccagattcctgttccagataatccaggtctttaaggtcaccactagaagcagcttctttagctttagcattattgagtgcaatcttactttgtaactcttcattctcaagctgtgctttctgaattgccaattgcttaagctgttcttccatagggtctggttgtggttgccaagtacgtaactcatgagcaaggtctggcatacgtttaagttctgcaatcttagctacaagagataacgtaatagactggtcaactgtgttgcctagtgtttgaaccatgaagcccaaatcctgggacttctggttatcaatttcagcagtgttaatatcaacctcaatgtcgaagttacctttaaggtcttcacggttaatctctacatactgttcgttagtaatacgtactacttccttctctgataagaacacagcattcattgcacaaatcttagtaccaatgtctgccatacccttagctaatcgacgaaggattgccatctcacgtttagatgctgcatcaagtgcaccacgaatgccagcagcaacatctccgtaagctgaaccagttacgccgccagagaatgctttaacacctgttagagcttctgcttcctggttttgcatctgagtcattactattgcagactgaggcaactcagggaacttgtgttccataatagactggctaggatttccctgcatcggattatattcatagtcttgcccatcatcatatcgacgacggttcagagtatctaacatccctttaggataaccacgctgaccatttgcacttcggcctaacaggtcaatcattccacgaatagttgcaccaaggattgcttggttatctcccaacagttcagcatcagcttcaccgtaaagttcacgtttacggggcatgtagggaacaactactaatggtaacttgccatcagggaatgggttcttctccatacgaataagagtagaaccaatccaggtagcaacaattggttccagtgaaccatcatcattaatgtcatagaatccccagtactcataagcaactactttcttacgaagtgcatccttaaactggaagtcaccaggagttttgctttcatggtctgggtcagtaatgggactggaactctcccagtcaatcttatccagattgtgataacggtctttgtttttcataaggtctgctttgcaagtctcaaaggagataactgcatacagagccttatccaaatcaccattacagcttgggtcaataactacgttattagggttaagcatctcaacggtaggtctgttaaccagtgctttttctacttctacttcagtgacccctgtctgaattgcataagtagcttctccagtttcattgaagtagttaacagcttctttgatatcttctggcattgtttcgtcatactcacggggattctctgcctgaagctgcaaagcctgttggagaacatctgcttgttcctggttctcaattggatacaactggaagactggagtttctgttttaatcttaatagtcttacgttcccaaccgatacgagcaataccagtaccgtcatctacgacactatgcacgtaatcatctaccagttttactttattaagctgagtacggaattggtagttaagaactagctcattctggcgtgcagctaactcatcttcaaaagtaaccggagttaccttaaatagtttgttagacgagaggaatggttcagacaatggagcataacgccactctgcctgacggcgaaccagtctaggctggacttgcgagcgtcccttaacctttgggggtttagccttaccctttacttccattaaatcattccactcacgaatctgtgccatgattgcatcgtgagcaggtttagcagattccaaatcacccttcagtaattggatacttggttccttcttccagtccgttaacttctctgattgagccgggtctggtaaaggcttaaaagtgtcttggtgttccatagttattcctgttcaaaaagtttacggtcagcctgaatctgtttacccaactcaattagttggctgtcacggagtctaacagttgcccggagttcttcaaccaaacgtctgccttcttcaagactattgtcgagtctggctgcatggcttgcaagacttctgcactcaagggttccggcttcggcttgacgtttatataccgatgctcgtctttcagactgttgcatccggctgtcgtaatcactgctaacgcgagcaagctcgcttgcgtaattactctcagccgtctgcaaccgggaagtgagtaacccgacttcataactatggtttctttggagagcattgtatttgtcctgtaatttttgcgttgccttttggtcttcgaccttttgggcatcccatttcttttgaacagtagactgcccattggaattgccccaaaagtaaatggtggccccaaggaccaccaccagaagataaggccaacctttagagattagcatcttcattacatgcctccagtggcacattgcctattcggttagctacccaaccatacgtaaagtctggcatgtttaatgaggtatagtggttcagttgtttagcatcaagcagcttaatcattacctgacatgctgcaactttgccccgttttttctgtaatgctttatatgcattaacagtacttgtaccgactttaccatcaacctgtattttagggtagtctttgccattacgtgacatttcattaagagacatctgcaaccacttagcaggacgggttacaccagtattaacaccagcatctactagcttatgcgttacagcaggagatatatcagcgaaggctacgaagttaggtttaagtacatagtcatcaatgtatatctcagcagccatctctttagataaacccttcatagaaccatcccaaccatactcagtagccagaacttctttatgagtcttagctactgattgggtaataccatgattagtttccccacctgggtcacgaggattgtttacataacctccttccatatagaacactgcccccagaatagcagcgataacccctcccactgcaccaccttttgcagcaagtttctgtttagctttcatgtgaatcttcctttggtcggaatcgtattaatctgcctatgatgtttaaggcaaacagtgcgattgcaatattggaaccatggggaatatcttccaagatgtgacgaggtaatcctgtcaccattggttggatgatatctacagcagagaatagaattaaaccaaacgtactaatttgaatggatgcccatttccagcatcttttccagttaggtactaactctacttttctttttagcctgcgaaccatgcgaatatctcccgtcttgcagcagccaatacaccaataattgcacctgctccagcccatacccacttaccaaaaattccagcaccaacaactttatgcttaatggtgatgaactcttcaatagtaggttcattcttagctaagctatcctccacattttttagtctattgcctatgtcattgattgaatcccgtaattctcccagagtttcctccagtttctcacggtcctgtctgtctctcgtctgattctcaaacagagtcttcaatcgttcctccagtctgactagaagcagttcgcccgattcattcataatattaccgtagttgtaaagttaagaaccccaatagggtcgtatcataagatgactcttagataatacttagtatgatgggatacatccagacatagtgtctggtatcaactgcgaggtaactatgtctattaaagatattttccaaagtggtaaggatgttgtgtgcaaaatgaaggggggattgttggtcgtgggaagttatggggaacgaatagtttctgctaataacatctcagagatccccccagaactactacctttcccaccaacagagttagaagacacattccttctggacttgtatacatggaccgggagccaggcagtaaatgaccaatcctggttcaattacttttcattaccagggataactaaatcacctggaggtacagcagcactaacaattgaagaaggaaatcttaagttccccattagaaccaggaatacccaggtaatgttcagtgttcgtatatcaggaattattgcaggtggtgcaggtacagcaagggaatggagaacacaaacaagacgaaccaatggaattacgatagtaggttcagatgctagtgttaaagtacagggtacagacattgctaacagagataacgtactggctacttacacacttggttcaactgaccctttcatggtagacggtattcagttaggtatgtttaatatctcaggacaagtaattaccctaacagcagtatcaattagggcaatgcaaacagtaaactctatataagaaatattattaatagataaaaacaaaccccgcctgagcggggttttatacctagataagtaatagcctggtagtacgtaggctactgttaaccaactctactgatctaaccgtaccagtattactcacttagacataacagctaatgcttcctgcatacgcttaatagtacgccgcatcaacgcagcctctaatatcagtacttcctcgtaacgaataccgtagcgggaacctgctggtgtaatcagtttacgagagccattggcatcttcctcgtatacatcatcccaactgtcgaagcacaggaagccatagcgatgtgcatctataccgtgacgttcgaatgcctccttagctcgctgagcgatgatgccgaagtgccatctagctgagtctgcacccttctcctcaattcggtccaagtactgaaattgcacaaagtcaacttcagaccaagcatccagtaaagcatctgagataataagaggctctgttttatccctagcatctgagataacagtgaatgctgattgagtaaaaccgccagaccatgctcgacttgcggaacctaatgcgtatgtatcagtactatctggggtcattgcattagaacctaactgcaaataacctgtgctactggtaggaagacgcacgttaccgttggtgagtgatactgtccgagaagtaccatcagaagtaaataggcgaacttgagaagaagtacccccacctacagctaatgacacagcaccatccccaagcattctgtacttatcagccgaggtaagaacgcctgacggaagtgacatggacttaatccgccattcgaacctaccggacatactgcctatgtactgtcctaatgcaggagcgtgcactacgttactattactagtgccgtcaatagtaactgcaccttcaatagtaccagtagcactgagaaggtcgtttctccttcccggatgctttacctctacgaagttacgggtagaacctgattcgaaagtaataacacctgtagcactgtagctaggaaatacagacgcatagttgttattagctgtatctataaagcgcgcaattgtagcagtttgagcttgccctaaagagttagtaccatcacatcctgacataagcacattgcttattacgttatcagagccttctactgtaacaccgtgagcctgactagcgtcagagattgagaaatctacaagcacatctgagattaagttggtactacctttgcctgcaacaaccgctgcatatttaggattattagccactaccccattgataaggttgttagagggagctattgacccttctgtaccgttgtaagttacatgctggcagtctgcccctataacattgctgactatgttataactggctgtacctttcagttctacagccccgaactgagggtagttcttagcaatgacgttatttatgagggagttaaccgaggaatcagcaagtatgcatccagccgccttattagtagcatagccggagtagctacctcgaatgcctttaatcataagcccatcagagggtgcatcattagggtatgtgattaaactgaaaccagcgcccttaacgtttgagaaattaacatcacttatagtaacatcactgccaccagcaagagatacctgctgcccttgagtggtatcggtcgccttattactttctaccgtaatattacttaagcgacctgagcgtagattgttaaatactaagtagttacctgtacttgaacggtgacttagtacaccactgcctctaccgtctaagttacagtaattactattaataccagaactagagaatacaccgtctgatgctacgacagctttttgagaatttagtgaagcagctatattctccgtactatctgttacaccatcccctttagcaccccagcctcgaacatcaccctcatcacgccatcttgccatctgcaattcagggtaactggacgcaccatccgggtctgaaatctggctgcgcagggctgcatcaccgacgctcagccactttcctgtaccaatatcaggaacagacccagcatctacaacctttggcagtgcgccatcccatcgatacaacccaccctggtattcaagacattcattctttactttaatctcataacccaaagagaaggacccagggactgttataaactctcctcgtgaaacagctagtgcacccaggtcaacattaccagtagagtgaactaacacaccggcagtattaaggcttacagcagtaacccctgaaccaaggtctgcaggtaatgagtaagctcgctgggtagtcttatcataaatgaccttgtattcccctaagtctacacctacagcaaagtaaacaacctcattctgcttaacaccaaacttacgggcaatggcttgtttgttggtaagaataccagtggagcctttaccaccttgtgagaacatttcgttcataagaacctctttgtttttctggttaatggcgtccttgccgaatatatccttatgtacacattggaagattatttaaatttttccaattgccgacgaagaaatgcacacttaagtacgggagatttctcataactaataccgtatccacccctccaccaacttaatggcaaaatggttttgtttattacttctgttcaagagcagaaagtctggcttcgattctttccagttttcttctctgataagcggcttcagcaaagaaaattccgtcaggccgaacaccccactcctcaccctcttcatgaataaccacctcggtgtatacaggttcttccgtagtagtgacattaccctcctcgtcagtgtgttcaacgatttcattgtgtgaaaataccgtatcggtcatccgtggatacttgtcatagcacagaacagcataacgacaattcgtactgttttcatccatcagaccatgtgcaatgaatacatcacgaatttgttgagcaataaccccgaagtgaatacgagcatcattgcctttcagttgaacagcatctaaccactggtacatgatgtagtgaacgtcaccccaggcatccaggaaagcatcatcaaaaactaccggctctgttttcttctctccgttagaagtaacaatagggttacttccgaggtatgcagtggtgaaacggttacttggtccaccaagcgcaatgacgttatcgttataaggcttaacatcagcaccctgaaacagatgttcatttccgttgtaaactatcctgcgagaagctgtgttgctcgcaccgtaaagcgtaatctgtgcaccagtagaagaactggttccgtctcccccgcaaaatatgatgcgctgccctgctgggttattagtcggtacagatttcccgataaacccatactcaccttccattaaaacttcagagcgaatgttactactggtgctggctctaagggtcacatgacctaaacccaaatctcctgtaaattccattggagcaggaacagtgcgaatcccatttgtatcaaaaaacacggggacagctctgtcaggtacagcaccatatctgaaatccctggaaacacgattgtctgaaccaatcttcattttgtagcaatacaaatctgatggatgaccatctgatttgaatgggtctttcgatgagttatctccatatgtccaggggttcagatggtcttccccaccgaacaagtaatagatataactatccttaacgaccactgagccaacaccaacgccagagttgacaatgccaccctgataaatctggtcagtgatatttacccattgagtattatccaggttccaggtgtctaggttcactcgcgtgtaaaacgttcgcgggtaagaactgaaatatcgctggtcgggtgcgtttgcttcccactcgttgtccgcacgttctgttccaaaaagaatgagttcgtttcctaccttagcgaatggcagggtggagtggtggacattattcgggaacctcaatgattgccaggatatacccaaatcgttactacgatgtagtgaactacccagacgatccgaccgagttccacgggttacaacataaagaacaccgtcaaaatatttaacacagggttctgccgcatctggctcatattcagcagggatacgtcgttttatataatgcccaggattgttaaatgcatccgggaaatacagcataccaacttcacgtggagcagcatcaccctggtgatatcccatcataaatgaatcattattgatggcggtaaaactgtgaacctcggtaaccatgggaatcagtccaaggttggttttacgccaaggtgactggtggaacgatgtccccatatgccagactttggtagagttattttggtcagattcctgttgatttggcgtggtgacagtaaatgtgttgcggtcaataactgaagttacagtcatattccccgaaacaccagtcaccccagagttcgagaagttaacaaaatctccggcaaacaatccatggtcaggaatagtaattacagccacaggctgattagcggcttttgtgataccacctgtcggatggtaattacgggacataggacggtcccatatctcacaggtcaccagtgcgttagatgctaaagtacgtgtctcaatcatcgcaaagagacgattacgcatcacccccatactcatacagtggtagttaactgtcgggtaatcaggatgtaggtcggttaaccattccggcgttgtccaggtctgtccgtcatcccctgaacgaacccaggatacatgcagcctgctgaccccatgtctatcactagccatgaacgggcagtaaataacatcatcgtaaacgaacgctttatcctgtggccacgcattgtaataaggggtgtccgttattttgaaaagctcgccctgaacaaattcttcagaggcataataaagcggctgaccaggaatacgctcataaacaaaacgagtgttgacgaatcgactaatatcaggcaaggatgtgaccttatatgtcttcccattgccattaatcttttgtccaactggtgtgtcgtttaatacgttcgttaatgctactgtatcatcatgcacagcgtcccctttaacaccccaaccacggacatctccctgattacgccatagggtattttggtcagtttcttttttggttagtaactcaacctgaatgttacctggagtatatgtaaggatattaccaactacgctggatatatacacattagttggtaattctggaataacgtaaatctgctgattatcgggattataaataacttttttgttatttaaggattgtactgtattagtactgagaataacctcagaatcttttacattagccgcacgagccacttcctgtagagtacgatctgttgcttccaatactcgtgcttcaccaccaatctgtactatcaaacgatcattggttgtcagtggttcggtaagaaaaatacgttggttatctgggtcagcagtataagactcagtagttaatcctttatacaaacgaagaccattcttatacacagccggaatagactggaaggtatacggaatagcaataacctgctcaccccctacagcagcaccattgttgtacaaccaattgatctgaatccagtcattaatgttaggattatccggtacagcaggaacaccagtcagaaggaatactacttcatctccttcctctaaaggttgagccagagttacggacaggctgtctacgttgaactcaaatccacgacctacatactgcatgtcgccattaacaataatgaaaggtacacccaccgtaccatctggtacgttgattgtggtttccccaccagtagcagaaccattactgtatacccaaggaatataagcaccttcactggaagaagtaccaccaccattggaaccagaagtagcaacagtaatccacgaaccagttgcttctgagtcatctgggatgatgccagtacgatcaccttctacgtacaagtaatcagttacctgccggtcacctgcacgggagaaaccgtagatacgggaatatttaacctgcgtggataatgccttcaattcctcttcagagtttacaccgatgaccatcccatactggttcaggaaatcatacaggagtttaagattacccaggttgcagtacacagtacgaaccacatggtaagcattaccaagcagtgcatccaccatttggtcattggaactgctatgacaatatggattggtccaatcctgatttgcatcaaagggggtatgtgcgttcatcgccatcctcgttgttcaaatttagtttcggtaattgaaatacttccattagccaggtcgtaatcaacaacctcaccacagatgctttcatatgtttgcagatgctctgctgctttagcgttagcttccggagtattcaaaccggtgtggtaacgataacccacccagttatgaagtgccgtcattagcgtatcagctaaatcaacttcctgttcttcatcacccgtaagcactgggtgcttggcttgatacattacgttaagtgcctcaaagtgtcgaggacgcatacactgaatagtatcaggccgtggagtgaagatagcacgagggtccgaatcatcgttcagtctacgtcggttccctgagttatcaaatacatttaagattttaataacatcatcctggaaaggtttcatgaacccatccatgatgtatggatactgaacctcaagagtgggcttagtaaatctggagtaagcatatctggattgaagaggataatcggtacgcccttctttcatctccacaatacaactattagttctgagagggaaacgactatgcagtcgaaccaatccttcattaatagctgccagtatctcaggcttactatcaggctcaatacacaatctgtcatccgtgactgcaccagtacccttcaaggtacttagtgccaagccacggtatacttccgataatttttgcatggttcctcacacaatatatgaacgtagggggttaacactatcttcttcttcatcgtcccacatcgggtcacccttgttatccaccatagtcatacctgcctgtggtttccagggattgagataacccagcatagagatagtatcaatacagtcatccttacctttgattccattaatggtagctaatttaatctggcccatgaacaaacccataatagttgaatctctcaactcttccgggaagtacatcttaccagctttgaaccatggaactacctggttaaagcgtgacagcttagaggttacaggacgtatgcctggcttaccaccttcagaggatgcaaagttaaagaagacattacggttaatcatttctttttgaaggagtgagatgaatccaccttgttgacctgtggtttcgaccccaacattttgtggttggtattcctgaaccagacggaataagtcatcaaagtttttatccataagctgacgattagccacaccatcaacccagaaccaatctccattagaactataagcccaaactgaaatgacactgtagtcactggtctgtttctccgaagtagcaaagtcagttgtaatgtaatagttgtagcaggacttcatccttaatagttgttgtctgctataccacctaatttcactatcctgaaccagtctctcatcttcagaactaatacgaagcataagttcctgatagaagccagccaacttaccagtcttaactgccatatcgtattgagctttgatgtagtcatatgagaaacggtcatcccatgcaccctgaaattcttccctgctacaggggaacttctcgcatacaggccatacgttgacatcccatgcaccagactcaactgcttcaatgataatgtcttccttattaaagggagtaccattgaaaattactttacgacgggttgggtcaagagcatggttcacacctttatagacggtatccttaatagcttccatgcttgtcttggagttagcatcaccatcgctaatcaagtcatccagtacacagagtgttggacgtttaccatatatcttcgtaccacgaagacctgtcttagcaccaaacaacttaacaccaagtcgatgtccttctacattacggaactccagaaggttatctgtaaatgtagcctcaggtatccattgctgaaggaactcactattcttgtaacggaactcaatgttcttacgtgcagacttagcaccgttatccattgagtcagatacgtaaatcattccttctaccttacccaggcttggtaaatgaccaaacactgccaggaacaaagtaaagtactccatgaatacagcagttttacctgcaccacggaaacacaggttaactacatactggttcggactaatcatcttatccagcatcttcaagtgaactggaggtgttttgttagattcaccctccttaccattaaccaacttaataaagttggcaaaggtaagagcaaactgactaggaacatagttagaagaattaaggtgggagtaatccacctggtctagccattcatctagttcctgtttaattaattcagacatttgtaatgtcctcatctgcacgtactagtttagaaccagcaacctctttggtaggtacaccactattgattgcattgatttgctgttcagctaatgcagcaagtgttgccttgaggtcagttaacccggagttctctcttaagtccagattgatattcgttacctggtctttcggtttagccaagtgagtaaggatagagttagctgcatcacatcttactttctcacttgctgctgtggtcattagttcaacctgaacgttgatagccttttgataattgtcctggttcacaatccacactggaaccaaactttgttccatgatgaggttaaccaatttacccctatggtaagcagatacataagcactgatatctttctcactggttcctcgtgctacaagttctgcttgtcggttagggaatgtcttaaagtaggcttccttatttgagtagcccatgtgtttgtaagtcacatactgaactgcattcatgtagtcctgtgtcttaaacttaccttccttcataactccagagtaagagatgaagttttcacggaatgcttcagcaaccagttggtcttgggtaatgttgttaattgtgtccaccaactcctgggttacactgttcttgaagttagcaggtagggcattaacaatctgctgcttagttagttcactcatacttatctcgctacaaagttatgtctattaaagaagattcttttcttggggtgagttaccccttgaagaaaccataccatacagttacactttagtcatgatatagaaaaagttcatgatactaaatagtatgtaatgttccgatgaccctattcctaaaaggagtaacatttgagaatctatatgagagtccacgactccaaagatgaatacaaagaactagaccataccaaggctggtattctttcagatgatattatcattacacatgatgaagattcctaccatgaattagctgggatgatgctattagagaatcgtccaggcattaagatcttagaaccaagagaaacttactctttagaaaagagactttcagctcttgtgttcttcacaaaattacctcatagtgtctccgtcaggcgaagcaaagatagtgttcggatgatggtgacgatgtgattagtcatgccgcctagtagacagtggcggtactcgtaaagagttaataacttctacagtcagggttacccggctcctttcctacctagtaggctaacgatacacatgtatctagggtgatgaactgacccgtgattgaaaacggtaaggggtagagtcgagaggctctaccccatttctttttcaggaggtatgcaaatatgagcatctacgcttttgatattgatattactgggatacttcgtaatcaagaaccttattaccttggggaaccagaagtagtaagtaagttcattaccccatggcaaacagtattcttacctgactgtgaagagtcacacgaggttattggttctcttttcctatccaacctgcaactcaatactaagatactcactgaaccaaaggtgtatgacctctccttttacagcgactttagtatgattttccctggtgttaggttctataaaatacctggttgggaattgatagctgaccataatgtctttaataaaacactttccatttacttcagacctattcctaaaggaaggaaaattaatcatgaaattcataatgaccatccccagttttgctgaaagagaatctatgtatacaactgacttctctttagaagaagtaatgaacagcaacccccagcaagtaatcctggttcctaccttagaggactaccatgaagtaaggggacagctattcttagcaggtaatgatcgtaaggttgtatgtattattccaccctctgtctataccaactacagtgcaggtgaccctatcccatatatgttggtatctaatgactaccaatgggatagtcggtatgtaaatgatgaatactgttactactatataaggaagtaagatatgcatctgtattgccttattagctttgctactacttgctatttgtctccatatacattggataatatcctggcaggtaaggggagagttaccaccatcctgtatgagccaagtgaagatgcagatgtgctcataggtacttgcttaatgttggggcaacctatccaattcattaagatagtagattccgtagaaataccggaacacaccagtgtgtacatattgtcagagagtgaacctatggtagtaactacccttactggtagacttattaccctctatccttctacctcatatttatctagcgacgagagtctctaatgaaactaaacacatcaccctacccggtacagttagaagtagtattcgaccaggataccttcattaaaaagtataagaaacttaaagggcatgagccagacttggatggttgtaaggggtatacttcttattctggcaatcgagtattgattggtatctttagggaacctttacatacactcatccacgaactcaaccatttctgtttgtgggcgtttgactacataggtatgcctataaactctgccaatagtgaagcatattgctattactatgaccacatcctctcccagattccttcctcctatttaactgcttataaggattagcatgagattatatttcctatcagatatgggaaggttacatgtaggagagggtatactatggaattggatatgtaacaatattcccaatgtacctgtatatgttcactccgatatagactatcactggttaagaggcgagtgcttacttagaaatatgatagttaacttcataaaactagaaccatgggatagggtatccgatgtatctggcccatgctacttcttagcagttaatgggcatagagcagagaagatgttatatagaactaaatagagggtagatagataccttctcataatatttataaataaggcagaaccggtgacaagagtacaatacctatgaatcctatagcgaaggcacaggcaataaagtgaagccagttctcagggtctgtaggattgtaattaccccaaccatctttcatgttagtaccccaaagttatctgcttatagagatagtgcctataatatttttgcatgtcaaaattgtgatagctatatacagcagcagtgttg

SEQ ID NO: 17 - DNA, 43535 bp, Unknown
  Podoviridae; Autographivirinae
tctgttcgtttcgttcactccgcttgcgctccgttcactcgctcacgtgtaccttaggttattccttgatggatggcttaggttagccttagtgggctgccctagttaaagcctcagtgcttagcttagtatcaacttagtagtgtaccttagttagtcttagtgccagaccttagtgattgcatagctaaagctataagatgcaattaggtcgcggtcggtagaccgctgagagtaggtaatagtgataagatgcagtaggagaaacaccagaaacctagccgtcctagcctatcctagctctgtatctattgctttgccttagtctaacatgtgagacaacctagatttatcttagtgatgatagcttagtattgacaagtttggtttagtgtaatactattcatcacgtaggcagcactgaggtgcttagtagccagctagtaaggcgtacgaagagactagtgcctacattgctctttaacaatctgcttagtgtaacctatgtatgccgtggttaattacttattgaatgaaggttaactatgacaagcttatatcttgatgcaaccagccaccgttattacgcattatatggaggtacattagtctcttttgtaggtggaacaggtgttaggcgtgtaatatcctacaaggctacgcatgaagcctgtatcactgcaggcttacagctaattggcactaactttaaggagcggtattaatgactctgaataaccgcgaattatccgttctcttcaccttgttatgctacatgattcgtaatggtgagctacttactaatgacgagcaagccttgtatgaccgattcatcaatgacggatgggtagacagtgtaaacaagaaggagaaagcataatgttccaacacgaagttttcttcgaatcagctagcgaagctattcgcttccatgacgatatgatgcaagcgggtgtaggtgttgatgtgtatcactatttgatagattacgacactgaatatcaccgagttaccttagtatctgagtatgacaaccaagtcattactgagtatctaggcagtgaagattacgattacgatgaagtaatcacgacaaatttctaaaaattaactattgacaaccacggcatacaaggctacattaagcatcaagacggcgacgtctttaaacatcccgctctttaacaatatgggtagtagcttcttagtctggataggttaaacctagggtattctttttgagtaccctataatgtaacctaactaactaatgaggatcaaatcatggaacgcaatgctaacgcttactacaaccttctggctgcaactgttgaagcatttaacgagcgcattcagtacgatgcaattcgtgaaggcgatgattattctgatgcacttcatgaggttgtggatagtagtgttccagtttattacagtgaaatctttactgtgatggctgcggatggcatcgattgtgcctttgatgatgcaggtcttatccctgacaccaaggatgtaaccaagatttgccaagcccgtatttatgaggcgctttataatgatgtaccaaatgacagcaatgtggcttggtatgaagatgaggaagaataaagatggaaaggcaatataacttcatattttcagacggtgtggccttgaaatgctccttgcggttcgcacaactgcgcgaggaagtgctaggcactacatacaaactatttagctgacactataagagaaggcttaacaaggcgttgctacggtagcgcctgattaaactttcacttactaggagttaagactatggatttagatagcatcattatggcatttgctcttattggcttaagctggtgctcctatcacctttaccgtgagtttttattcgataaagctaaacgcaaactaagaaaggaaggcggtaactacctctgtgtaagaggtggtttagtcgaatacattgcacctaacggcacggaatgcgccattaacaaagatgcatttatagaaacgtggcattacatcaagtaactagcctatagcctgcctgtgtgggctatgtgatatttacttacactatttaaggtgattaatatgactactgaaaacactcttctgtctgttcgtgaagctgcaaccgctgaaatcaagcagcacttagacaatatcggcacttcttacatcaaagttggcgcttgtctgaatgaattacgcggtgatttcgagggtcaaaaagactttttagcttatgtagaatcagagttcggcatcaagaaggcacaatgctacaagctgatgagtgtagcccgtgtctttgaaggagacgaacgctttaaaggtgtggctatgcgtgtaatgctggcgcttgttcctttcgctgatgaaaatataatcatggagaaggccgcagaactcgccgcagatggcaagctggacactaacgccgtaaacgccctgattgagcctaagaaagagccaaaggccgaaacggtacaatctaaggctgagccagtaaaaccgcaggagaacgcgactgaggccgcagaatcacaggaaatgcaagcgccgcagttagtgccacccgcgagcgagcaggaggtcgacgaatcagcaccatggggagaggaaagcaagccggaggcaccgaaggccgcgccgctggataacacggctaatactgagaatgcagctattgctggtctgctggcacaaattaaagcactgactgagcaattacaggcagccaatgaccgcatcgcctctttaagtagcgcacgcgaaagcaagaaggcagccgcgcctatgctgccgcaattcaaatcttcctgcttctatgctcgcttaggtttaagcgctgaggaggcaacgaagaaaacagcagttaacaaggcacgccgcgaactggttaagctaggctatggtgaaggccatgaagcatgggccttaatctctgaggcagtagaagaattaactaagtaaccttatcggtggcatcttcttaggtgtcacctattaaggtttctttcactaggagtaaaacaagatgcaagacctacacgctattcaacttcaacttgaagaagaaatgtttaacggcggtatccgtcgctttgaagcggaccaacaacgccagattgcatccggtaatgaatcagacacggcatggaatcgccgcttattgtccgaactaatcgcacctatggcggaaggtattcaggcttataaggaagagtacgaaggtaaaagaggccgcgcaccgcgtgcattagctttcattaactgcgtagaaaacgaagtagcagcatatatcaccatgaaaatcgttatggacatgctgaatacagacgttaccttacaagccatcgctatgcatgtagcggaccgcatcgaagaccaagtacgttttagcaagctggaaggtcacgcagctaagtactttgagaaagtgaagaagtcgcttaaggctagcaagactaaatcttatcgtcatgcgcacaacgtagcggtagtagctgagaaatctgttgctgaccgtgacgcggatttctcccgttgggaggcatggcctaaagacaccttactgcaaatcggtatgaccttgctcgaaatattagagaatagtgtattcttcaatggtcaacctgtcttccttcgtaccttgcgcactaacggcggaaagcatggtgtttactatttacagaccagtgaacatgttggcgagtggataactgcatttaaggaacatgtagcgcagctcagtcctgcctatgcaccttgcgttatgcctcctcgcccttgggtatcaccttttaacggtgggtttcatactgagaaagtagcaagccgtgtccgtctggtaaaaggcaatcgtgagcacgtccgcaggctgaccaaaaagcaaatgccagcggtttacaaggctgttaacgctttgcaggctactaagtggcaggttaataaagaggttttacaggttgtggaggacgttatacgtctagacctcggctatggtgtaccttcctttaaaccactcatcgaccgtgagaacaagccagctaatccggtgccgttagagttccagcacctgcgaggccgtgaactgaaagaaatgttaacaccggaacaatggcaagcctttatcaactggaaaggtgaatgcactaagctgtacaccgctgagactaagcgcggcagcaagtcggcggcgaccgtccgcatggttgggcaggcacgtaaatacagccagtttgacgccatctacttcgtgtatgcactggacagccgcagccgcgtctacgcgcaatctagcacgctctctccgcaatcaaacgacttaggcaaggcattgctccgttttaccgaagggcagcgtcttgatagcgctgaggcgcttaagtggtttttggtgaacggggctaataactggggttgggataagaaaacttttgacgtgcgcaccgctaacgtgctggatagtgaatttcaagacatgtgccgcgacattgcagcggatccgctgaccttcactcaatgggtaaatgccgactccccttacggcttccttgcatggtgctttgaatatgcgcgttatcttgatgcactggatgaaggcacgcaagaccaattcatgacgcacctcccagtccatcaagatggtagttgttctggtatccagcactacagtgctatgctacgcgatgcagtaggtgcgaaagcagtaaaccttaagccctctgactctcctcaagatatttatggtgccgttgcgcaggtagtaattcagaagaattatgcatacatgaatgcagaggatgcggaaaccttcacttctggcagcgtgactttaacaggtgcggaactgcgtagtatggctagtgcgtgggatatgataggaatcactcgcggcctgaccaaaaagcccgtaatgacactaccttatggcagcacacgtctaacctgccgtgagtcagtgattgattatatcgttgatttagaagaaaaagaggcccaacgggctattgcggaagggcgtaccgccaatcctgtacacccttttgataatgaccgtaaagacagcctgacacctagcgcagcttataactatatgacagctttaatctggccttctatttcggaagtggttaaagctcctatagtggcaatgaaaatgattcgtcagcttgcccgtttcgcagctaaaaggaatgaaggcttagagtataccctgcctactggcttcatcttgcaacaaaagattatggctactgatatgctccgcgtatctacttgcttgatgggagaaatcaagatgagtctacagattgaaacagacgtagtggatgaaacggcaatgatgggcgctgctgctcctaactttgtgcatggtcatgatgccagccaccttatcttaacagtctgcgaccttgttgataaagggattacatctatcgcagttattcatgactcttttggcactcatgcaggccgtacagccgaccttcgtgatagcttaagggcagaaatggtggagatgtatcaaggccgtaatgcactgcaaagcctgctagatgagcacgaagaacgctggttagttgataccggaatacaagtaccagagcaaggggagtttgaccttaacgaaatcttagtttcagactattgcttcgcataatattaataggccattccttcgggagtggcctttcttttacctactacctgtaacatttcattaacataaagtgtctcacatgtgagacttatttaccggacactataggatagccgtcggagacgggaaggaaagggaagataaaggatataaaggaagtaataggtattaaaggttatataggttatctaggaatacctattaccttcttccttcctcttattaccacttagagggagggcagatctaggttgtctcacatgtgagacttcatatttaccggacagtatagataagattaactcactttggagatttaaccatgcgtaactttgagaagatgacccgtaaagctaaccgttttgacatggaagaagggcagaagaaaggcaagaagctgaataaacctgtccgtgaccgtgcatctaaacgcgcagcgtgggagttctaagttatggctattattcagaacgtaccgtgtcctgcctgtcaaaagaatggacatgatgttactggcaaccatcttatgatatttgatgatggtgctggctattgtaaccgtggtcacttccatgataatggcaagccttactaccacaagccggaaggtggcatcgagataaccgagttacctattactggcaatatcaaatacacaccttctcaattcaaagagatggagaaggaagggaagattagcgaccctaagctacgcgccatcgcactaggtggtatgcgtatgaaagaccgttgggaggtcatgaatgagcaagaaagggcagaccaagaagtagagtggaaacttgatgttgaatggttcctcacgcttaaacgtaagaatcttgtttcccgacacattcgcggcgacatttgcgcattgtatgatgtacgtgtcggacacgatgaagggggtagagtctcgaggcattactatccacgcttcgagaaaggtaagctagtaggcgctaagtgtcgcacattacctaaagactttaagtttggtcatttgggtaaactctttggtatgcaagatcttttcggaatgaatactttgtctcacgtgttagacaagggaagacgaagggattgcttgcttattgtgggtggtgaactggatgctctagcagcgcagcagatgctccttgattctgccaagggtactaagtgggaaggccaaccttaccatgtatggtctgtcaacaaaggtgagtcttgccttgaagagatagtgcagaaccgtgagtatatcgcccaattcaagaagattatatggggttttgatggagatgaggtagggcagaagcagaatcagcaagcggctcgcctgtttcctggcaaatcctatatccttgaatacccttctggttgcaaagatgccaacaaggcattgatggctggtaaggctaaagagtttgtagatgcatggtttaatgccaagtcatctgatgaagtctttggtagccagattaaatctatcgcatctcaaagggataaactcaaggctgcacgtccagagcaaggactgtcatggccttggcctaagctgaacaaggtaacgctaggtattcgtaagaaccagcttatcattgtaggtgcagggtctggtgtaggtaagactgagttcctccgcgaagtggttaaacatcttattgaagaacacggtgaatctgtaggcatcatttctacagaagacccaatggtcaaggtgtcccgtgcttttatcggtaagtggattgataagcgcattgagttaccgccaaccaatgacccgaaagaagacggataccgtgaggtgtttgactacaccgaggaagaagctaacgctgccattgattatgtggctgatacaggaaagctatttgtggctgacctagaaggcgactattctatggagaaggtagagcaaacttgcctagagtttgaggctatgggcatttctaatatcatcattgataacttaacggggattaaattagatgagcgtgcttttggtgggaaggttggtgcacttgatgaatgcgtcaaacgaattggtactatcaaagaccgacatgcggttacgattttccttgtctctcaccttacacggcctccggcaaaccgtacccaacacgaagaaggtggcgaagttatcctttctgacttccgaggctcaggcgctatcggattctgggcatcttacgccttggggattgagcgtaacacaagagctgaaacgcttgatgaaaggactaccacgtacatctcttgtgtcaaagaccgcgaccaaggtatctacactggaaccaaggtcatgcttaagggtgacattcaaaccggacgtttaatggaaccacaagcccgtactaagtcatttgatacaggtgaagcaaggcaacaagaagtacctgatttacctgacactatagaagagacaacctttgacgatgaacaggagttttaatggaaattattaaaccagtattgaatatcggtattgagatcctattcatgcttgtgatcgcagattatgctgcacgatatggattcaagaaagctgtgaaacttatcgttgcatctggttttcttatgtcaatgttctttattgtaacacgccttatctagtgtatttatcagggcttgtctcacatgtgagacaggctcttattaggtacattaaataactggagattgattatgtataacttagtgttgaatgtaggtgactttgtacgcaacatcaagaaagattcaagtcgctatctttgccgtggtgttgtaacctttgtaggtgagaacctgtattatgtagaatatcgcagtggtgttaagcaatattaccacaagaagacagcacataaatatcttgaaaagattgtagagataaacaatcaatgtaagtgcgtacatgatgaggtttgcgataaatgtgctcgccagatgcttaagaatttcctagctcctctttattatggtgctggtcctcaaacactagcagagtacatggcagaaaagaaaaccacactcaagaaagagcgtcgcaatgtaatcactggtaagactcaaagtgagatgattaagcaatgtggcactgcattaggtgttacacagtttaatactcgtgcattgggtaaatccacaggacaagctatggtaaagattggagaagccatgatgcacccaaatgtacctgtgcgaatcatggatgttgaccatgcaatcacagaacaaggtacgcaacgacgtgtaattaataagcattttgccgacactatagaaggcattattcgtaagcaagggttgaaaggtcttcacatcttaaatggtgaagaattactgtacctacctatcgttactgaagaaacatacgtgaatatctaaggagttaatcatgactaaggtattaatttatatgcgtggacctcataaatgctatgcagttgtagcaccagatggtgttaagccctatggtatttcaaaggggtttgcattaataggtgctagtagcagtgcaagttttcagatggaacttttcggtcatttgactgaaaaagagttccgtgaggagtttaatgtaatcggcagctttatggtgaaacatgcagaataaacatagtcttaaaatgttcgatgggcatgaagacctgcaagccaagattactaaccaagccttcctgttcgcacagttaactatggctgaggccaagaagaatagtctcactcgtgaacaggttatcaaggaggccacttgggaaccacaccaaggtaaatatatgggccacaaattaactgtaacacgcagtcgataagtcaagggttgtccaacgtgttggacagcctttcatcatattgattgggaggtattaaatgactaagtttactatgcaagacctcattaaattacgtgatgaaatagaatcaccggaagttaatacagagtttcactacattgatccacgagataaacgagagattcctgattatcagattgagacggagttaatgtatgaagattattgattggaagaaggaagcagaaggccgtatcctagtgatggatgcggaggctaaaggcctgctggatgctatccgctacggtcatcgtgaagatgtacacattatttgctgcatggacttgctcaccactgaggagttcctcttcttcgacccatatgagatgcgtgaccctgaagcaagggaacacctgaaagagtgggaaagccatcaagatgggaccttggttgatggtgttaacttcctaaagcactgtgaggctattgtgtcgcagaacttcctagggtatgacggtcttctctttgagaaagcattccctgatatatggaaaggctttaattacacagagaagcgtggcaagggcaggctccgtgccgacctgtgtcctgtgcgagtcatggacacgctggtgatgagccgcctgttaaaccctgatagacgcctccctccgcaagcatacgccaaaggcatgggtaacgtcacccctcactcaattgaggcgcacggcatccgtataggccgttataagccggagaatgaggactggtctaagctaactgaccacatggttcaccgtgtacgggaggacgtggcgattggtcgtgacttgttcctctggctctttaacggggaatggacggagcacaaacgccgtggcgtgaataagcgcactggcctaggcattgagactgccttccacatggaatccattgtggcgctggagatgagtcgtcaggccgagcgtggattccgtctggatatagataaagcattagcacgatgcgaggaattggacgctaagattgatgagacggtcgcagcgttccgtccgcacatgcctatgcgtatcaagtctaaaccttttaaaccggaagaaaagaatgaagtatgccaacgcgcaaatgagtatggagctagcaacaatatacctactatccttgacccctctcactttcttcacgcagagagacgaggagatcgcaagacagtatggagtgtcactactaagtctggtgattggtcggctagtgtcaagaaagactttcctcaccttagaggaaaccgtaatgacacgccaagtatcaagtggattggcgcttactcgcctgttactttcgaagagattcccttgggtaacagggatacagttaagcaagtgctctatgattatgggtggaagggtgttgaatttaacgataccgagcaagcgcatctcgatgagtacggagtgttacccaagccttggagtgggaagataaatgaaaaatcccttactttatggcaagagagagccgcacgtgaaggtaaaacaacccctgattggtgcttgggtatcgctgcatggtacatactcgtatcccgtcgtggtcagatccttaaccgtggtgacgttgaaaccttcgaccagaagggggtgtggccttcgcaagctggtatacgaaagtgtcgcggccttgtacctgtagcatttaacaaggagttaggaatcaatgcgcagcaatactacgaaaggtacggatgctggcctacgtcagacaaggatgacggagaatggcgtgtgccagctattgctattagtattggaacttctacgttccgtatgcgtcatcgtaacgtggttaatattcctgcccgtggtttgtatcctttacgtgatttattcatagccagtaaaggtaagctaatccttggttgtgatggtgctggtcttgaactacgtgtactgtctcacttcatgaatgaccctgaatatcaagatattgtactgcatggtgacattcacacccataatcaaatgaaggctggtcttcctaagcgtgacatggcgaagacatttatatatgccttcctatatgggtctggtatagctaaccttgcagcagtatgtggtgttactgaggaagaaatggaggaagttgtggcaagatttgaggttgaactaccatctcttgcacgtcttcgtgagaatgttatcgcacaaggtaacaagtttggctacctacaagcgcctgatggtcattggggtcgcatccgtatgtctggtggtgaacttaaagaacacactatgcttaacgtactactccagatgactggttctctgtgtatgaaatacgcattggtcagagcgtttgcagtgatgcgcaaggaaggtgtggccttagatagcatgggaaacccttgcggtatagctaacgtgcacgatgaaatccagatggaagtccctgaagatgaggtcttgtatctcaactacgccttgcctttcaccttagaagggttcgaaacagagaaggctgctgtgaaagcagtgttcgatgcagaggagaaacgtgttcatgtggactctgaaggacgtatgtggtctgctgcaaatctcgttagtgttgatgcggatgctggtgtacttcattgccagcgtcgttatcaccgtgcagggcatatcattgccgatgcaatgacttgggcgggtcagtacctgaagatgcgttgtccgatggcaggtgagtataagattggtgcaagttggaaggagacacactaatgcaaactgcttttatcattcttggagtcatattatttatggtagtattctgggctttctctggcattgacccagattgtgatggtaactacgactgagttatactcaaggtcacttacgagtggcctttatgaataacttattcctacttattttgtctaacatgatttactggacactatagaaggaaagcctaggtaatctaggtttataaggtagtataggtaattaagtaaatataggagatataaatatgtctatggtaactactctggtattcgtagctcaatactttcgtggcttatctaataagtttaaatacaaggctatcaaagctcttgagtctcgcatcgaagcagtacaggcagagcaagttaaagttgaagaacatcgtagttctcaaatgattgactgtcataaccgctactatgcatctcgtgatgaactaaatgcacgtcaagtcaaagaggtagaagatatgctggcacgtcaccagcaagagcgtgacagcctgaaagctgaatttgaagagaacaaggcatcaattgctcttgtacatcaagctgcatctgacagtctgaagaaagagattgttatgctggaaatagaactggataacctgaccaaataaggggttatgatggaagaagtaattcaagctaaacatgtaggtattatctttcgtgatctagagcagcgtaaagttgcaggtcatactcgtctggctaaagaggaagacaccgcaatcactactgtagaacaagcagatgcctatcgtggaccagagttcactcaaggtgaaacttgtcaccaattgagcctatcactttgtgacactatggctattgtaaatgtgcaagaagtcgaagagggtgagtgtgtcagttacatctaccctttagatactattgcacgcattaaggtaagccataagtaattactagacactatagaacaataggtcggcttagttcggcctatgattgtaaagtgttgttgatgttgaaccattgtgcatcttgcacaaccagataccgtatcgggctttctagtgagtacatgcttgtgctcagtacaaagctaactgacaataggagactaaataaatggcacgtggtgattttgattttggtgctcagattactaaatctgaaggtaaagtctttaagaatccagaagtaggtgatcatgaagcagtaatctctggcatcattcatgttggttccttccaagacatctttaagaaaggcaataccactgaagttaagaagccagcaaactttgttctggttaagattgtcctgatgggcgacgatgataagaacgaagatgattctcgcatggaacaatggatgtctgtgcctctgaagtctggtgataaggcaacactgactaagttcctgaatgcagttgaccctaaagagttgctgggtggcttcgatgatttcattggtgaatgcctgactgcaacgatggttggttctggtgacaagaatgacgatggctcattcaagtatgttaactggaagggatttggtggtatgccggacaagctgaagaaactggtcattgctcaggttgaagaggaaggtctgtctatgacaggtcacattacctttgacaagctgacaaaagaaatccttgatgacatcccagctaacttggtgcgtcaatacttcctgaacgagacacctcgtggtaagaacctgtctgttgctggttctcatgtagaagcaataattaaagctgctcgtgaagaagacccagagtggaagaaggctaagaagaaagatgacgaggatgctactccagctaatcgtaaatctttggatactggagagtctgttccacaggaagtacctgaagcagaagatactcctgcaccggagatggatgaggacgcggaatattaaggagaaaggatgaaagtacaaatcgtaaccctgcactgcaagaaaggtatcacaacgctcggaggtggcactttccactctttctccgaaggggagatttatgctgacctgcactacatctggcgcgacggacagcacgtggtgaactacagcgacccagctacggggaaacgccacggcgtatcgcttccggcgcatgacattgctcaggtgaacacagttttataaagtctcacgtgtgagacaaatcggtgtccggtatttactggacactatagaagagaagaattttaatcggcgataatgccataaccaacaaaaggagaatttaatatgttcaagattgaaactatcgtaaaccgtgttgttaaaggtgctgctctggtatccgttgagtctttcattatcgtcgatgaagctgatcaactggtagctggtactaaggcttacgatacccgtgaagaagctcaggctaagattgacagcatgggtaacttcgctgctggtctggagttcgctcgtgcttgcttccctgagcaggctgacaaagctcagattggtaaggctaatatcgtagctgaatatctggattggattgctgctggtaaaccagtgaaagaagttaaagctgctgaagaagctgaagctccggcagtagaagtgtctgcaccggaagctccggttagcgaagaggaagagttttgataatagcaggtgtagcctctgttagtcctagttgactatcacgctcacctcatctaatgccctgtctgccttagtgtaggcagggtcttttgcgtaatagttattggagaatgaattatgccgactattgaatctcgaattgaactggacattagctacaatgcaatcaccagacagtatattggggttgcctatgattacaaaactggtgagaagctagtggaggtgagacaatgggacgactattggttaagacagaacctccatgatgcggtgtcctcctttctgaaggagtggcctacatgcgaccaaacttcgacttcggagctacagtatcggaagacaataacctgttgctgtggccaactgaaggtaatcgaatcgctttaatagatgctgatatgttaccttacatcatagggtatacaatcagtgatatgacttatgtacgagccacaactcgtgttaagtcagggcaagtcccctcaatcaaagatacacctgagtgtaagcaagcgtgtgaccgtgtaaattccttgcttaactcttgggtgtacgcagcagaatgtgatgcagctaagttattcatgacgaaatcagaagctaacttccgtgtccgcctagcattcaccaagccttataaaggtcaacgtaagaccgagaagcctccattcttctatgaattgcgagagcatctcttagaggttcacggtgcaatcttggcagatggagaggaagcagacgacctcatgagtatcgcacaatgggacagccaccgccgcttccagcaagatacaggtaacgagttccctatcggtagtccagagcataaagcattctctgatacttgcatcgtttccttggataaggatttgatgattgttcccggttggcatctacagccgggtcaagagaagaagtgggtagagcctatgggctggcttgagctacgccgtaaggctaatgggcaagtcaaagatctaaaaggtgctggcctcatgttccactatgcacagatgattatcggtgatgatattgataactatgctggcataccaggtcgtggtgctaaatatgcctatgatcttctcaaagattgtaagacagagaaagagttgtacatggaagtgctgggtgcttacaaggctaagttcgggcatggacaagttaaaattaagaattaccgaggtggttatcgtatcggcaaagcctttgatctaatgcttgagtgtggtcgcttagctcacatggcaagattcaagggtgatatatggcgagccgataagagcccaatcttgtggggagatgatgcggaatggttagcaaattaaaatcatcggaggtggcagcttataagaaggaattgctagataagcaaggatggaaatgccctctgtgtggcggcagtctcaaagctgtaacacctgtaaaccgtgtacttgaccatgaccatgagacaggattctgccgcgctgttgtatgccgaggctgcaatggtgcggaagggaagattaagggtgttatctctggttatggcaaggcaggtaataaccgttacttccagcttcaatggttagagagattgtatgaatactggaagttacatagtacgcctcagacagataagttatatcacaaacatcaaacggaggcagagaagcgcgaggctaagaaccgtaaggcacgccttgcttatgcaagaaagaaggaggttaaagttgggtaagctgcgcagcttgtacaaagactccgaggtacttgatgcaatcgagcaagctaccgacgagaaaggtaatgttaattacaatgagatggctaaggtgctctccagccaccctgtgggtaagaagattacccgccagttggctcgatactggcatggtcaattcaagaaaaccaagaagaatggtgattattaccagactcttctgcaagaggataagcgtatcaaagaagagcgtaagctcaggacccctgaccgctatgaggatttggctattgtacccctgcctgactcgcctcatcgaagtgtactggtaatccctgacactcatgcaccttacgagcacccagataccttagagtttctggcagcggtggcagcacgttaccgtccagacactgtagttcatctgggtgatgaggcagataaacatgccttatcgttccacgattcagaccctaatctggatagtgctggcatggagttagagaaggcccgtgtctttatgcataaattacacaagatgtttcctgtgatgcgcctgtgtcattctaatcacggctctatgcacttccgcaaggcaagcgctaagggtatccctgtgcaatacttgcgtacctatcgagaagtcttcttcccgcatgggggtggcgaccagtgggattggcagcatacacacgttcttgagttgccgaatggtgaacaggttgcatttaagcatcaaccagcaggctcagtcttagcagatgcagcgcatgagcgcatgaacttagtgtgcggtcacttgcatggtaagatgtcggtggagtatgcacgtaacacacatgagcagtattgggctgtgcagggtggctgtctgattgatgagtcatctcgtgcatttgcctatggtcgtgagtccaaatacaagccagcattaggttgtgtggttattctggagggtgtgccgcacattgtcccgatgcagaccaatagtgacaatcgctggattggtaagatttagttgacactatagaacaaagggtagatattagcttacccttgattgtatagtgaatggaggaattagtatgtcacactatgaatgtaagaagtgtcataatcgctatgataattgcacctgtcattataataaatataaaaggattaaatcaggtgattatgttatacgccgtgcaggctgccgcgacctagaggggaatagagtgtgtaaactattaggcaagaaatccgatgcaacattcaaagttataaaggatgatcctgttggcagcgccattaaacttgaaggcattgaaaagcgtgaatggtattcaccttactttgagaaagtggaaaccccaccagttgtatctgagtcaaacctgttggacaacaatatggttactaagcctaagcactacgagttcttcgatggggtagaggcaatcactatcattgctcgtagtatgaccgagaagcaattcgctggctattgcatgggtaatgctttgaaatatcgtctgcgcgcaggtaagaagttcaacactgaagaagacctgaagaaagcagactactacaaagagctattccagaagcatcgtcacgaatgtattgatgaggatatttaatatggaaggtaaactatatagagggtacttcggtaacttatatagagtaagccctctcggttttgtattgacctccaatgatgaaggtgcaatgtggttactaagtgcctatggttctgacttagcatactttaaagaggcgatagttaaaggtgtgatgaaggaggtgaaatgaatatcttccaattcctaggtcttccagaagaccaccgcaaccacccattcatgctggtgaaacatcgcggtgaagtacctgagaagaaattaacttttccatgttatgcacaggtaaaacgagatggtatatttagtgctgtggttgttcgcaacgatggtgtcgttggtgtctttggacgcactggaaagaaactggctaacacggaaaccttggaagaatcttattcagctttccctactggcatttatctcggtgagttgcaatctatggctgttgatgtctaccttgaagcactttctggagtagttaaccctaatcgcacagagccacttgacttcataggccagcagattaaagacaacctgtatattgacttcttcgatatgttaactattaaggcattccatgatggattcactgatgtttcttatctcaaacgttacgatgctttacatcgtcgcatcggcgctcatcttagcgggtacaacgctatccttcctattactccttgccataatgagcgagaagttgaagcgtttgcgcaagagcaaatagacgcaggccgagagggtgctgtgtttaaactggactgtgattatgaagcaggccacaaaggttatcgtcagactaaagaagtccgtaaggtaacttatgaccttacttgtattggctttgaagaaggcaaaggtaagtacaaaggtaaggtagctaacctcattttcaaatggaaaggaggcaagacaatcaaagctatgttaggtaaagggtggactcatgcagatgcagaacagatgttccacgatattaaacatggtggacgattgaatgtcattggtaaaatctttgaagtaaaaggtcttcaggattcaagcaagggcaacattcgtctgcccaaagcaggagaattaagacatgacaaagatgaaccagatttcttttgattccatgaaggccactcgtgccgttgaggtagcagaagctatctttgaaactttatcctgtggcatggaagtgccgtatactttactggctgatgcagaagagcttggtctttctgtagaagctatccaagagaaggttgaagaactctatggtacagacgaagaagaaaccgacgatttcatttgagggtatggagatgcttgagatgattctcaagccttcttctccgaaggtgactaagactcacgaagaattaatcgtagatgaagtgaagcgttacataatggattgtgttagagcacaactggtggtccaatgatacgtccagcttcattcctagatattcctgagattataaaccttgggaataaatatgtggaagaggaagtcaaggttgtagcccaccactcagcctcatggaatgcagaacaaagcgcacataacctttgtgcatctcttagtagagaagatttattcctatgggtggctgtagatgaagggcagattgtaggttttctgtgggctggctatcacgagttagccccttggacacctgtaagagttgcatctgacattctcttttatattgtaccagagaggcgagggacactgctcggtatgcgcctcatcaaagccttgaagcaatgggctaacgatagtgggtgttccgaggttcgcctgtctatcgcttctggtattaatgaagaacgtgtcggacgtatgtataagcgacttggctttgaacagtttggcactgtgtataacctgaagttctaaggagatcacatgggtattgtaaagaaagcatttaaggctgtcggtcttgctcaagatgcaccgcgtattgaagccaaggttcctgctcagcagcttgagcgtaagcctgagactgaagctgaagatatacagattggtgcaggtggtgatgatgcgactgcatctgcaaaaggtaagcgcgggcttgtccgtccggtagcttctagcttgaaggtgtaatatgaaacagagcacagatttggagtatggaggtaagctgtctaagatacctaagctatgggagaagttctccactaaacgtagctctttccttgatagggcgaagcattactccaaattaaccttgccctatctgatgaatgacaaatgggataacgagacttcgcagaatggatggcaaggtgtaggtgctcaggcaactaaccacctagccaacaagctagcgcaagtgctattccctgcacagcgctccttcttccgtgtagacctaactgcacaaggtgagaagattcttaatcagcgtggccttaagaagacagagctagctactatctttgctcaagtggaaacacgggcaatgaaagagttagagcaacgtcaattccggcctgctgtagtagaagcattcaagcatcttattgttgctggaagctgtatgctatacaagccgagcaaaggtgcaatcagtgcaataccaatgcatcactacgtagttaaccgtgataccaatggcgacctgttagacattatcttgctacaagagaaatccttacgtacctttgacccagctacacgtgctgtagtagaggttggcttgaaaggcaagaagtgcaaggaggatgacagcattaagctgtatacacatgctaagtatcttggtgatggattttgggaacttaagcaatctgctgatgacattcctgttggtaaagtgagtaaaatcaaatcagaaaagttaccattcatcccactgacttggaagcgaagttatggcgaagattggggtcgtcctttagcagaggattactccggtgatttattcgttatccaattcctgtcggaagcagttgcccgtggtgctgcactgatggcagacattaagtacctgattcgtccgggggcacagactgatgttgaccattttgttaactctggcactggtgaggttgtaactggtgtagaagaagacatccatattgtacagttaggtaagtacgcagacctcacacctattagcgcggttctagaggtgtacactcgccgtatcggtgtcgtattcatgatggagacaatgacacgccgtgacgccgaacgtgttactgctgtagaaatccagcgagatgcgttagagattgagcagaacatgggtggtgtatattccctctttgctactactatgcaatcgccagtagcgatgtggggtctgctggaggcaggagaatccttcactagtgacctagtggaccctgtgattatcacaggtattgaagctttaggacgcatggctgagttggataaactggcaaactttgctcagtacatgtcactgccattacaatggcctgagcctgtactagctgctgtgaaatggcctgactatatggattgggtacgaggtcaaatctctgctgaactgccgttccttaaatcggctgaagagatggaacaagaacaggaagcacagatgcaagcacagcaagcacagatgcttgaagaaggtgtggctaaggccgtgccgggtgtaattcaacaagaacttaaggaggcgtaatgtctttctcatttactgaaccgtcaaccactcatcctactgctgaagaaaatccggtagaaaccaaggaggtaacaactgatgctgctactactgatgttcctgctgacgctggcactgatgtacaagatgacaatgctggtgcacaacctgctgaagacgccggaggagaagctcctggacaaccttcagaagaaggagacaatggcggagagaatggtgaacctaagccagatgataccgcgaccgacactgaggaagtgcaatacttcttcggagaacatgaagtaacagtagacatcccacaggatgtaactgacagccttaaagagaaaggcattgatgctaagcaggttgccaaggaactctattccaaagatggcaagtttgaactgtcagatgtaaccaagcagaagctgtatgatgcctttggtaagtttgcagtagacgcatacctgtctggccttaaggcgcagaatgaggctttcttcttgaaggaagctagcgcagctaaagaactggaagcagctaacactcagcgcttctctgatgtttccaaggaagttggtggtgaagaagggtggtcccgtcttgaggcgtgggtacttgaagcgctatctgatgacgaactaatggcattcaatgcggtgatggaatctggcaaccagtaccttcagcaatacgctgtgcgtgaactggagagccgccgtaaggctgcacaaggtgatgacaagccaagcctgattgaaccatctgcacctgttgccgcatcagaagacaacggcccactctcgcgtgagcagtacctgcgtgagatgatgacccttagctctcgcttcggcacagacaagaaagctgctgctgagtatcaggctagactggatgctcgccgccgcgctggtatggctcgcggactttaatcagtatttactggacactatagaagggagaaatgtctccctaaattatcaatttgatttataaggaggtttattaatgtctacaccgaatactctgaccaacgttgcagtctccgcttccggtgaggtagacagcctgctcattgagaaattcaatggtaaggtaaatgagcagtacctgaaaggtgagaacatcatgagctactttgatgttcagactgtaactggtactaacactgtaagcaacaagtacttgggtgcaaccgagttgcaagttcttgctccgggtcagtctccggctgcaacctccactcaggctgataaaaaccaactggtaattgatgccactgttatagctcgtaacaccgttgcacacctgcatgatgtacagggggatattgacagcctgaaacctaagctggctaccaaccaagctaagcagcttaagaagatggaagacgagatgcttattcagcagatgctgctgggaggcctgagcaacacctcgcagaaacgtggcaagcctcgtgttaaaggtcacggcttctccgtaaacgtagagattaacgaaggtgaagcactgtctaacccacagtatgtgatggcggctgttgaaatggcacttgaaaatcaggtagaacaggaggttgatatttccgatattgcaatcctgatgccgtggaaatacttcaactgcctgcgtgatgcagaccgcattgttgataagtcctacacaatcagcgaatccggtgcaaccattcagggcttcgttctgaaatccttcaactgccctgtgattccgtctaaccgcttcccgaaatactctgctggtgcagcgcatcacctgctgtccaatgaagacaatggctaccgctacgacccgaccgcagagatgaacggtgctgttgctgttctgttcactgctgatgcactgttggttggtcgttccattgacgtgactggtgacatcttctacgagaagaaagagaagacttactacattgatacctttatgtctgagggtgcaatcccagaccgttgggaggctgtttccgtagttactactgaccgtgaatccaacggtactccggtgtcaactgcgaccagtgcggcagaccatgctcaggttcttggtcgtgctcgccgtaaggctatctacaccaaacagtaccttgaaggtgcagcaggtgttggtgctgctgaaatgagcgctcgttctgctggcgtatccgccgaagatttggttgctgctgttcgtgcagtgatggctaatgacattaagccgactgcaatgaaacctgctgagtaatacctatgccctatctaccttgcgtaggtagggttcttttgttaggaggattcatgcctgtaattagacaaaccagtaaagtaggacatatgatggaagatgtggccttccagattattgatagtaagctggaagcggtaaacttgtgtatgcgagctattggtcgtgagggtgtggattctctcgactcaggtgacttggacgcagaagatgcaagcaagatgatcgacatcgtatcccagcgattccagtacaacaaaggaggtggctggtggttcaatcgtgaaccaaactggcagattgcacctgataccaatggtgaagtcaatctccctaacaactgcctagcagtattgcagtgttatgctttgggtgagaagaaagtacccatgactatgcgagcaggtaagctctactctacatggagtcatacctttgatatgcgtaagcatgtgaatgctaatggtatgattcgtcttaccttacttaccttacttccatatgagcatctacctactagtgtaatgcaggctattgcctatcaagctgctgtagagtttattgtgtctaaggatgcagatcagactaagctagccactgcacagcagattgccactcagcttctaatggatgtgcaatcagaacaaatgtcacaaaagcgattgaatatgcttgtgcataatcctacgcagcgtcagttcggtattatggcaggtggttctcagaatgtacctgcttactctcattcaccatatgacagttgggcacttcgtccgtgggaggatcgttaatggaagtacaaggttcattagggaggcaaatccaagggattagccagcaacccccagcggtacgtcttgatggtcaatgtacgactatggtgaacatggtccctgatgtagtgaatgggactcaatcccgcatgggtacaactcacattgctaagctcttggatgaaggtacagataatatggcaacgcaccattatcgcaggggtgagggggatgaagagtatttcttcaccttaaagaaggggcaagtgccagagatatttgataagcatgggcgtaagtgcaatgtcatctctcaagatgcacctatgacctacctttctgaggttgttaaccctaggggagatgtgcaattcatgactatagctgatgttacttttatgcttaaccgtaggaaagtggttaaagttagtaataggaagtcacctaaagttggagataaagccattgtgttttgtgcatatggtcaatacggtacatcttattctatcataattaatggaaccacagctgctagttttaaaacaccagatgggggaagtgcagaacatgttgaacaaatacgaacggaacgtatcacttctgaattgtactccaagttgcagcaatggagtggtgtgaatgactatgaaatacaaagagatggtacgagcatatttatagagagacgcgatggtaaaagtttcacagtaacaactaccgatggtgcaaaaggtaaggacttagtggctatcaagaataaagttagctctactgatctactcccttctcgtgcgcctgctggttataaagtacaagtgtggcctactggcagcaaacctgagtctcgttactggctgcaagctgagcctaaagagggaaaccttgtgtcttggaaagaaacaatagctgctgatgtattacttgggtttgataaaggcacaatgccttacattattgaacgtacaggtatcatcgacggcatagctcaattcaagataagacaaggtgattgggaagatcgtaaagtaggggatgacttgactaaccctatgccctcttttattgatgaggaagtaccccagacaataggtggaatgttcatggtgcagaaccgcctatgctttacagcaggtgaagcggttattgcttctcgtacatcatacttcttcgatttctttcgttatacggttatctctgcattggcaactgacccatttgatattttctcagatgctagtgaagtctaccagctaaaacatgcagtgaccttagatggcgctaccgtgttgttctctgataagtcacaattcatactgccaggcgataagcctttagagaagtcaaatgcattgcttaagcctgttacaacatttgaagtgaacaataaagtgaagccagtagtaactggtgaatcggtaatgtttgccactaatgatggttcttactctggtgtacgagagttctatacagactcttatagtgacactaagaaggcacaagcaatcacaagtcatgtgaataaactcatcgaaggtaacattatcaacatggcagcaagcaccaatgtcaacaggttacttgtcactaccgataagtatcgtaacataatctactgctacgattggttatggcaaggaacagaccgtgtacaatcagcatggcatgtatggaagtggcctataggtacaaaggtgcgaggtatgttttattctggtgaattactttacctgctccttgagcgaggagatggcgtatatctagagaagatggacatgggtgatgcactaacctacggtttgaatgaccgcatcagaatggataggcaagcagagttagtcttccagcattttaaagcagaagatgaatgggtgtctgaaccgcttccttggactcctactaacccagagcttttggattgcatcttaatagacggatggggttcatatattggtggttctttcctattcaaatacaaccccggtgataacaccttgtctacaacctttgatatgcatgatgacaaccacgtaaaagcgaaggttattgttggtcagatttaccctcaagagtttgaaccaacacctgtagttatcagagataggcaagaccgtgtatcctatattgatgtacctgttgtgggattagttcaccttaatcttgatatgtatcctgatttctccgtggaggttaagaatgtgaagagtggtaaagtacgcagggtgctagcgtcaaaccgtataggtggtgctctcaacaatacagtaggttatgttgaaccaagagaaggtgtcttcagattcccactgagagctaagagtacggatgctgtttatcgtattattgtagaatcacctcacacattccagctccgcgatattgagtgggaaggaagctacaatccaaccaaaaggagggtctaatggctataggttcagccgttatgtctggtatgtcttctattggtagtatgtttgcaggcagcggtgcagcagccgctgctggaggtgctgccgcaggtggcggaggtttgctaggttcactaggtggattcctaagtggctccactgctggtttctctaatgctggccttcttggtgctggccttcaagggttaggcttgattggtgatctctttggtggaagtgatgaagccaaggcgatgaagaaagcacaagaagagcaatggcggcagcagcttattgctacacaagaggcgtacaagacagtggcagacgcagaacgttctgctgctaaacaatatcatgcagatgcaatcagtaatcaggcttcactgctacatcagcgagcacaggttgcattacttgctggggctactggtactggtggtaattctgtgtcctctatgcttaatgacttagcagcagatggcggcaggaaccagagtactatcattgataactatgagaatcagaagattaatttcaccaaccagcttaggtctatccaacgtggtggtcagatgcagatgcgtgagtttaagaagccttctgctatgaataccttggttaaaggtattacaagtctggcatctgcctatgtaactggtagtaagtctggcaaggcattgggtaaagccttaactgattctcgcacatattcatctggaacaagaggtatttaatggcaattgagcgacaagcagtacaaggtctgccacaagtgcaggccacttctcctaatgtcatgacctttgcacctcaacaagtgggaggtgtgggggctggcgtggcttctacctccggtagtaggtttatcgaagaccttattcgtgcagcaagcagcgtggctgatgttaccactggtatccttaatcagaagattgaggaagataaggttgttcaaatggaacgggcatataacggattaatgccttctgaggatgcaactcgtggtggcgctcgtgctaacatgcttgtcaaagctcaactgctagctaatgatgaagcagcacgaatgaaagacatggctactcgtttccaagggacggatgacgagtggacacaacttatggttgactctcgtaatgagatgcagaataagctgttccagcaataccctgagttgcaaggtgacaaagatactatgcgtatggtcactaatgtcttccaagaacagcagcctcagatttgggctacacggacccagcataaacttgaccgtgaacaagcagaccgggagtatacctttgacgggcgagtggcttctacttgggattctaatattgaccctgaagcctctggctatgctttacaggaacgaatccgcgaaggtctgactcaaggattactacctgaacagatgcacaagaagctagtccagcgggcaatttcacttgcacaaggtggggatgttagcatggctgaagccctgaagtatgtgaaggacgataagggcgtttctgtttatgctaagaatccacagcttatcacagccatcactagtggtaatgcagtttgggctaggaataatgtagctgatgtaactcgtatgtctttcgaagttaaagaatcataccttgcaggcgatttaactgatgaagaattattggaacgagcacagcacattaataatctgacaggtaactctgccttctctaattcagagctagaggcactgatgcgcaaacgggctaagcagaatgcagagctaggtgcaatgcaggatatgcgacgtgagctttactccgaccgcctgactggcttccaaggtaagactgataaagagaagaaggcttacattgatgttatcaaacaggatagccaactttatgcagaccagcaaatcaaacaacgtggcttggacccttacagtcaagaggctgaagctattcgtggtgcagtggaagtgcagcgcctgcaattcatgaactccaaaggcttagtggatgatacctttgagtctcgtatcaaagccatggaatctatgctatcccctgagcactttgccaagggcgaaccacaggagttgatgactattcgtcagttgtgggaacagttgccagaagagagccgaggtgtctttggtgacacggtgaatggctacatggataactacaacactgcactacaaatgggagagacacctttgcaggctgcaaggtttgcgcgtgaagcacagcagaaattctctcgtactgagaaggaaaccaagaagttcaactcagctattggagatgcactggatgaggtatctggtgctggctggtttgatggtaaaaccgaagtgtcagacttaggtaaagctattgcggaagaagagttacgagctaaggccaatatgttgtggtccagtggtatgcgtaacatggattctatcaagaaggctttaattacttggggcaataaacgctacactcaatcagaggatgcaaagacttccggtggctatttcattaaaggtgattacacttctgcatctgatatgcttatgtcagttgggaaaggtgtaaaccctaccgatgtccctctggcgcttggtaggtatgtagaaacacagatgccagaattgaagaaggagcttcaagagtgggaaactaaggatgatgtgtacattgattacaatgaacagaaaggaacttttgtgattcgtgctggtgcagcaggtcgccctctttctggagtaatccctgtaacttctttggataccacttcattactggattctgcctatcagaagaaagtagaagaacgagacaaaggcgagcatgttcacccgtatcgtacagatattggtgcacaagagcctatgccagctaaaccaactgccaaagatattggtaaatttggactagctaacttcctcatgtcttctgcttttgcttctggtgagaatctgccttctaacttcgagattaactatcgaggtaatatgcaacaattctatgacaagctagctatggatgagaataaagataaagttggctttaataaggcaactggaacctttactccatataaagacgctcacggtgagtctatcggttacggtcatttcttaacggaagaagagaagcgaaacgggtatattaagattggcgatgaactagttccctatcgagggtctatgtctcagcttacagagagtaaggctcgcgttcttatggagcaagatgctaagaagcatgtgccttctactcgtgactggaagattccgtttgaccagatgcatcctgcacagcaacgtggcttgatggatttaacctacaatttaggtaaaggtggaatccagaactcaccgcgtgctcttgctgcattcaaagctggtaaacttacggaaggctttatcgaaatgctgggtactgcatctagtgaaggtaaacgtgtttctggcttactgaagcgacgtgctgaggcttacaatatggcatctgctggtggtgtgcctaagattaccgaagtggagactcgtgaagatggctccatgtgggttaggtttggtgggcctatgccagcaggttctgtctcggcatggactcataaacgtattggcgcggatggttggtatcaggtttatgaggctgcacctaccaagttagctaaagattctaaggtaggtaaagttaaattgtagtacctaactcaaggcttgtctcacacgtgagacaggtctttatgataggcactatggaggaactatggaacaagatattaagactaattgggctggatatgtccagtctactcctgagccgttttctattgaggcggctccggtatcggctcctacgatacgccagcgtaatgagttacaagagcaagttcttgaggccaaagctgatgcggacatcttaggtgctgtaggtgctgccttccagaatgaatggttggcattcggaggtaagcgatggtatgaccgtgccactgctgatttcacacctcaaccagactttgagatacaacctgagcaacgtgaagcactacgtttcaaatatggtacggatatgatgcagacaatcactgagggtgttcgttctgaggatgaattgaacttccgtattcagaatgctgatgaagaccttgagcgcaataagcgcattgctcaggctggctgggttggctctgtggcgacgattggcgctgctgtgcttgaccctgtgggatgggttgcctctattccaaccggtggtgccgctaaagttggactcgtaggccgtgctgtgcgtggcgctatcgccgctggcgtgagtaatgccgctattgaatccgtattggtccaaggtgacatgactcgtgatttagatgacattatggtagcactaggttccggtatggctatgggtggcgttattggcgctgtagcgcgtggtagggccactaagctcagtgagcaaggggatgacagggctgcgagcgttgtgcgcagtgcagacgcaggggaccgctatgttcgtgctgttgccgatgacagtatcggtgcgatgcgtgttaagggcgcagaggttctcactgagggtgcattcgatatctccagtaagggtgaagacctactgaaaaccttgcaacgagaaggtaatgcgattgatatgacacctcgccgttgggctgggactatgtctgccctcggtactgtcgtgcattcctctcatgacgcaagtgtacgtggcctaggtgctcgcctgtttgagtctccgcaaggcttaggtatgcagaaggcatctgctagtctcatgcagaatactaatttgaaccgtctgaaatctgctgatatgaaccgcttcaatgatgggtttgatttgtggcttaaagagaataatatcaatccagtagcagggcataccaactctcattatgtacagcaatacaatgaaaaggtgtgggaggcagtgcgtattggcatggatgagtctacacctaaatctatccgcatggctgctgagggacaacagactatgtacagagaggcgctggctttacgtcaacgttctggtgaagcgggatttgaaaaggtaaaagccgacaacaaatatatgcctgatatctttgatagtatgaaagccagacgtcaattcgatatgcacgataaagaagacatcatcgaacttttctctcgtgcctaccagaatggcgctcgtaagattccaaaggaagcagcagatgagattgcacgagcacaggtaaatcgcgttgctgatgctaccttaactggaaagcttagttttgaaaaggcaatgtcaggtcagactaaggtagagtatgaagctatcatgcgtaaggcaggcttcagtgatgaagaaattgaaaagatggtagaagctctggataacaaagaaaccagagataacatctctaaccgagctaaaatgagtttaggattagatgttactcaagaatacaatggcattcgtatgcgtgacttcatgaatactaacgtggaagagctaacagataactatatgaaggaagcagcaggtggcgctgcattggctcgccaaggcttctctacctatcaggctgcacttaatgcaattgaccttgtagagcgaaatgcacgaaacgcggctaaggatagcaaggctagtttggcattagatgaagagattcgtcagatgcgagaaggtcttcgcctgattatgggcaagtcgattgatgcagacccacaagctatatctactaagatgatgcgtcgtggtcgtgatatcacaggtgtgcttcgcttaggtcaaatgggcttcgcacagctaggtgaacttgccaactttatgggtgagtttggtattgctgcaactactatggctttaggtaagcaattccgcttcacctctaaggcgttgcgtaatggcgatggcttcttccgagataagaacttagctgaggttgagagaatggtgggatacattggtgaggataactggttaacaactaagggtgcacgtcctgatgaatttggtgatgtaaccacagtaagagggatgatggctcactttgaccaatccatgaactcaatacgtcgtgctcaaaccaacctatcactcttccgcatggcacagggttctctggagcgaatgaccaataggcaaatagctttgtctttcattgaccaccttgaaggcaagaagattattcctcagaagaaactggatgaacttggttttactcaggagttcatgactaatctacagaagcactatgatgctaactctaaaggttctggcttgcttggctttgatacaatgccttatgccatgggtgaaactttagctaatgctattcgtcgtaagtcaggtctaattatccaacgtaacttcattggtgatgaaggtatctggatgaacaaagcactaggtaagacatttgcacagcttaagtcattctctcttgtatctggtgagaagcaatttggtcgagggattcgccacgataaaattggtcttgctaagaagacagcttacggatttgctttgggttcaatagtgtatgcggcaaaagcctatgtgaactctattgggcgagaagaccaagatgaatatttggaagagaagttatcgcctaaagggttggcctttggtgcaatgggtatgatgagtacaactgctgtatttagtctaggtggagatttcttaggtggcctaggtgttctaccttctgagttagtacaatcccgttatgaggctggctttcagactaagggtttgatagaccaaataccactagtaggtgttggtcaagatgcatatcgtttagcagattctataactaaatatgcagagggtgatacagaaggtgtagatgtggcacgtagggctttacgcttagtgcctctaactaatgtaataggaatccagaacgcattgcgttatggcttagatgaactggaggattgatgagttatactttcacagaacatacagccaacggtacgcaagtaacctatccctttagctttgctggcagggataagggctatcttcgtgcctcagatgtgatagtggaatctcttcaaggtaacacttggattgaggttacatctggctggcaattaactggtacgcatcaaatcacttttgatgtagcacctgttgcaggtttgaagttccgtattcgaagggaagtacaaaaggaatatccatacgctgagtttgaccgtggtgttaccttggatatgaagtctttaaatggctctttcattcatatactggagattacacaggagttacttgatgggttttatccagaaggatacttcattaagcagaatgtaagctggggcggcaataagattactgacctagctgatggtgagaacccaaaagatgcagtaaataaatcacagctagatgctatcgacaagaagcatactgattggaactctgcacaagatatagagattgctggtattaagagaggaatggtgtctggtgtatcgcatcgtactattccttggtatatggtcgcctccggtggagagcaaatcattcgaccaccttactcatttgatgatgctatggtgtttataaacggcgtattccaacatgaactagcaggtgcagtatcagtggggtatgatgttataaccctatccgagccattacaggctggggatgaagtttatgtgcttatcggtagtcgcttaaccccacctacaagtgcggatactatcctctttacacaagcagtgagtgaaggtacacaatctatcgacattgtaacggctttccaacgtcttgatgtatatttagatggcctgtatcaacctaataatgcttatgaaatcgtagggtctactatcactttcagtgagccattacctgagtgtgtcgtaagtatgaagctacaactagtgtaaggaggtgagatgattaactccgaactggtagatagtggtgtgaagctggcgccacctgcattagtatcaggtgggtacttcctcggtatcagttgggataattgggtgttaatagcaacattcatttataccgtgttgcaaattggagactggttttataccaagattaaactatggaggaggagccgtgagcgtacacaataaacatgcagctacggaagacgaggttggcattctacatggtgctattaccaaaatctttaataagaaagcacaggcaatactggacactatagaagaagacccagatgcagcactgcatttagtctctggtaaagacattggagctatgtgtaagtgggttcttgataatggtattaccgctacacccgctgcacagcagggggagtccaagctatctaagcgcctcaaggctatccgagaggcatcaagtggcaagatcatccaattcactaaggaggattgatggctaaggcaagagaatcacaagcggaggctcttgccagatgggagatgctacaggagttacagcagacttttccgtatacggcggaaggtttgcttctctttgcagatacagttatccataacttgattgcaggcaaccctcatctgattcgtatgcaggccgatattttaaagtttctattctatggacataaatatcgcctcatcgaagcgccccgtggtatcgctaaaactacactatcagcaatctatactgttttccgtatcatccatgaaccccataagcgtatcatggtagtatcccaaaacgccaagcgagcagaggaaatcgcaggttgggtagttaaaatcttccgtggcctagactttcttgagtttatgctaccggacatctacgcaggggaccgtgcctcagttaaggcatttgagattcattacaccctacgtggcagtgacaagtcgccttctgtgtcttgctactcaatcgaagcaggtatgcagggtgcgcgtgcagatatcatcctagcagatgacgttgagtcaatgcagaatgctcgtacagcggcaggacgtgccttgcttgaggaactgaccaaggagtttgaatctattaaccagtttggtgatattatctaccttggtactcctcagaacgtaaactctatctacaataacctacctgctcgtggttactctgttcgtatctggactgcacgttacccctcagtggagcaggagcaatgctatggtgacttccttgcacctatgattgtgcaggatatgaaggacaacccagcacttcgctcagggtatggcttggatggcaatagtggtgccccttgtgcacctgaaatgtatgatgatgatgtgctgattgagaaggaaatctcgcagggtgcggctaagttccagcttcagtttatgcttaacactcgcatgatggatgctgaccgctatccgctacgcctgaacaacatcatcttcacttcattcggtacagaggaagtccctgtgatgcctacatggagcaacgactctattaacatcattggcgatgcaccgaagtatggcaataagcctacagactttatgtatcgccctgtggcccgaccttatgagtggggtgctgttacccgaaagattatgtatattgaccccgcaggtggcggtaagaacggggatgaaacgggtgtggctatcgtcttcctgcacggcacattcatttatgtgtatcagtgctttggtgttccgggaggataccgtgaatcgtccctgaatcgcattgtgcaggccgcaaagcaggcaggtgttaaagaggtattcattgaaaagaactttggtcatggcgcgtttgaggccgttataaagccatactttgaacgagagtggcctgtgactctggaggaagattacgccaccggacagaaagagttgcgtatcattgaaacgctagagccactaatggcggcccacaggctcatcttcaacgcagagatggtcaagtctgattttgagtcggtacaacactatccgcttgaactacgcatgtcatacagtcttttcaatcaaatgtcgaacatcacgattgagaagaacagcctacgacacgatgaccgcttagacgctctgtatggcgctatacggcaattaacttctcagatagactatgacgaagttacccggattaatcgtctcagagcgcaggagatgcgcgattacatccatgctatgaacacacctcacctccgtagggcgatgctctatggggattatggcactgagcgaagagtaaccaacacttccgtggctatgcagcaaagagtatatggtcagaattacaggagtaaatcggcaagcagaaatacactttctgcaaggatttcaaggacttattaattactggacactatagaaggaaggcagaggaaataacagtaagtattaggtagttataggtaaacataggaaaccataggtattacaggtacaccttagtgggagggactcctgtcccgaccttatttccttcctctttcttattatacttcatctaaggaggcttaatgtctaatgctatccatgctaacacttatgacctgatgccgttaacaggaaagatgggtcgtaagcaggagaagccaatcagtctggcactgatggttccggtactgccagaatcggaacacattgaagaacgtgttgacgtcgtgaatgacgcaaccaaatctggcaaacagaaaggtgcgatggtactagatttccaccacaacctgcacatcgctactggtggtaagcctgactccgattggatcaagctgcgccgagacaacatcatcgttccaacataaggaggtaatacatggctaagtatggtgacgcatctactgtaactggtggtgcattccgtgttcgtgcggtacagactgtggcaactgccctgccactgccgatcgtttccgaagttgacatcaagagcaccaaggctcctgtcaacctgacacgcctgtctggtaagcagaagggcgcgatggtctgcgtagacaaaagtggcgatgacctgtacatcgcagtggcaactggtagtgagccagcagacccgtggttttgcactggctaacgagtcgctgaaagtaacacctgtctgatagggaggcaacatgccattaagcgtaactggtcagcgccagaagaataaaattgccactgttgccattgacaccttaccaactgtaacctctgcagaggtattacgatcggattcattgttgaaccgccgcgacctctcaggtaagacagaaggtgcaatggtagtagttttggatgggccgaacaaagggatctatgttgcgcttgatgacaagcgtgacggacattggatgtacgtgcatggtgtgacaaccgaaggtgaagcaagccgtgatacagtacgtgagattgacgatatggtggatgttgagcttgacaccaacttcaacaacaacttcacccttgcagatgcacgtatcgatacgaaggtgattgaaacacctgtgcttcttcttgatggttcatacgcataccgctgccgtatgacctttgacttcaactgcacccgtaaggacgagtccgttggtactgagattaacttcagtatgaatctcgtaggtgagacaggtgactcaggtcagtatctccctgttgaccacgctacgttaactgcatgggttgattctggtgttgtacttggtcatatcgattccaagacagcaaccaccaacaacatccctgtccgtattcatgttaccgaaggggcgggtaagtcgttcaactttagcttctcgctagagtggacttctactgaacagatttcagaggactaatcgtgcttaataaacacttcaagcgacgcgagttcgcttgccgttgtgggtgcggtacatccactgttgatgctgagttattacaggtagtcacagatgtgcgtgagcactttggcgtccctgtagttattacttccggtcatcgctgtgctaagcacaatgccaacgtaggtggggctaagaactctatgcatcttacgggtaaggcagctgacattaaagttactggtgtaggtccaatggaggtccgtgcgtacctctgcaataaataccacgataagtatggcattggtgcttatcccacttttactcatatcgacgttaggagtaataaagccagatggtaagatgtattgaatggtgcgagcgcatggttgctcaagctgccgaggatggcaactatgatgactggaagaactactcggacttattagcccaatggaaagggagatgtaatgaaaaagctgtttaagtctaagaaagtggtaggtgcactggttgcactggtgattgctcttgtttctgtaggtcttggcgtagacctaggtgaaggtacggaagtttccgtcactgacgtggtatgccaagtaatcacctgtgaataaggtgctagaggtggtagcaggtcttattggcctgctgcttgccgctaagaagaagaaggaagagaaggaggtacaaagtgaggcgaatcatgctagcgacaatcctgctgattggttcgctgatcacttcagggtgtcagacggcgttaccagagaatccaaaggtgaagcctctgaagccgacgcttacggcagtctacgaggtggacgataaagtctgcttcagtaagcctgacgctacaaaattaggtctgtacattctctcgctagaacgcgggtataattaatacatagttttatgtatcagtgtcttacggtttactggacactatagaagagataagatagtgccgttcttttgagcggcctattactagccaatcttcatagggagggttgggaagtaataggagggtatatggctaagttaactaaacccaagacaacgggcttactacatagagacactgtactagctaccttattagataatttactatctaaaaggcgtgttacatttgaaggtgtagttccaagtgaagatactaaaattgagatagaagtacctacagcatgggatttagattcttcgtgggcatcacttgtatcattaagtacacctacactttgtacagcttggattactaaagtgtcagatactagattagaagtacatgtgttccatacagcacaagttgaaatagacatagatgtagatgtttacattctaggtaaacacattgtcagtgcgtaagcactgcttttcacgcaacttttcttaaaggttatcatgatggtagcctttcagaaaaggaggttacatgattcaaagactaggttcttcattagttaaattcaagagtaaaatagcaggtgcaatctggcgtaacttggatgacaagctcaccgaggttgtatcgcttaaagactttggagccaaaggtgatggtaagacaaacgaccaagatgcagtaaatgcagctatgacttcaggtaagagaattgacggtgctggtgctacttacaaagtattatccttacctgatatggagcgattctataatacccgcttcgtatgggaacgtttagcaggtcaacctctttactatgtgagtaaaggttttatcaatggtgaactatataaaatcacggataacccttattacaatgcttggcctcaagacaaagcgtttgtatatgagaatgtgatatatgcaccttacatgggtagtgaccgtcatggtgttagtcgtctgcatgtatcatgggttaagtctggtgacgatggtcaaacatggtctactccagagtggttaactgatctgcatccagattaccctacagtgaactatcattgtatgagtatgggtgtatgtcgcaaccgtctgtttgccatgattgaaacacgtactttagccaagaacgcactaaccaattgtgcattgtgggatcgccctatgtctcgtagtctgcatcttactggtggtatcactaaggctgcaaatcagagatatgcaacaatccatgtacctgaccacggactcttcgttggtgattttgttaacttctctaactctgcggtaacaggtgtatccggtgatatgactgttgcaaccgtaatagataaggacaacttcacggttcttacaccaaaccagcagacttcagatttgaataacgctggaaagagttggcacatgggcacttctttccataaatcgccatggcgtaagacagatcttggtctaatccctcgtgtcacagaggtgcatagctttgctgctattgataacaatggctttgttatgggttatcatcaaggagatgtagccccacgagaagttggacttttctacttccctgatgctttcaataatccatctaattatgttcgtcgtcagataccatctgagtatgaaccggatgcggcagagccatgcatcaagtactatgatggtgtattataccttatcactcgtggtacccgtggaggccgactaggaagctctttgcatcgtagtagagatataggtcagacttgggagtcactaagatttccatataatgtgcatcatactactttaccgtttgctaaagtaggagatgaccttattatgtttggttcagaacgtgcagaaaatgaatgggaagcaggtgcaccagatgatcgttacaaggcatcttatcctcgtaccttctatgcacgattaaatgtaaacaattggaatgcagatgatattgaatgggttaacatcacagaccaaatctatcaaggtgacattgtgaactctagtgtaggtgtaggttctgttgtagttaaagacagctacatttactatatctttggtggcgaaaaccatttcaacccaatgacttatggtgacaacaaagataaagacccatttaaaggtcatggacaccctacggatatatactgctataagatgcagattgcaaatgatagtcgtgtgtctcgtaagtttacatatggtgcaactccgggtcaagctatacctactttcatgggtactgatggaatacgaaatatccctgcacctttgtatttctcagataacattgttacagaggatactaaagttggacacttaacacttaaagcaagcacaagtgccaatatacgatctgaagtgcagatggaaggtgagtatggctttattggcaagtctgttccaaaggataacccaactggtcaacgtttgattatttgtggtggtgaagggacttcgtcttcttcaggtgcacagataactttgcacggctctaattctagcaaggctaagcgtatcacttataacggaaatgagcacttattccaaggtgcaccaatcatgcctgctgtagataaccagtttgctgctggcggacccagtaaccgatttactaccatatacctaggtagtgaccctgttaccacttcagatgctgaacacaagtacggtatttctagtattaataccaaggtgttaaaggcttggagtagagttggttttaaacagtatggtttgaatagtgaagcagagaggaatcttgatagcatacacttcggtgtcttggctcaggatattgtagctgcttttgagtctgaagggttggatgccattaagtatggaattgtgtccttcgaagaaggtaggtacggtgtgagatatagtgaagttctaaccctagaggctgcctatactcgccatcgtcttgataaattagaggagatgtatgccactaataaaatcagttaagcaatctgctgtacgccagaacacagaagaactcattcaatcaggacgtgaccctaagcaggcatatgccattgccaaggatgtacaacgtcgtgccttgaagaaaccttctgcatcttctgcgtaagcaggttaatatcttagtgtacacaagggcagacttaggtctgctcttagtgtattccaaaggaggtaacatgatttggattcatacgtatggtgtaggtcaattccagaagaatgtactcaggaagattcatgagtccgaggagtcggccttagccagccagaaggtacttggtgggactatccagtgctacatgaagaagccacaaggttttgacttagtgtaaccaaaggtgttcacaaagtaaccaaagtcaaaattttgatataggcgtgtgtcagctctctcgccctcgccctcgccggattttcccccatatggggccgcgctgcggttggcttgggaattgggctaggctgaccgtcttcaacctgctgccgcaggaagctcgacgggctggctgagggttgccgagggctgcgcttagtggtacacaagtagaatgcctagaaagcgctagggcacgccttagtgttggacaaggtgattgccttagtgcaaccgtttagggcttacacaggccgttttagggccattcctgagcgtttgacagggcatgagggtgtgggcta

SEQ ID NO: 18 - DNA, 150995 bp, Unknown
  Myo, Distinct clade
gggcgcaccaagcgccctttctttttacatgtagaggataaacaaaaatgactttaaacgagcttaaaacagcctataacgcaacattaaaaatagccgtgcgttaccgtgacgaatacggttttattgcgcagggtgtgatcctgggcttttctgacgatggtttgatctatgttgatgcacatcacaacaaggttaaacctgaaaacgtcattagcataaaatatctttaaaaacgcttgacaccataaccaggtaggataagatgtatcacatagggcgggaatagttcccgaccacataaaagagaaaaacattatgaccactatcacaacaaaacaagaaaaaattattacagacattgccgcagtagccgctattgctattatcggtacctactatgacaccgcgcgtccttcctccttgcatgagatcgccgccgttgcatcagttggcgtgctgttttacgttggtaaacgttatttatcaccaatgattaacaagctgacaccgtggaaaaataaaggttgatcctgttttacattgtgttatagttatcgtgtagggcggcaatggtgccgcgcccctttgaggatgcaatcatgagtaaagctaacaccgtgctaatgttttccctgattaatgatcccgcttacttgtccaacatgacgcaggagggtaacacattaacggcaacattcaccaataagcttgaccgagtgatcatcatctcactgaaaacagttagtaaaggcttttactcgttagcttatcattggatcactgataccgacgagacaagccaggactatagcgcccctttccctgaatcaatggcacgggagatcatcgccgccgttgtaaatgatggtttgtttactgcataaataatttagaaaaaggcttgcaatcattttgagatagtgtatatttaattcatagggcggcgggaatagttcccaaagcaaacgagaggattacacgatgagcaagtacacagtagaatacacggtagagaatccggtagtatccgaaggtaaaaagatgacatttgccatcagtataatcgctttcgttgtcactatcttatcaatcatcttataaggtgcacaccatgaaaataacagacattatcaaagagatcgcccttgccgctggcgttgaagtcgaggaagtgatcgcgctcaatcttacagaaaacgatctgcgcaactatgaagcggaaagcgtgaaagcaagcggcgcggtcctggtatatgatccggctaacaagtaaggggataacatgaatccgaaagatatgcaagcatggaaagggtacgacgatctaagcgccttgcgcaataagtcaagccgtaaccttagacggttggaagcaaagaaaaagaaaaaatagtttgacaagtccgcgtagtctgataatatgtatcttgtagcgcggcaatggtgccgctcacaagaagagagaaaaatcatgaaaattacaaaaagcctaactaattatgcagcacgtcgcggattatgcttaaccgttgaaaacttagggaaagaagactttttgtgtttttgggagcttgagaatgattgcgagtggatgttttcttattctatctgcgaagatcaaaacggttgtttgttaacctggcgcggtaatatctatttaccggaagaaattaaagaagagttaccaggtacgatcatgacagagagacagcttaaagaagtgatcaattttgtagggcaaaacattaaaaaataatttgacagtaggcaaacaacgtagtaaagtttattacatagagcggcggaatggtccaccgctcacaacagaagagaaacaaatcatgatcccgactatgttttatgtatcgcgcaaaggtcacaatattttttggtctgaagatttaaatgaagctatgacgtttgcccgtgatcgtgttgctatcggtggcgttaacatcactgtaaccgatgaaaacggcattgaatactataacggcgacgatgaagaataattaatgaggcgggggagtattccccgccgtcaatagggcggggcaataaggcaacgcccactaatgagggtaaaatcatgttagagaaaattttcacggttgtagtagtgggcctggtgttatcggttggagtggttgcaactatggctaacatgatcctatcttcccacggtattggataaggtgaatcaaatgatcacgaataagacaggtaaaacagaatttttacgcggcttgcagatcggcaagcctgagatctggcattgcactaaatccgcgcataatgaaatgaaagattttaccgctactttacaacgtgttaaaatatctataacacagaaaaaagccttgttagtagtagaaaacgagatcccgcaaactattattattgtcgagcgtacagcatgaaaacagaaatcattattgaaatcatcaacggttataaagaagcctttatttttgctgaatcagccagggatcatgaaggtaattttattgataacttagacgattatgatttttctcctagcgcggacgaacggatcgcccaggatgtaacagcctttattaatgctaatcttgccgctatttctgaggcaatgagcgacggcgcaacagccaaccagatcgggaatgatttacattttacccgtaacagtcacggcgtaggcttttgggatcgccctgaaatatacaccactaacacagccaaccgcctaaccaatgcagctaagtttatgccgaacgtgtcggcttacattggtgaagataatttgatttatattgaataaaaagtattgacacagatcgccagtgtgctaatatttaccacgtagggcggcaatggtgccgccgataatgaggaaagtaaaatggaaactatcgctattgttaccgtagaaaaactggttgttggtgatgtattcgcgttaatggtgcctaacagcagcaaactgggcgcttatgaagtgatggatcataaaaatgaatcatttggcgacggttgcacaatggcggtaaaatccttaaaggatggaatcatccgtcaagctaattggcacaaagggaatcaagtcggattaatatcagctaatttcttgccagaagagcaaacgttagaccaactatcaggcggtaagacgttagccgaactactggaaacagcgatctaatcaacaaaggggcggcaacgccccacatcagaaaggaaaagattatgagtattgcaacagtattaaccgccgttaaaaccgctgaatcatccggcttgcatgttgagcttatagatcaaccaggtggcgatctccttgtccaggtttacccgccgaaagtaggagatgattattattggtgctattctgatacgttcgaacaagtagacacgaaagcgatcacggcttttattttaaaagctgttgaagaaaataactttcattataacatcaatcaataaactttaagcaggggcggtaacgccctattaaacgcaataggaagaggatagaaagcatgaaaaagatgatcgcagtagttgccctggttgttggtattaacgcgcctgcaatggctaatgatttgcctgaatccatcacgttaaccgatatcaacgcggtaaaccggatcggtgttaattatcgcctatgccttgccgctaaaactttccaggacggcacgacagaataccacggattcgagggtatccgctgcggtgagcttgcacgcgaccttaaggaagatccagaccttgaggccataccgatgaccgtaaacggtaaagcttacgtaaaccgccaacaatgagaaaggtaatcatgacaatggggatcatagtagcaacgctggcgctgatccccttcctggttgaatatgtgctgattagtgttgtcctggtagtcagtgacttattggaaacggttggcacctggttttaaggaataataaaatgaatacagaacaagttagaaaggtattagcagcgttgcggtatcacaaccatagcaaggtaaagaatgatcctgattatgtggattcaagcctggaagaagacacattgcaagctataagccacatgcaagaattgcttaaacgtatgacagagaagaacagatccgactttataggtgaggaagtataaaacagcttgcacgatgtgccggatagtgtaagatgtatttcgtagggcggcaatggtgccgctcacaactggaaggaaaacaccatgactacagctaaccgcctgatcgccgtcctgaataaagcaaaggctaaccgcctggatgttcaaatcaaagagcaagcaaatggcgagatccttgctacggtgtccgatggcggttatgtatcagaatcatttttatcagggagcttagatcatcttgtttggaaattagaaattatcgtggaggatatgcagatcatctaatctttacaaaaacagggcttgcttttgtcctgttttttgttatgcttattgaacgggcggcacctggcgacaggggaagataatcaccggaagaccccgctatatattgatagctaacacctatcaaacaacaaaacatcaaagagataaactatcaaatctttacaattccacctattgacaccggatcacgcttacattattatttatcacgtagggcgagcaatacagcaagcccacaaagaggaaaagaagatgagcaaatcagcaattaaagcagttgaaaaagcgcaagaagtgatcgcaacgtcaaccactggcgcaaaggttaatctcgttggttatctgacagatgaaactatccgtaaaaattggcgtaatgctgatttactggcttgcttattgattaatagtgtcgctaatgctttccagtgtgaaacagccgagagcatggaggaaaacttgtttgataatatggatcaagccattgaaacctatatacaatcaaacctggatagctggaacagtaaaacatggcccgacaatttacgcgatacaactgatcaactgatccgccttgccctgatggttgaacgcgataacgttcacaaccgcacaaagtaagattatacaaggggcgcactaagcgccctttaacgtaaagaaatgtaaataatgcgctatcccctattgacaggggatcggcgttatattatatttaactcactggcagcaaacaacgaaacgaaacaaaggacaacaccatgaacattaaatcaaataatccagcttactccttcgataacgctttttgtcacggtagcgccgccaaaggcttcgaaatcgatggtaaattggttatcgtgaacgttgacggggaagaggttgcagtatatccggtaaacgatgttaaaagccgtttacaatgccgcatggatgttaccgcatatcagcttgatccggtccgtgtagttgccctggtattagaggaagagatcaaagcaatgcatcatagtaataagtttattggtgacgcgcaggataatatgaacgtttgccgccataaagttaatgaagccttgaaagaatgcggttttaaggatctgatgattaaacgtgatgaaaaattccgctttcgtaatgacctggcaaaccggatctactcaatctatgaagcgttataattgacaacaaaacaaggggcgcaccaagcgccctttctttttgcctgaataatgttgatagattccgcctatggaaaacagacacagaacaaaactgaataaatagcggtatcgagctaatcaaccattaaacgaataaccatacctcccagggtaacaggctgttagagagccatttagagcggttaaaatcgatcaacaaccaacaacaaaccatcaaaaacacccttttacctcctttctagtgcaatgataaccattatcatctatccatgtttatctatgcaatataagtgcataactataatgttgataatagttcgcaacaactaactaaccaacaacctaaaacaataagcaaactaatcataatcaaaggaataatagcaagatgattgataacgacaaacaatcaaaccatgatgaatactaagcaagataacgataacacgacaaaacaaccaactaacgaacaataacaaacgaaaccattaaaataacaactattagcaaaatagtgcctgaatgaaatcattacaaaacgaatcattcacaggatcatcattagcacgctatgccggacacatagcgagctaataataagccaactacaccccaacaatcataaccatcggtgatggttatttcttgttactgcgtagcttgcaataattgcaagcgtaatgacgcttacacttattgcgctggcttattattagcattatatgtaattaccaagatcataacattagcgcaataacaataatcattgtggtaattacaagatgaaatcattagcatggcaataattatgggggcaatgggaggatgattatcatcattccgatacattgcacactatgcacataatagaataaaaggcaatacttttgggggcgaaatgttaccgccacaggcgggaatgttgagcactaagagaagagcaaatatcatgggggcgaatactatcgctacgcgatatgttgagcatcttctcttaaacgtaaataaaatcagaataatcttgatttattttagtttttatgttaataaacgtttaaataataatcattctcatataaataatagtctgcttgtcatgagcgggatcagttgacaatgttccgtcatatgatgaagttgccaaaccattgataaataagtgtttgtgtgatttataatcaagtggcccaccttgtcgctatgttggcataagccttgcataagtcattgaatacgaatgataattattctcattcgcatgatatttgggaattgtcgctgcgtggacctgacggcccgaaaattcgcgttaagcacttcttacgtatgcgccatgatttttgccatatcatattgattctattagatattcttgccatgattgccatgaaacagggtgtcccgaaataatctctccccgtagatattttgggttactttttatacaagagtggggtgtcaaaaataatcggtatatatgggataattgataggaatcccctatgataattcgattgtaattccctaagattgatcgtatgatgttggtgattgatgattgccatgaaagatggctaacgatgagaggagattatcatgcaagagagtaaaaatgttccgttgagtagtttacgtctaatgaagttttacaaagcttggcttgctggtgaggtagaaggtcacacaacgagtggtttgtgcatatgtttgattaagtatgtagagggaacatatcctgatgaactgttacctcgtctacaacaggagatgaaatcacagtttattggtgcaggactggattacaatttcccgtttaatgaaggtggttatgaggaatacaccttcgaacataaaaaacatatttgccataaaaacaaacatcgtatacaatgggtgctagatagaattcaagattacgaaggagagaaaaatgacaaatagtattccgttgagcagtgcaacattgcttcgcttctataaagcatggattgccaactatcctgcaatgaatcgcacaacgagtggcttatgtggttgtctggtagattatgtaaacgattttgttggtgagacaactagagaagaagatagaagatggcgggatagtttgttggaccgtttgaaatatgaaatgaggaaacaatttacatgtgcagggttggactacaatcttccgttcaatgcagattgcatggattacctttcagagtgtataaacttggcgtgtcataccaacacgttacgtcttcaatgggtgaaagacagaattgaagatgcaaataatgcttgcattgaataaagatgtttgtataatggatgacataacagatagccaatgaggagatgaaatgaagaatttgaaaactgtcacaatgttcttgactgatcctacacgtgtgcaagcactggctaaagccagccgtgtagctgtagaattccaaaactgtaagccgtccgttgtgacaggcagtgaaacgtgtgttatcgatttcattaacgaatacttccgagggaatccggttagtcgttacttcattaagggtctgaaggatgcataacatgaaacgcatgaaaattcgtattgagaatgatggtggttataaaggattggcacatgcaaaatttccacttgtgttggaagccatggtggaatacagtgggcttgctcatgtgcgattctcgaagatgatggaagtgcaggaatggttttgggacgagatagatgcacgagaaggggaagattatgttttctttcctcacgaatataacattgtttattaaaggttgtgtgcaatgatcacaccacaacagaatgaagcagcaatggatcttcttgatagtttgtatttcgataattggtactctgaatgtgaatggatgaatatgcaaactctgaaagagaagacaaaagcgttgattacagtagatcaatttcttgcagagacggaaagaatgaattatgatatggcatctcgcgcacgacgcgtttccattttcaataaaatgttagcattatggggaggtagaaaatgagacaattcactatactggcagcttatgtgcaatgtgttcacgattatgttagtgctcatacaggtttgctggaagttaatagtaaaattgaaggcaatatgggtactgtctatgtgcaacatactttatccaatgtgccgtttaaagtgttcactgttgtagctgccgattacaatcgtgtagatgtgcgtttcttggatcataattttcgtaacgcactagataatatcgaagattatcttcccgtgaaacctttgtcatttccaccgagtcgtgcaaataatgtagtgacaaaccttaatgaaaggaatgtggctatgcacaaaaaagtccgtcaactgaaaacgctgatggaaatgcaagaagagattgaaaaagaactaaaagaagattttggtatgcttccaaaagacgctttgaaatggtatgatgaactaggaggagaaagttatgaataaaggaactactgtatatttagtaacaaagaataccccaggctggagccaatgcagcactgtcccttacaagatctgtgcaacattagaactagcacaacgtgcagaagcagaagtggatgccatgcaatacagctatggtgagatcattccttttactcttgaacaagaaggagcatacaatgtttaaagaaggtcatgtctaccgtttccaggatgaggattatatgcgactatattctacctttgataacagtattgctgctatcattggagagaattttttcgaggtgttgagcactgatgcaaatggtaatatcttgtcaattgttgtgatagggagagacggtattatcactgctagtgatggggatcgttacataatcaattctgctcatatagattattttgttgacggtggtattcgcggtggtcgtggaaaaccccaagaagaacctgttgatacaacaaaagaagagtggtatgttgtaatgactgatgacacctgtatttctggatttgaaagttatgaagaagctttgaaagaagcagcagagcataaaatggctaatcctacagaagaggttgaagtttataaacgtttggttgttgctaccatcggcgtatcttttgtttaaaaggggaatgttatgtttaaagttaatgctgtttactgtttcaaaactaaagctgcccgtgaagctttctctatgatctctgatgaaaatttcaaaatggcagctttgattgaagggtcttgtttccgcgtcgaagatattagtgaatcaggctctgtttgctcattgactttattggacagcggggatattattgaagctggacagtatccgttcagaagttgggggatattgttagctcgcggagagcgtaacttttttatgtgcgtgtctgcggaggaagttgtgaaagaaactaaggatgtttctgtttacaattctgaatttataagttatagtgagtatcaacatctggaaggcattgttggtcacttgttatctctgattaacgttgaatgtgacctgcctgaatcattgaaagaagagttgaaagcattagatctgttataatgtttcgcacaacgaaaggagaataagatgaatctgaccgaacagttacgccgtattgcaaaagaagcttccttcaacttccctgttgaagaagtgattgagacatgttttgctgaagcacgagcgggaaactcttcaagaaatttcacgccatctgattttggtctggataattcccctacccacccaggggagatctacaatcaggtgaagtggatggatgaagcagtagcaattcttcgtgagcgtgggcttattgtttataaagaaatggatctgaacggggcatacgagtggatcactgttgattggtccgaggtgaaatgatgaaaggtaacaagatgaaagttaatcaagtgccgagcgcatacactttatggcttgcgcgagcgttacaccagacgatcaaagaccctaagaagccaatgaagagtgggaagaagtttatgtctaagggcaaaacaacctttggcttcactcgtatgtctgtcaagatgaaaaggctggggtacaagccaaactacgctcgttacccttctgaatacaactggtttgactaaaaggagaaagactatggctacttttcaacaactgaaagatgtttcacgtttagtaagaaaaatccgagaagcagacgctgctgtgcggaatgcattaacgccagcagagcgtgaagatcttgaagaggaggtgaaaacagccgagaatgcttttgctgcgtatctttcaacactgtatacaggaggttaaatgtcagaagaacttaaagaattttatcaagcatatcataactggctgttagctggtgctccagataataatcctttctggcatgataaaggattatgtagttgcctctacctttggactggaggttatgatgatctaaattatgaaatgcaaatgcaattccgtgaggcaggattatctgaagaatatccgtttgatgacggagactggtttaaatatgattttgcacaaagaaacgggctattgcatttgaatgctgcccgtataaaatgggtaaaagatcatgctacacaggaggatgtgcaatgccaatagtgtttagtttcttagtaattgttatggttgttcttttcgcggcatggctttgggattttgacccaggagcagcgcagcaaagagctacagactggaaagaacaatgtattgtgctcaaacatgaacgaaatgcggagaaatttcttgacctagagtgtgatcgccttgtaagatacaagcaagataaataaccttgaggtgcaaaatggtaattgagattaaacttgaatatgctggggctgttgccctgatcgcacaaacgttgggagcaaagattgaagaagtgtgtatcaatgcctggagtgtagagattgatgttcctatggacaacattgctaatcgcttgctggtggcagagtgtgaacgcaccaacataatctacaaaggagcataatatgaaaattagagtttgtgatgtattgggttatgttggttttgagaatgttcagattccttttgttgttgaagcacatcttgttagcgatgacatgacaacattctttgttacgatagaagaaatgtccaaagttgagggatgggagtggtttgaagaagatgtttgggaaggttgtgattacgtatttttctctgatgaagtgaatgttctttcggagtaggtatgtcttgttttacaaaagcagtgtccatatgtaagaaacagtatgaaagtgattacggaatatttaatattccagtggatcatacaaagtattgttcatgtggtggcagaatgaagaaaacagtgatttatgcggatagtggagacgaacttgttccggttatggtttgcaaagcttgtcattctgttaaaacattaaaagcgtaaggagtcgggacacccgacgattggagctaaaaattttgcgtacaaccctttccgcccaacaggggcgcgtcgggtaaataaagaggagagtttatatgaaaaagatcatcgtaggtttattgttactcattgcatcactcggaacagcaaatgcgtctcaagtttatgagtgtgtgtcagatgtggttgttaaaaatctgaaaggtgaagtgatttctggtcctaagaaaatggcttctgttgtcattaataaagataactcctttatccttaaaaattcaggtggtgctttgatgagtggcattctgcaatacacaggagaaaaaagtaaagatggtagtgctatgtatggttcacaacagtttattggcactactgaagttgtgatgatgcgcacagagtatcgagacactttagcttggtttgcatttctaaaaaatgataaaacaataacgaatgttcttactctagaagctgattgtacgcaacgataagggggatttatgactaaaatgagacattacgctgtaaactgcaacgatgcttggcgtttgtgtcctgatgatccgacagaaggtacatttgtaagatatgaggattataaagagttatcggatgctgtaatcgcattgttaactgatatccgttcacgttatccaggacaagatttcacttgccctcacatcaaacttcttgcttgcctggtagaaggtgagaaagaagtggaagatggcttcaagcgtgtagagtatcaaggtgaaactttagatgttcctgaatttgttaattatattgcaacagattcaagtggcgagcgttatggttacactcataaaccggagattccagatttcgcttatgcgtggcgtattccttatgaagtttttaatgttgcagattgctggtatttaggagaaggaaacaaccttaattggcgtgattccttggttcaggtttaacaatatgaaagagacattgccagcagcataccgtttgaatgatgaacgtatttgggagtggaccgacgtttcttgtttttaccctgaaatagttcaatattggcgagcaaaagggtgtgttgtagttatcaacccatgtggaccagtggatgaagattgcttgtatctcgatggaaagtggcacagttattgtcgctggccttttgagtggatgtgtaaagaagatctcccagagggttgggagtatccaaaagcaaataggagataatatgtctgaagattttgttgaagtgtttgtcaaagacgaagaaactggtttaggcacaggtttcatttgtgaagaaacctttaaacgtgaacaagaaaaagctattcttatgcgaaactatgatcacgcattagaacaatggaaaaatgcagaacaaaaatgcaaaaacctttatgcagaaaatagaaaactacaagatcaaatggagttgttagctatcagtttacgatctctcattttggctgtagaagatggttttaaaaatccagatggttttcctgtgagcgatattgaacatgatttgtatcttgctcgtggtgcttacttctatgttaaacagaagtctgtagaaggagagaagtgatggaagaaaaactggaacgtattatcgagttagccatgtctattggctacgacgattgttttctccaaactattggagaaacagagaacgattacgactcttgggtgaaagagttggaagaacttaaaacttccttgattgctgactttgctgaagcagaggataaagcagatcgttacaactatctgtgtcgataagccttgacatttattttatgtatggtatacatacattatcaacgtgagcaaggtggtgtaatatgaataaagatcggtttctttctttagtcgcggaagctccttttgatgttcttggggtgagattatggaaagacagaaactatgggttagatgttcaaacatactctctttggttggttggggagcacagcttagatgaaagcttgtgcatgggtagggattctcgttccctctgtttaaagttcagaagcttagaacgcgcaaacaaagagcaagaaaaactaacgaggtggctaaatgaaaacaagcgcaaggttgatggagttttataaaatttatttagcatggattgatgttggtgctcctgatggtaaaccttttcggcgggattgcggtttgtgtgccaacttattcgactatgtgcacgcggatggctacaatccccttataacaaccttgtcagatgaaatgcacgcacagttttaccacaaagggttgagtcaagaattacccttcaatgagaactacgatgcatatgtcttagaatcagatgcagaggtatgtcacctgaatgtggatcgtgtgaactgggtaaaagaacgtgtagcagaagaaataattggttgacagagggatctgtctttgtcataatcatctcatcgaaacagagaggagagaatcatgaaaaagtttatttgcacccgttccactaacagtgatatccttgtaggtaaggttatcaaaggagaactcttccatgcaaacggtaagaaatatattctgctgaaagattctttcaacggggaatatccgcgctgcactttcttcaattacaacactccatttgctttagaaggagatgcttgggactgggctgaactcaatccttgttgtgaggaagaagaatctatgttcttaggtttaaacgtttaccgtgtagattacaccatgtgcggagcggaacattctgttcgcgtagaagccgaatccaagctacaagcacctttcaaggcgggattgactttgggtcattgtttggcaaacattgaagatgttgtgatccaaagagttgttttagagaaagaggctatttgacagaaaacggtgcaatatttaaaatataaagattaaccacaaaaggagagaaaatgcaagttgaagacctgatccagattctgaatagagccaaagagaagggtgctatcaaagactggaaacgtgaaacgagtgaagacctatctcactgttgccgagaattttacatcgaaggtattgctgacgatcattatactatcgaatggtatatcaacttaatgacccttaagcacggttcatttgagatttggtttgatgacattgatgtaaatggttttcatcctggctataaaatcgctatgcagttatcttatcgtagagaagttgtagcacatttgggtttacataactaaggagaaaagaatgcaagcagttgttaacgaagctattatgaacttatccttcttgttagctggtttaggaggtgttctcataggtttggctcttatctggtgtattcgtcgattaatcgggtaccgacaaaaaggtgtttcatgttttgtatcttacaattttacaactgcttacagcaatgaagttggatctggcaatgctcaagcatttttaccaacatatcctcctacggtggaagatattcgaaacttggaagtagaacttatgggactaagtgataactatacatctctagttattcaaaatatttttcgactaaaacaggaggcgtgaatgaaggtacattaccctcatccctttgatcctaaaaacaaagccgtaattcttcgtcagtggcaacgggtttgtcgtactaaatgtccaatcaatagcccacacaatgtagacaaggactatcttggtacatttgttgaatacacttacatagacaaaaacaagcgtaaacaacatgtcgaggaatactgcttaagagtagaatggctgtaaataataaataccttgacaagtgtttattcgttttgtaaagtgggaatacagcaatggtttaggagtggttatgaaaaagtttgttgtttacagtcgtctttctaaacagaaaaaaggtgaggcacaatatggtatggagagccaagagaatgatatccgttacttcttagactctgtgcctgatgcggaagttattggtcaattttctgaatactattcgggtaagggcgattggaagcaacgtaaggaactggttaaagcggttgaaatgtgtaaagctaccggagcaactttattggtagctaaagttgaccgcttgggtcgtaacaacgcctctgtagcaactcttctagagatgatcgatgttaagatagccatcatgccagacgcagataaaatggttatacagcttctgtctgttctggctgaacaagaagttagaggtattgctgatcgtattaaaaagggtcttgctgtagcaaaaagcaaaggtgttttattaggcagtgctaatcctaaaactgccgctgcacgtagaaaagggaaaatggaatacaactctgttaaagcagacgcttttgcagagacattccgtgaacgcttggagatccttagagatttaaatacaccttacaaaactattgctgaaaaattcaatagtaagaaaatagcaacagcacgtggtggtaaatgggatgctaaaactgtttctcgtttgtgtgccagactgaacattaaataggagaggatatgaaacaagaaaatgaatctgtagatcacttaatcatgctgtcagccctttttgccggatgggacgtattttttgaaaatttgttcaattcttctacagatggttccgattttatgcgccagtttaaacgacgaactgttgaggactatgctttctattcaggtcggattgaaaaaggttacgaagatacaaatacaacactcaccattaaagttttagatgtgatgtttagtgttatagatgctatcgacgaaagtcttccgatcctagacaattgtaatacgaaagcctatgtttacaaaatagctcgtgcttatgtgtctgcaaacagttgtcttctttccacccagattgccgtgaacaatcttgccaacttgtttgatgaaggagaaactttttatgacaatcgatttgaagtgtaagaggattcttttagatttctataataattggttagaacacctccgtctctttccaagagaaagtggttacgctgatgttggcttatgccgaggtctgcgtatgtatataagtgatgaatttcgggcagagcattctttagcatattctgtttatggtatgcaattagccagttttgaaaacgctggcttagatacaactttcccatttaacacagcaaaatcttttgatcaagagtgtaaggaaaaactttgcatgtttaatgaaaaacgtgtacagtgggttaaggatcgagttaaacaactggaacaagagttggatttcttctatgatgaggcagaataatggatagacaaaccttaaaaacaatggcagatgccactaattccccgtactttgaaaaagtaagtaaattggtagctcaagccgcagaggaaggatattataacataaacatccataacccaagtcttatactagaaatgccaagtgataagaagatacaagagagtatctgtgaaggtattgttagttactggcgcgagcgtgggtgtggtgcaaacatggctttagacagtgcaaacattgtaagatatataaatatttcttgggggtgattttatgattcaatgcactcatatccaaattacttggagagatgaactttaccatttgggacaatttactgtaggggaaacataccctgtcattaaacataatcctaacatcgcaaactttgataggatggttcttgttgaggacgatctgggtcaaacttattctttagatctaaaatatccgttttcttacggctacgattggatcgttacttttgaagacgtggaggaaaataaaacaatgaacgaaaaaaattcttggtattatcgttgtgaactgccgccagtaggtgaaaaggttatctttgttcctgatttggaaagatattcttgggacagttcttattctattcctaaagaaggcaccgaagttgaagttattgcacatcgcacaacttcgcatggtaacgatgtagcagttgttttctgggatgatgaaggcgctgcttgtgcaggtggctttgttgcaggtaattttgaacccctgccagatcctttgaaggaggcaattttaggcgtagcttcttttggactctcttacacatctgcacaagagatcgtagaaggtattttaaacggtaccgttccaaacgaaatttttaaacagattaaataatagttgcaccccgttctgcggggtgttattgtatatgtaaaggaggcgctaatgtattacactgaagactacatattgtataacttttttaaaggttggttgaaatgggcggaacaagctcctgtcggagattgtgtttttccttgggattctcgtcaaggcttgtgtcgttgtttggaagattggcttataaccacaaactacaattcagaaactaagaaatctacatcaaacagattaaaaatgttgtttgaagaagatggtttagatccaatttatcctttcggtgaggaaagtttccacaatggtcttttccttggcactcaacattatgataaagatcgtgtagattgggtaaaagaaaaggtagcacagtatgaatggggttaagaattatcaccgctggttagaaagctatcttaagaaatgtgaacttggtgttccaggttatacttacgacacggacgagatccttgatgaaatggaagtttggtttaaagagcctcgtgaactattggaaaacattctaatggcttgggatggtacggcacaaagcattgaaggaggtagaaatgagtaagaaattgtttaatattcgtgagaatcgtgatggatcgttctctgtagtcaatgagtttaatgtttcggttgggacttttattactaaacgtcaagcagaacaagtaagagatactttaaacaagtaaatttttaagggggacttatgttaggtaagatcaaagcttttttcaaacgtattgttgaaggaagtccaacagaaggtgcattaggaagatctctaacaggagaaccgcttgccataatttctatcagtcggtatggtggatattcaattaaacaaacacctttaggtatagaaggtagtatgctttcttggacaatatctcaagttggtgataacaggcttgcagctatagcattgcttcgtggggagtatgactattgtttatcagcgccttgtaaaaagcatctcatagagcacattagagacagagtagaaagagaaggcggatacttcttcgaaactaagagaaacgaacaaggaactcttgacttcactaaggtttactgggacaatcatactcgtcaaactgttgaacaacttctggaggaaagatgttaaaagcttttgctgtatactctactgtaggattcttttattggattatagttgttgttggatgttggttgggttcttctgttgtgatgggagaatggttaacatacaatgtatttgaatgggatgtagtttgtagatcattacttgttatatggactgctattgtttgttggataactgttagtctaacattagatctatattgattaatagatggtagatagatgatcatagtttatctaccttcacttacgtttcatacctcactatcgtgagtaacatgaaacattattatatagaaatctactactcgctatcgctcgtaaacatatgtttagggtaccatatttttttgaaaaagtcaatgctgattcacctatcaattatctgtttaagataaatcttacctatcaatctaactcttaactagtattgcacctatagtaagactattcctatagttattaaccctcttcttctgtagaatgtaattagatccttgacaaactcacaaagcttgtgttacattgtgtctcacaagtgaataatactgaacaggaggaagaatgagttccaattttctatacaaagcaaaagattcacgagatggagagaaccattggtggttgatcacagaagatggtgttatcatcctaccgtgggacggagagacgaaagttcaaatactagagaaagtaaaaggtgttagttttaatgttagtcatgatataacaactttcaaagcttttgctatgaatcctagtcttgttgctgaatggtaatccaggagaagatatgactaaaatgtatgcagccgttgataagctggatgggtctgattctgtttttattttgaataaaatgggtgtcttagtttatgcccgaacttctcaaaacatagagcaccaagtggaagcagcgcaaattttagagcaaataacccctccatacctatattcaaatgttgagcgttttaacgatgcacttggtctgacattaatagcggagtggtaataatggcgaaaatgttagcaattgatgatgttgtaacaattactacgtccataccttgtcctcctatgccttgcccctattgtggtggttcagggtatgttatggcggatgtaggtcaaatctacgagtgtaatccgtgcaaaaccacgggttatatccaaatagaatcagaggagaaacactatgagccaaaacgctaaagaaaaagaagtaatcacggtaatccgtcagatggaaggtgccgaaaacaatgcttttgttactaagattcttcttaatatctttgaagatgttattttaaacaatcctggtcataaagattatcagtatgatgttatgatgggtgctttgcttgagattaacaaaaacacttttgctgaatatgagcaacacatgcttttaccagaggaagatcaggattatttgttatctggtgctttaagtgcacaagaaaatttctaccacgttcttaatatggcttatgcagatgaacttgctgtctcccttgaagagcggattcaaatggttcgtgacgtaatgaatgaacaaatccaagaagttgaagatctggtagcagagcctttagcagaaattcgtgcagctattgaaaaacaaaaaggaactcaatcatgatgcaagtaggtgatgtggtttgtcttaaaggtgcaaacaaacaaatgacagtaatagaaagttatggtgaatcttgtaaagtaacttggtttgatgaaaacggcgagttgcaacacgctatattcgatcaaaaagctttgaggaaggttgaagaaaaagaatgagccatccgtcaatatttttctgttttgtagatcttgaaaacgagtctttaatcgttgatagtgagggttacttcacttattgggaatccgagcacgaaactataagtgtagtgaaagaaattatgcaaaccaatccaaacctaccagcacataagtacggtattgcaaaagtgtttgttactaaaacagagtacacaaaagagcgaagcactttgtaccataatattgaagtgattcactatttcaaagatgttatttaggaggttatatggaagagaagatttgggatggtaaagatcctttagaagttggacacgtagcacgtgtcaaaaaatctactacaggtcctggtttttctggtttgtatcatataccagaagaaggtcagcacgttacaattttggctcgtgacaaacaaaacggagcaacgcctgtgtggattgttcgctggtatgacaaagatcttaacatttgcttgtcacctattatggctcatttgctggaagccccttgctctgaagaagctctaatttttgtttcggcttttcagaaagccacaggtttaacattagatgcaaaagatgtgcaaaaagcatttgacattattcaggaagacaacgatactacatctaacgacgaactggttgaagttacaatcttatcttcagcagatatccgagagattgataattgtgattttccaatcacatttaaaatgtcgcagaaagacatgcagtcatctggaagttgttttggtatacctcgttggttttttgattctatcaaaaattctactacagagggatcagactatgatcaagatgacatgctttggttcttaaaaaaccgagagattgttctctcaccacttaaataaggagaaataatggtttcatttatcgtaggtgtagttgtaggctatctgattaacaaatatcaagacgttatcacggcaaaagtaaaagacattttagactcatctaaataatctatcaaagctgcatcttcaataggtgcagccttttaaaaggagatatggcatgactaaacgcactgattttaaatgtatgcattgtgggaaatcttttggggatcatcaagctcgcacattcaactgtccacgtaaaggtcgcggaaattttaaaggttttaatcccgcacatgtttattctccagattacgataagccagaagaagaaaaatttgttatttaataaggaggtcatatggaactcgttcaagaattgtataatgctttaggagcaaaaggaaaagattggcccgaacatgcgcttattgctataagagactccgatggtgagattaagttttcaagcgtaagtaaagagcacatcgtagaaacaaaactgggtatttacatgcgtggaacttattgcttattcaacaccagaatggtagaagctcctgttattgaaaatgggacaaaagattgccccacaatcgtaacaaaagctgaatatgagaagtttttctacgctaaggcttgacacaggaacaatactataggatagtgatcctatcgtagcaatagaacccgcttcggcgggttttttcatatctgtagcaataggaggtcgtgtgttaaataaaatcgaagaaggttgtatggcatttttggtagataacccgtttccctttatggttaaggtccatgtaggagagtatttaggttatgacgaatgggattgtagtatcaatagtgaaatgcaccactaccaaccaacaatacttaagacggatcaaatggcgcgtattacagtagaggatgaattgatcatcgagttatacgagagagcactgcacaagtaagctagaacccacctaaatcgaacagagacgctctaaaatagaaaaggcacccacttgggtgcctttgttttattcttcgttagattgcgtctcagacgcgttaaattcggtttcagtacaacttgctaggtaacttatattttgcatcactacaactacaggtgtttgaagtttatcttctagccccgcagccacttgagccaaggcattatcaatatttgatttcctaacgcctgttccatgtcctgttgccaagtaaagattaccttcccctttttgtgtagcattagcaaagtagtaaacgtaatgtgcaaggtagtaatcacggatttcttcagtcattttattctcctaataagaaaggggccgaagccccttgagtggtttatttgtttaagtggtcttcgaccattttaatgaaaccttcattgctgaaggctgttgcagctttttctcggtaaacaaaaactccacgatcttcatagagaagtgtttcttcgtaattaactccagggttaactacaaccatttttgtcccgatattaagagcaggaaaaagctcccagttaaaattgataacttgattagagcaacccactacaatcaccatatcttgagccgtcaagccgtctaagatgtggtacatatcgttatacaatggggcagtctccccaaagaacactacattgggcttcacatacttgtaatcatccacatcgatagcagcatagccaacatctttgatgattctattgtctacgatcacttcaggcaggaagccgtgaacatgtagaacatcttcatgaacaacacccgcttgttccagaagatcatctacgtttgtcgtgatgttgataacacgatcacagccgtactcttgaaaccattccgcgatctggtaatgcgcagcgttaggagacacactatccatctctacgcgacgtttattgtagaagtcatgagttttacggtagaggttgtatccctctgcatctaatccaccaacagcgccaggaacacactgttcttgctggtagccagcacggaaattgaaaatgtcacacacttcagaaaggtcgtattcatcccacaaagctttaccactttctgtgtcagtgcggaaagtacgaataccgctatcggcgcttaagccagcgccgctaatcactattaatcgtcttggcattcttcctcctcaaatggatcataagaatcgtactcgtaagtatcatcttctgaaaattctacttcgaaataaatatcaaactctgcaaacagacgtaggatgttagacatgctgtaataattatcgtaggcagattcagcttcatagtaaacataaagcaaatggttagccttatcatcttccaaatatttcccgtctgcatacgcatagtctgcatatgctttacctgcatcttccacaagagaacgatcaagcagagtaggaaatggtttctctttttcttttagtttgctcaccaaccaatgtgcaatatcattccattctgcatccataccactaaagcaacttgcttcttctccaaaagaagcttctcctaaatcgccactaatacgaacaacattagatgaactatagccacacgtttcacaatcagagtaactattatgcacattgacatttacttgaaacatattccctcctataaaagaaaagccccctgaaacaggaggctttgttcagatatcggcactataccagactttgaaggtatttgtcaagtgcttcttgatcaccttgacaaacatagcaacggaagtcttgagcagaaggttctttgtcctcgtcccaatcccaatagacagtacctttatagcgtgagcctgggaactcgaagtatgccacatgagtaatatggtgtgggccaccccaaaactctgtaaaagtaaattgaggatacgctgctttaactgtattttcaaaccaagttttacgatctaatgcttcgtttataaaataagcatggcgttccatttcatcccacgttttccagacacttctctcatcaggagaaaagacaagccattctggaaggtagagagtgtcatagtaatcatcatattcgatctcggagacgcacgaagctgactcctccagttttgagtaatcaaaagcagaatatacccaccaaccatcttccagtaacgctttgatagggacgaagcctttatcagcatattgatcgaattgtttgacacggtggcttgtgcagtcttcaaactcacattctaaacgatatgcaccttttcgacgagcctcaagaccgtgtgcactgaaaataacaacacttccttcaccatcattacgatctacttgataagcaactacttgttttgaatttgacattatttctccttatctagaagattgttagacaaaaacactgcacgagcaaaaccacgtgcggttaaggatctaagttgttttgtttttgcactagctccacctaagcttttccaaccccagaagcagcctatatgatctactggtttcttcactggttgaacaaaaccattgccgtgccaaatacaagttttctttgtatacccatcacgggtaggcattttaggatgaaagcttccttcctcttcaaacaaatacccaccatactcataaggatcaaagtaaaaatcgggtttacgccataaggttgaaagtttacctactgggttctcaatcatccaaggaacattatatttgttacccaaagcttccactacacgaatattagctaaagcttcatctagttcctctgtgctacgttcgtgtttgctaccactacctgctaacatagtgcaaggtggaaatccaaaaataatatcgggtttaggtatcccatgatcttcagggttgaatgtagaatctatccaggcattcacataggttatgtttgggtgctccatcctaacctcgtatttaccgtgatccccttcatcagcgtttacacaaaaacacttgtgacctgcttcggcataacgtaacaccataatcccagatccgtcaaacatagacaaaactgttttactcattacccctccattcaagacaagccataactttacgccaatcactttctgtaagaaaaatctcgtttgctttcttccacaaatctaaatcgtgaagggttggaatacgatatgttagttcacagaatctatgctcttcttctgtaatataaccaaaatgcagagccacatcgtgaaaccaacaccaaccatgcatctctcgaacaacatggtcatgctgagacattgttttatgccgtaaacctaaccaacaaggaacagatactttagtagtctttaatctgtgatcaacagtattagagtattcaataatagctgtcagtttcaatcgtgctttttctaaatcctcatgggtcactttgaaataactttctgaaagatatccacacatattaataacctccttcaaaaggcttaactacatgttgattagctttaaaacgttcaacatagtcgttttcgcccatgttttcatatagcttagtaacaacataaaagttttcccaagcatattccctaaaccaaccactagtgatggatgtgcagactttagataaagccattataaaactttgcttaggggttggacctccgatctcttcaccgaaaggaatttgtgaacgttccaaagccaaaacacacgcttcttcataaacacctaacaggcgcacatgttttggttgagcaaaaaacttttctttgctggtcataacttcacttccatctttcatataagatttatatgctggagcatccattaacgcgattgcttcatggatagaatcatgatcataaacatacggaacctcgtcacctttaaagaagtctttactttttacgtttaagttcggatgagagtaagtgtatgtttctttctcacgtaactcataaatactcttaagattttctgggatctttgcgcccagtgaccgcatgaaatgaatatctttcatagttttaaagaagtgaggactatcctttttaaaacgatgactcattttaagaaggtagagcacatctaaaggagcaacaacatgtccagcgtaagttcgacgaacatcatcagaatcttcacaataactaatcaaagcttctgtgctatctccttgagaagcaatatcatattccaaatgtgcaccagctatcattttgacgtggcctttgttccctttacgttctacaagttcaacaaactcgtcttgagagaacatttttgataattcttcccactcttgttctgtacacaggtaatctaaatctacacaagggcgatacaagtcttttcccatgtccatagcatgaatttgtaatgcacggctaccaattaacaccataatatttctcctctattggttgataggttaagtttatcaagcttccagattcctgtcaataaaaaacccgccgaagcgggttattatttactaacacattgaggaagaagagatccaaacacctcttgtggttaaaccattttcatccaactctacaccataatcttcacaaatgaaatcaatatagtgatctgcggctggcgttcctgtagggtaataagtttctccgttaccgtagtcacctatccaagcttgttcctgaaactgttcacagagttcttcaatttccttacgaaactttctttgtgcttgttccatctctttaactttcttttttatcagcagttcgccttcagactccacaatctctccttaacagctactactgtgccaaacgccttgagaattaacgacgaaaccatcatcaccttcaccataacaagaagaggattgccaatcttcaaaacagattgcgtcatcttctaagctaagaccaaaaccagcatcttcggcttcttttgtaagttcgtccactaaagccataatagcttgggctttttcagttaattcttcaatgttacgataactcattagtatttctcctctggttggaaaacggaacgacaggcccacatagaagcttctttcaacttagtctttgctattgaaatttggtcaaggcgggtggatatattggtagactcttccaaatcttcacaatcatccagttcagcccacaattcagacattagagcatcaaagattaatcctaatcgaacttcagcatctttaatagcattcactttaccaattttgtcatcggtatgcggtttataacctttgatatcttcgattcccactttacctcctattaacaacttaaagaagatggatgccaatttgttccagtattctcattttcatcttctggatcataataaccacccatcccatattcaggagagaaactgaaaccttcaccagtctcgtctgctaactgttctgcttccgctaaagcctcataagctgcttttacggcttcttctactgttttaaacttggtcgtcataaaatttctcctctcctaaagacatgttgacatgaaatgcgcggtatgtaaattcgttgtccgttgtgttagaataaaactcaaattgaacaacaccgtcttgagaagacaaatacatgccaatttgaactgttccttctggtaccaggtaagcatactctggacgtagtgttacattgtaaaaataaagttccccaacacccatttcatcccaagcttcccaagcggtaacgaagttactttcaaaacttgttactgatccgaactctgccataaaacctcctcaatcttgtagtttgactccatctccaacacatttccacgaacatctctccgaagaaaggcataagctttattaggtattgtagactcatatttaaccatatctggcacagcaaaagatactactactcctgctgggcttctgtcaagagccttattaatatttctaaggatatcgttagccaagatttctgccaattctccaagaacagtttcggttatatctttatatcccattaaatatttgttgatatctttcatctctgtattgttcagagtatagtctaaaggataaaaattcaaagaggagtcacttttatgtgtccacatgaaatgcacccgatccgagcagaatcgtaaccctctacgaagaatatcttctacaacagggagaatttcttttgtcacatcattaaccatgttgtaatctaagatttctgccaagtttgttctttgttcaccacgtttacgtctaggaatcacttgttattgccctcattaccaaaggtcgtagaaaatcgtaaatctcttgttttgttttcccacgaatgtttaaacaaggaacattattggctttagctatcttccaagccgtagctgttccaccttttgcatctccatgtttatcagtattagcacaagccaacaagaaacatgatggagcaggattctccaaatctctgcctaacacttgatgcacattacgttggtgcaattttctagcaccctgcttaagcttttcataagctgggtgaacatctttgatccattgcacagagatagcatagttcattgtatctggttttgcaagaacaataacatcacctggaatctgattacctttgaaattttcccaaggaacataaatttccttgttagtaggattttcagactcttggacacctgtttcaaaagcagaatcactaccctctgccttaccagaccgtaatttaaacccaaggtttgaaagccatttccctatgcctaccatcaaagcccactcttcttcagatatgtccctacttccaactcctgtatagaacagttctgccataatcacctcaacaagtaatttcaaaaggtgtatagggttccgtatttctcataatccaaggactgctaggattgctcggatcataaggaccaaaaggttttatggtaggttgtgtttctttcttctgaatctcttcaaaaatacgacgaagttcagaatattcttgatccaccataagattcggtgcatctgattctacagtttgcaggttatcttccttaagaacaatctcacgaacaagattaacatcttctgtttctaagataacttctttacggatattacctacactttgaataattgtaattttatacattaatcctcctcaagagttgaataaaattgaagaccaccatccatatcgaaataagcaaatgttaagttattattgaacacagatccagtatccatataaacacgattcgcattgataataggtgtttttacataagagtgtccatgaaacacataatccacacccatcacaacaggaagtttcattccctctttagcacagtctaccatatctctgtcccacataagtgcttcagcaaaacggttttcctgtgtttttgtcatcttcgaaatgtattctggaagatctgttacagggagatattccaaagaagatggatacccaccatgaataaacgcaagtttcatgcctctgtagttaacaatgagaacaacaggtaaatcttctgtcatcattgctaaggctgtagctccttcttcaccacattcttcaaataccgtatatcctccattttgataccaacactcgtagtagctacgatctccttccagcatacctttaatcatcatgtcttcatgattgccacgaatagcgtagcgattgtgtttacgagtaaattctaaaacacaacgaaagttttgctttccacgatcagtaagatctcctaaagatacaaccacatctgtatctcggatacctaactttgcctttcctttttcatacagattataacaaccatgtagatctccaattataaaaagatcttgatcgcttttaacagtaatttctctatgtatgatcacttatcctcctcaaaatctaagaaaataaaaatattcacctttccttcaatctcttgttctaaaacaagatcggcaaattctgcataagctttctcttcaactttttcaatatgctctgcggcatctttaaaaggcgtatccccatccacctttactaataagaaaagagatcgcatttctacgcttttactgttacgaggaaggaaatctacagcttcaacaattctccaacccaaatagccaggggttttatgaatctctcctaaatacttttctaagattttacgaccctcgtcgataagggcttgttctgtagtaatttccattccttcctcctcaaattattaacgaaaccgcatgactaaatcttggttcagatataacctctgctacagtaacatatgtatcgtgcagccaaaaagattctactctacaaacacaaataccgttgataatgaaatctacacaggctttattattttcgcacacttgttgactataaacaacccctaaagagtcataaagtgatctcactgttgctaccatttcatctgtttcgtcttcctgtgaaacaaagaaaacgaatacagacaagttattagcgaaagtattgctattctctacttcaaccgacttacaaggtaaaaaggagtaatatttaccattaggtatcaatttcgcctcaacctggttaagtatgctttgagatggttttgttacataaaaaagattttctgttgggttttcaacattactccttactatgcaacgagtggggttcgaaggatcaaaaacatgatcgaaatcgacacacacaggtaagttaacaactttaaactttttgctaagaatgcttactgctgtaaaaatcaaaccagcatttattttgccagtgaaagttgaacgcataactactcctcggatcattctaccaaagagaattccgcctcttccaggtagattacagaccttgttgcatgatatttaacgctccagaaattaccttcgcgccgtaaaagtatctcattcacatcaagattgcttagaaaaaccatataacttaaagcttgttgacgcgttgagaattgtttctctaaaagttcttctccgctctgcataatccctccttaaaatactccctccgaaaagggagtataagtatatcacgtagttgttatgttgtcttcttggattctagaatccacttctgcaaacatatcttctgcactgtaattatttccagtccagcgtgataaaaggatagcaccaatctcttttgcatgagattcggactccgcataaacgttagtcccagtgtcaccttttttcttttcatgtgcataaatgcagtaataattgtaagccattagtcttcccagtcattgccctcggtagagtgaaccaaagctcgcacgataccgccgtaatctactgcctgatttgcagcatgttcggcataaacttcaatggcttttttgaagaaaagagcagtagctgcttcaatattatccatttcgccatctacgtcagtagaaagtgaaaggttgaggctttcatctacttcatcaaaatcaatagccactgtcataattagtttacccatagttcacactccttaaacaaaataaaatggttgagagaggcccaaacgattctttgggtcgtatacataccaagcgtatgctgtcttatctgttccacctgcaacaaacgaaggccgttctgaaaggactataaggtttgttggtggattcttttgatggaactctcgtcgtttctttgactccaagaagcccaaccgaagaagataaatacaaacatccgcctcttttaagctcttttccaagaactccattgctaacttaaatggaggatttgtgattataatatcgggacgattttcccatttatgactaaaataatctttaccttcttcaagttcgcaatattctgaaccttcaggaaaatggcgataaatcgcttcagcttcacctctacaaggttctgcaaaaacccaaccttcttcctttagatttttgaaatctataacactaaacaaactattgattgctttttgcggtgtcggataataatcgctcgttgggcgatcataatctaatgccatctaaaatctcctcttttgtaatattatccaactctttaaaggatgaaatctcgtttaataatcctatttgatcagcctctagaggataagtgtttttatctgtttttctagacagaatatcttcaacaaacttatcaatagccaaagaagaatcataaaattttaaaagttggtaatccataggagatattttgtcatctcttagaaatatttctaacatgttttcagtagtatcgtggtttagtgtatgttcaccaaaaatattaacttcgtaaacatctttgccaaaccaacgtttcttcttttcaacagtataggtttttgccaccagaccatctaaacagtttcttgccctcttacatgtttgacggtaagagtggatagcgccttcaacaaacttagcaggaacttgtaacattattaatctcctatgtttaagaaatgcccccgaaggggcagtttgttaaatagcggttccttcgaaatccgccacatttacgagattaatattttcagatttagaagtcaagttgttttctgcaacagatttttcttcagtatccgcctcgttacctgccacgttacgaggttcttcttcaccgtagggattaccgaatttcaaaagattgatcaattcttctttggagaagttttctaaatcatcgtctgttaattcaataatctcgtcttgttcttcaataaatgtttcaccaccagaaaaagcatctcgctttttagctacttccatagcttgttctggtgttgcccctgcgtcaagagcagctaaagcaaagtctgacccacttcctactgcataatattcttcatcaatcggatatgcacgtgttgggttgttaccttcgtgcaagaaaatacgtccgtctggatgaacaacaagtgcaataaactcttcatcttctttatctggatcagagtgaatcatcaaaccagggacagcatcacgtgctgcttcgcactgtagattttgttcaaaccattgaaagaaagaaagcacggaggtcagacgaccagcaccacctacaaggtaatctccaatttttcggacctttttgaaattaatagaatctacacgtccaccaaaagttaccttaccgtcactcaaaatcttatttttggttgcaataattgtcgtcactattcttcctcctctgttaatgttttaagaaccgctttcccgccattcacatatttgcagatgtattctatcgcacgtagtgtctctttgtcaacaaaaatttgatcagacgttgcgagcgggttattaagaagatcactgcaatcacgaacaagcagtgctttcttattaaacaaattacttaagaacagtaacttcgcctcttcttctgttatgtgcagaaggctaggatcggagccagctattcctattatacaatcaaacaagctttctttactatcagaaagttcttgaaaatggtttaaaagccaatcttctcctagacaccaacatttaaacatttccagtttatctcggagggtcatattctctaaagtaagagcaatctctttttcaatatggtttacacaaatttgacgaaattcgttaggttttacgagtcccgtttgatagcactcatctataccgcttcttccgatagctattgttgctacacccatcaatcctccttataaatggcttccctgccatgtcattaaataaacacttcagtaatcagtttagacaaacgtccacgtttattatcgtccgttgtcagttcaacgtatccaataaaatctacaattggctcacgaacaccttcttcattttctggatataaaagttccaaaatttgatgcagaccattgctacgttttttaattgcatatgtctggcgaacatcgcctaatacaataacatgcgtattaatacctgcacgttcaataagaagtttaagtgtttctgttgacataagttgtgcttcgtcaataatgacgattgtattatccagggtggcccccaacaaatagttaggaatattcaattcgatcttacctgatccaatatcgttttccaatttgttggctgtcatgaattgctggaaaatacgttttgtagattcatagtgtgctgctagtttatctgttttatctccagacaagaaaccaatctggtcatctccgacttcagtagggttcttgataaaaagtagtttacggaagtctcctgaacgaagcatctgcaaagctttccataaagcaacagaggttttaccagtccctgccggagcatttacaacagtcagatcattccaaatcatgctttgaacaatcttattttggtccccttcaggcataaattcatctaaacggtaatcgtcattacctaccgcttttgctgcataacggctttcaatctttgctgaattagccagtttctgccgttgtgttttagctgcggttttatttcccatagtagcactccttttagaaggggccgaagcccctttattagttgtaagcatctaaagttccagaagtcagaactttaattactcgttcagcacggtttggcgtctggctataccatcggcttttacgcatgtttttacctgcttgagtataatatgcattgctgattaaagtcaagctattttgaaacccttcagcaccttttaaccccaactggaaaaccatgttgattattcccaatttacgagtatcactaaccttatcatagattggtgataagatagcactgttttttatgtctctcttcacttttgcaacatcgtcagcaaagatttgacgggcttctttttctgtgataactccattagtcttacgaccaagaagattatctaagatttgaatagcctttgctttatcttttattttagtcagaaggtgtcctatgccgactgtccaataaccaagatggtcttgataaacagtaagcttcagtccttcatcgactcgtagcatatcaaactcatctactactttagccatttacttcctattcgtcgtctcctactccgtgatccaactcgttaaacaacagatgttctggagaagtttcacgttttggtttcgttttctttatgttggacttcagctcatttgccaaagcacgagaaaagatcttacgtttctgtttacttttcataattgttactccgcaatttgagccatgagatcacgcagttcggtaaaaccgcctacgtatgttacctccccgttcacttcggacagaatttgtggaaatgtgcgtggaggaactccggtaagatcaacaactgttttagtcattgattctaaatcatagtcttgatcaagacttaaatattcaaactgtttattgcgcatggttaatagttgttttgacatttcacaaaattgacagttaggtttaccaaaaattacaaattccattacctctccttattaagtaatactgctaaagactgttcaatacctttatttaaatctgattttgtaagatagtgactggttactagttgtgacttcaccggacgtgctgctggagcattataggttgaagctgataccgccgatatcttaacaggttctggcatctgtgtcaagatcttttccgcaaactccgcccaagaaataagatggcttcctgcaaaatggtaagtcttaacagaccttgaccaacctgtttttaatacttcaaaaatagcttctgctaaatctggagcatatgttggacaagagaactgatcagcaacaataataaaatcacgttgtccatcattatagcgagacaacatggtttttagaaagttatttccaaattcgctatataccgaggctgttcgaataatatatgcatttgggttaactcctcgcaccattttttcaccaagttctttcgtatacccataattgtttattgggttaggtgtagtatcttcaaaaataggatgagaataattaaaaatatagtctgtagaaatatgcacaaaatcaattttaagtttgctgcacactgccgcaatatttgcaggtccatacgcattaacagccaaagcagtagcaaaatcatgttctgctttatctacagccgtataagcggcgcaattaataacaccatctacataatcttcaataatagcgtttcgcacagcttcaaaatttgtaatatctacacgttctttaggataaattaaagatacatttgaaggagccactttacgtaaagcttgtcccagttgtccattaccgcccaataccagatatgttagcatacaccctcgctacgtaactgttgaaaagatttagccattgcatcttttgttgatagaataggtttaaaaccttcgtcaaaaatcatatcgaagccccaatcgatccctatatcaggatcatcccaacgtaaactttgttcactagaagggtcgtatggagttgtgcatttgtattcaaagatagcatccatactcaaaactataaaaccatgagccaaaccaggcggaagccaaaactgcgtatggtgtcgtgcacgaagaacaacaccgtcccaagcaccgtaagttggactatctttacgtaaatctacagcgaaatccaatacttccccacttacacaacgaactagcttaccttgcgggttatttgtttgaaagtgcattcctcgcaaaacaccgaagtttgatttagacatgttatcttgaacgaaagtttgtctaccaataatatcttcgtatttttgttcattatatgtttctagaaagaaaccacgatcatctttataaacgtctggtttgataattaccgcaccttcaatttttgttttttctactttcattttctctccgctaatttgagtaggtattgcccgtactctgttttcttcagtgagtttccatgatacaccaaagtctctaaagaaatccacccttttttgaaagcaatttcttccaggcacgcaatcttcaatccttgacagttctcaatagtctgcacgaattgaccagcttccatcagactggcgtgtgttcctgtgtcaagccaagtaaatcctcgtccgagaacttccacttgtaacttcctgtcttctaggtagctgcgattgatatcagtgatctccagttctccacgcgcggaaggggttacttctaatgcacgttgaataacagagttatcatagaaatacaaacctgtgacagcataatctgatttaggattttcaggtttctcttcaatagaaatagcttgacgattactcccaaattcaaccacaccgaatcgttcaggatctttcaccaaatacccgaaaatacaagctccgccccaaacatctaccatctcactggcgttaatcagtagtttaccaaagctttgtccgaagaataggttgtcacctaaaataagagcaacagagtcttctccgataaaatctttacctatgatgaaagcttccgcaagacctcgtggctcggattggattgcgtaagtgagttttatcccaaacatagacccatctccgagaagatactcaaagtcttcctgatcacctggtgtggtgatgattaaaatatccttaatgtcagccaacatcaataccgataaagggtagtagatcatgggtttgtcatacacagggagcaattgcttgctcacactgcgtgttaccggatgaaggcgggttccacttcctcccgccaaaataatacctttcataaccctccttaaattttctcactccaccattgagggttgtttaagtaccattcaatcgttgagtagagatcttgttcaaatgtagagtttgcactccagcccagttcagactctatcttagaaggattgatttcataacgcaagtcatgtcctttacgatcttcaacaaaagttatcaagttggaagaagggtaggttactgcttctggatgtacagtatccatatagtcacaaaccatatagatgatctccatattggttttgggattacgtgttccaacattatacgtttgacctggttctccacctgttgtcacttgaagaatagctcgcgcatgatcctcaacaaaaagccagtctcgcacctggtcgcctttaccatacaccggaatctctttattcgtcaagatacttgtgatgatttttgggatcagcttttctggatgttgataaggcccaaagttattggagcagttggttatcacaacaggcaaatcgtaggtgcggtgccaagctttcacaagatggtcagatgctgccttagacgcactgtacgggcttgaaggggcataagctgtctcttcggtaaagggaacgccagagtctgccatatcgccgtacacttcgtctgtggagacgtgtacgaacatcttcagtttattttttgggaggagccttgcagcttccaataaattgtatgtaccgataatattggagtcgatgaaaactcgtggattcttgatagaattatccacatgactttctgccgctaagtgaatgatgaagtcaggattgcactctactactaaacttttgacctgggtttcgtttgccaaatctgtcatgcttagtttaacgtgagtgatatcgcctacattctcaatatctgctgcatagcccatcttatcaacgacaaaaacttcgttattaggatcttgacaaagagagcgcaccacggcactcccaataaaaccaagaccacctgttaccagatagcgcatcagttctccttaccagacatgttgagaaataatagtttccgttttaatgttatatttttcaagtagctttgcataggcttcttttgcattctcattcaattgctcaagatctacagctatgcttccctctccgccttctaaatcaaggccatatatgcaataagactcatccgcatcgtagaaaggagagatgcggcttaagtccagaccttcttgtaagaaccagttaaaatctccatcaaattcttcttcaattctaggatcttctcctacagcctcttcccatttattaaaaggtgcaccctgtaacatacgccattcgatatcaatacccatttttcatctcctcctcttcttgagcagctttaataattgcttcataaatatcgtaagcaatgcctccacaacatctagcttcgaaagctattgcttctgcaatgtgatctgttaattctcgtggaatgcggacatattctttttcactctccatcttctacctccaacccttctttttcaaagattactactcgtccctcaccatgacaattcaggcaaggaaatgttaccataatttccacttccatctgtccagtcccaccgcacacaggacaaaaaataagtttttcagccattattcctccttaattatttcaaacttggcaacaccatttacaataatatgaccacaagacataactcctagccaaggatcgccgtttttcttcaggcgtttaccgaatacatcacaaaaaccattcttcatttcggaggcttcataagaagcccctttgtcaaaaacgtctttgaatgtgtcgattataccaacacatctcaaaatcattagaagtcaagctcctcatcatcagagagatctttgttagctgaattcaatttgtaattagttaactgaatctcttgggctgctgactgaatcaaatcaggattcaaccatttttccatccaagctaaaggactatgtttaggtgctttaaacttggctttcattttcaatcgacgataaataggagcagcattgaaataaacccactgtttagacaattcagcgttaagacctacaataaaacgaccttcactaaacaggtagtcacaccactgttcctcttgttcaacaacagtgtcgaggatcaaagtcaactcttcaatattgtcttcgtaaattttacgccaaattgggtcatgcatcaatgcatcaattacagcataatccatcttaacatgcaagatttcatctagcataattttctggatcagtttacaagccccaacaaacagttgttgttctgccatagcaaaagtagcagagaaggaagatataaactgaataccttctaatccaatcagggctaccatccctttaagaatcagcagtcgaagttcatcgttagcttcaatcaatcctagagcatacttatgaccagcttcttccaactgacccatgatatcagcaatgatacccatacgattgaaaattttatcattaatcataatctgattgatgacttcaattggatctggagtacattgacggattatttcagaatacgttaacgcatggagaacttccatttcactctgcttcatcatcatagcacaggcttcattgttactcaagaatggagagaacaaagtgatgattgattttgcaagagaatcattttcccattggaacgataagtttttaatcataacatcatagttgtttttagaacaagctacgaaatctttacgtgtctgatccagattaacttcgttttcatcccaatcttgtgctttttgaagtttgtagagtttgtgcatttcagggtaagtcacgttgatagaatcaaaaatccccaactgttcccccatgaaaactggatatttacctgttttgtaagtctcgttatgtaaattaattgctgccatttaaatcctccactatttcacaaaaacctcttaagcttaaaatatcttcttcctcaaaatcattgctccggtagaaagcttccagtgcttcccatacgcttctaccaagtataacagtcactgtttcttcacttcttgcccttgttattgcgtaagccgtggcttctggataaaaagattcccaaatctgcatgttagctatttcaagaccgccaagataatggtgacaccaagtaggggtaaaatcttcagggcgaatcaacagaggcttaaacccaggtcggtagattggggttactccaggtaaaactataagtgtgctcataatcctcctcaataaaaaggggctgaagcccctagtttcatcacattttgcaagcttcacaaccaccatcagaatcttcttgtgctaaagagtctgctgattttgttctactgttaaggtaatacaatgacttgccacccagtctagcaaaattcagaataaactgcatctcagctttcactgataaacgtccacctaccaatttagaataatctagccaagaatcacaagaaattccttggtccgtaaacttggtaaagataccatacatttctgcaagatctttagccggagtgtcccaggcagactggtagaacattttcagtttttcatagtctggaacaataaataatacactacctttctgactttgtttatacataatagtatcacgaacaggatacagagagttagtagtattgcttaccaaactgctggactcattaggtgcaatagcagccaagacactgttacggataccaccttgttcaatgatttcagcacgtaagccttcccagtccattttaagatcaaaattaccgatactatctactgttttagcataagtgtcaattggtagccaaccttgaggccatttggtcttatcgatccattctgcattacctttttccttagccagacgcagagaggcttttgccaaccaaaagtaatgacgttctgcaagttcatgcattaattttttagcataagcgtctgaataatttacaaaattacttgccaaataatgcgctaagtttgtaatgcctacaccaatagatctacgtgctttagcagttatttcgttatgtttaaatggataatccattgtttcaataacgttgtcaattgtcaatacagtgtagtatgcaacatcctcatattcttcaggtaagacacgaccagcaacaatagaagataagaagcataaagccaattcttgattttctgtattctcaccagtaaagagatccggcatactgtggaaagctttagttggtaagaagatctcttgacacaggtttgattgatacaccgtatccaggaaaggtgtatggttgttaacgttgtcagcaaagaacatgtaaatacgtcctgtttctgcacgttgaacaataatctctgtcagaagatcacgagccttaacaaattttttcttaatgcgacgacggcttactttgtcataaactgcatcaaactcttcttcacttttatacaaagcttcataaagttcaggagcatcatcacaactaactaacatccaatcttcgttttttgctgctcgacgcaagaacgaacggttaacaacaatagaataatccagtttgtctactcgtttatctataggtgttgttggattcttcagtcgaatcagatcgtcgaagtctggttcaagtatggtaaaggtaactgtagcactacctccacggcttgcttgcttcgaagctccaacactatcttccatccatttcagatacggaagaagaccaccatgaataatacgattattcttaacaccttgacctgtggcacgagtttgaagattaacaccaatacctgcgttattcaacgtatactcatgagctaagtaattagcaatggctaaagactctgccgtatcgtctgcacggaacaaacaacaagacgcacttcctttgattggagttcgtagagttgtcagatacggcgatggcagattaatcttaagatcgctaacataagtataaagttttttaatatcttctatacggcgttcttttggttggatctccataaccttcattgcgataccaatgaaaagaaactgtggagactcatgcaccacatcgtttactgcatctcgaataagatatttatctaccatctgacgtaaaacagaataaccataagttagatttttattatgctttacaatcttaccgatttctttgatctcttcatcagtataatccattttagcccaatgtccacgttctaccatatcatgataaaaggtattcagtgaagggatactgtggtatcccccatgagcctgtttgtaaatcatacccagaagaagtcttcctgccatatcactgtaagcttgtgttttcttgtcaatacacgctgcaatcattgctttatgcagatcacgtgtagacacaccgtcataacaccgcttcacagcttctaattcaatttcagaccagtttagtttacctgctgcaaattcagaccacttgcgaagtttttctggattaaactcctctgtcttaccgttagatttagttacaaaacgaatcaacttctcctccctattattaatgcatattcaaaacatctacatcataaccgaacttcatttcattaaaaagtccattagcatatagaaaaccttcaaaatgagttatgtcatcaaacccttttgcttttgctcgacggtctgcttcttgtcttttaggagataaacgttttgaagtgtctagaattacagttacattacaaccaacagtttcatcaaaatagacttcgatttcacagccttcatatttattatcagtcattgtccctctcattgattagtatcatctgctttcgcaggatcataagagttaccgaaatcatccatcttaatatgtgacgcaccccaacctgtaaattcttcatcaccaaaatgaaaaatatcattttcttgatagattcgtttaaaaccacaattaggtgaaacagggaaagtgaaaagcgttgtatttgaaaacactactcgcttatcgttattgcttcggatattcacattacactcaacagaatagtgtgaatcttcagccatacccagcattacaagcgacgctctaataacagcattttgtttctcgtgtgggatattgccattgtgtttatttgattctagtttccagataggggtagacattacagtagacatgcttacggtagcccaagttgtagtatttactaatgacatattttctccttcattttgaatgggaggactcacctcctcccagtattgtgctatattatactaaaactaatactaaagtcaataactatttaaacagatcaccatttagtatgatttgttaaaagttgacgatgttgaatccagcctttgaaattgccagaccaaaacttaccattacgatctacatgggtaatacctggttcccaagagttaaaatcccaaggagcattgataaacaaatcttcaaaacagttctctccatattgttcgcatgtttcttgaattggagtggcttgatgttcaaacggagaagcatgaaccttgcgcccagtcagcaaacgaccatagatatctaaagctttatctttagttgcatttaaacgacgatagctaacctgtgcacaacacgaagctgaaatagctttggcttcttccaaagtaagcacaacaacttctccagattcatcttgaacatagtatccaccaaaaacaaaatgatcgtcaccttctgtaccaatattatcatagaaatggtctacataaggtgtgtgccattgccctggtttcagcacttctggtgtagatccttcatactctttgtgcatctctttagccaaagcttcgatagtaggatcggcttctttgtcatcacgtagccaccagaaattttcatattctgttgctgtcagaactgttttaattcgttggaaaggttccagaagacggtttgcaacttgtttgtggtaccctgccaaagagaattcttctgcgaaacgtgctgcactaagcgcggcaagattccaccactcttgagcagtataacctgcatcaataagagcgtcatgatcaacacctttatcctgcataccaggttggttagccccaaaacgataaggacgagcaggttgatttcgcaccatttcaatcagtgttttaacaggtatagcacggctagaagcagcattacgactgaacagtcggtgagtcatcaattctgaatgaataatacgtggatattctagttcaaaagttacaatctcttttccgtcttcagtgatggaatgcgcaataatactagccgaaatctgtcttgtcattttttctccttagtttttaaaattgtttaaagtgttaaaaacatccaaacatgttagccactgatcttctaaacctgtgatcacaacatttggttttttctttagttcttctaaatggttatctttataaggcgtattaaaatatattttaaccacttcatctggaaaatatagtaggttatcagccctgtcatctattgctatatcacaaggcaataagtatttttctttcgtagcaaaaaagccgttaccagatcctttgctaaaatcaatcgtatctaatgttcttaaaacatgtttatgtttagaacttaagtgaccaccttttgtcacacttgcgatcaaaagattgctacctttccttgaaacatactttaagaaatctggcatacctggaacaaaacccattgtatcatagagatgaggattatccagaaatccgtaaggatctatattgaactcctccctgaaaccaggaaagtagttggtaagatcgtagtctgcattttttgtgaatgtgtctatcttaacaccaagtccactaatcttattcaaccattctaaccaagcaacatctaatggagccacaactaaatcccaatcacatactatctgcataaaacctcctctctcttttagtatagttatcttatactaactttcaatttcctgcaataggattttgactatttgtttacggcgttttgctactgtgctttcaggttctattttacgcttcttcagccacgctttatctttcttagctctacacaaagctatcgcttctttttcagcttttgcttcttcaaaagatatgccttgcttgtctgcataagcaagaatagagttgcacaatttacaaaccattcgcaaatcttcttctttcacatagatcaaacggaaaacaaaaaggggaatatcctcaaaacattgaagttgttttgctgcgtgaatatgatccacttggaagtctttcattcctcctctgtgtccacatatttcgcactcacaattccaaacttgttttggttttccagttttcttgtctatcatcacattgccgtctttatctacacgatcaactttaaaacgccttgcattgataaccttaattttattagggtgtctcatccatgcttttctaaaacatcccctaagataagtataaaattcagcttgtgttttccagggtgttccttcaccccacattatttttggttcacctgccaatattgctcacctttttagctgtatattcccctggtgggatattatgtttaaaaaacaaaaggcggtctaaccccgccttgcacattgtttctggaatagtcaaagttagtaaaagtttatcaccttttcggttgaatattttataaacttctcctgctccatattgtttagtattgctcgccactaatacgttccttaagttgtttaatagcttcgattgcatctacataagaagagttatacatgtgtttcagtgctactcgtattaaaggatcttttgtgaagaaatcaataagaagcatagcttgatcatgtttagctgcatttgtcatagatggataattttcacgaaccatatacgtgctattttgcataagggttctttctagttcaatacaatgaatagctttatctaggttaatctgacgttcacctttaatacgtgttgcgtattttgccaatttgcaaaaacaaggtgtgccaccaaccaaataagctagttcaataggttgcattaccatttttgtgtagtgatcaccgtcaacctgattatcaaaagcattagacataattttcctcctgaattcctactgcaccttcttctgggtagtctgcataataagctaccctaccttgatagataatatcaccatcgtcattataaattgctgtaccttcttggattgttatttcaacgtcaagtaaatctgggtctttctcgatggtatagttcaaacctaacatttcaaacagttcgaaaatttcgttacctgttaatgtaatgctcatatttcctccttttattgtggttagcagagtatacactaatataaaatttttgtcaataaaaaagggagcaataagctccctgattattagattccaatgatagttgctgctcgtttatccttggatctggtgtttgctctactacgtgacaaacctccacaagattcacaacgaatgatatcgaaagaacttaccgcagtgtggtattgtttaccagtaacaacgtgaacgtgatcactgccacaacgagaacaacggaccttctcatctgggtaataagcggataagttaggatgctgtggaatccacggaaggattttcatatacaaatcacggagcgaaacaacatcaccatcattgtaaatctgcatacgttcaaaagcatcacgatcaccttcacaacatgctttccataaagggaacccctcgttatccagtttttcactttctgtttcgaaatatgctcccatttctttaagggagttggaaggaagtgcaaattgtttcttagctgccttcaatgtatcaacaactacataattagaaggaggagccatatcgtgatatgcaaatcgttggttaatgtatgcacggtcaaacttatacccgttgtgtgccacaactacatctgcctcattcagaaggttccaaagatcttggcaaagctcccaatcatctgtatgatcaatatcaaaaagaggataagaagacaagttcttaccttccacttcaccagtatacaggtcagcagaagagtaagataacaaataacccctacgaattacttgatctggagaaatgaaggctttgaatcgacggaaagtatatgcaatctctggtgcagtttcaacatcaataattttaataacgggttgtttctttttaactggctcttgtttacttgctccaaatcgtgcaaggaaatcgttcactgtgctttttcttgttggactacctaaaacaattgctgcaatattacgagaagacataccctctgcactcatactaaggatatctgctttctgctcttctgttaatctgctcactctgcctcctgttgtgagatgtatgactgaagcatactctcaaatgttgtatcgtcattatcccagcgtttcatgtataccaactggaaaattgtttctatccattcatctgttgtcatatggacttcttctccatcccaagaagtaaaattaacaccatctgggaaccatgagtagtaagtatctttaactgtttggaaaagttctgcttgagttttacaagctgaaagaagattaaaacaagtaatatctccgaacttaatatcaaaatcttgataaggtcggatactatctgttttatctcccattagcatctgatatgctaaccagtaactgccccaacctttaacttctttctttttacctttatctacgatccatatatcgccaatagactcgtcaataagaattatatctggatttttaaatactccatcctctttgtagaaattaaaaaggatactaggagtatgtaaactatctttatctatagatactacgatataagaaaatttacccgtccttttataatctttatagccttggaaaccatacttctctaactcatcatcagcttctattacagtaacaacatcaccattgtggaactccacaagataatctttggtttctgaaagctgaaggggtttgatatctaatcgttcagatttatattctacaggcattttgaaggcgtgtctgaaagtttttcctacgccaataactccgcaatatttttctaaacgtagatgttttagaatacctaagacttttgttttagctgcttggaaggtgtgtccgatatcttctggcgggtattgcttatcaatgatttcgaactcttcctttgtgaagggacgtttgtttttggaggctctttctgcatttgtatctcctagccaacctccaattttagtcttgcttttaccccaaaactctgtcttatttttaaattccttttgagcacctgaagggatgtgcttcgcaatgattgttcttttctctaatgcagatgctgcttggaaagcgatctgatcataatcaattgcagctattgtttcttcgttgacatataaatgaagatcttcaggtttaattaaaatataaccgctaatatttccccctaattattcatcgtcatcctctgttgagaatgttttagtatacggacattgacgacttttcgggattgctataacttcatcttggttagcgttagaatagtagcaatattttgtattgccattaacttcagaatcagacaagattaaagtaatttgacctgctgctactgtgaaactaaaagctaaaagaacgactgtcagaatctttttcataacgcctcctaaaaagcctacctcattaagtaggtaggcataatatcataactaatcccgcaagtcaagaacttatttaaggattgttgctttggttaaatcttccatcagacctcgaatctcattgaagcacagaaggaccgaagcttcaatactaccttcttcgtctgcaaaatatttcggaaaacgtagtttagaaagtttaaactctttatccactacaaaatctacaacaccgtcatattcaagaccgattgcaacaacatctttaccatcttcttttagttcgacagctttagactcgtatagggattctttactccaaacaacaacgccctcgctatcctccattttgatataatttccgagagtaatacgatctgcttcgtgattctccagcaattcaccaaaacctttcacaatagcttcttcatgcacactaaaacctaccgaagggaaagtccccagaacggaacggaggaaagaagtaatctcttctgcaacctttttacttccattaagaacataaagaagattcgtagttttatccaagacaacatagttaaagaaatcttcaggttctgtttcaggcaatagtgcaaattcaatatcttccttcattgctttgactacttctttatcgacataaaactctttaccttcgctctccatgtcctgacgcatttcttctagacgttcattcaaaatacgtttaactttctttttatctaccttcttcacagattgacctacattaagcagttcaagatctgaaaactcttttacaaatttagagtcatcttcgaaacgaacaagaccgatagtgtgtgactgggagccttctgctgttacaaattccagaggaatatctgtaatgctgttaatggatgctacagaagcattgtcaccaacaaccataggcagagcggatttaaaagattttacaaacatgtttcctcctatttaatacatctcacattaccgcccgtaaagggcggcttacaacattacttgttaataatacctgcaatattaggtttgacaaaggtcgatggtttcatgatcttacctttatcatcaaagaacacatacactttctgtttttcattataaacagcatgaacaccagtgtatgccccttctggacgattggcatttcgttcttcaattgcagcgcattcttgtgcaatggctgaatcgatatccgaagttttccaagttttcagcaactgttgtttagttggatacttggaatcattacttttcaatacctctttaataactttcttttctggatattttgaacggattagagtgtcacgagacatacgcataataccagcagccattagtgccatttgaactggctctgtaaatgtttgttccaaagcatcaaaatcagtatacacagttggagtaaaaacatcgcctacagcatagtccaagaaattcatcgtatgttcttcaccaaagaacatgtaagtcagataactggatactacaaaaatatccgctgctgcatccaagagttctacatgatcgtttactttcgcggctgtttcatactctttaagctcttcacgaacgaacccgatttgggacataaataactcttgagtgaattcaggttgttcaccacctcgtgctttggcattccaatcaattacgtgctttgctgcatttttgaaaaattcagtatcgaatttaatatctttaaaaaaattctcgatcattataactccttatttaaaatagctttctagaaagttgctaatatttactacagtctcacccatgtaaatccctgcgaaaccgaaaacaagcatacgtggaatattgaaataccatttatctgccggaaaagatgccagaattacaatagcaattgctatcaacatcataagaattgttgctaaaattatcataaaaatgcctccaggtattttgcacaatgataagctaagaacatttttcctccttattctgctggttcccaagtgcctgggatcatttctcgaatacgaacaccaacaggttttgttggaataccttcatctgaaaattcttcatactctatttcaacgaactgattaatcaaggtagaagcattctctgctttacgataattgatagtctcatgagcatctttacgcattaagaattcgactactttaccattttccatctcacctgtcaacactccatcgccatttttatcactttttgaatttattactttaacttcaagcgtatgacgaggcttacgtttaataacatcataagaacgtttatcaaattcgtaaactccgtgagtattacgatatactacaccttcagctttctcaagtaaagctttttcatagaaagcatcaaactgttcttggttttcaatatactctgtatgaaccacacaaataagctcatcaagaccataatcctccactactgccttaagagcagtaagaacatcaacacgtttttcaaacggtagatctggaactggaatatcgtatacgtaatagttcagcaaaggtgtatttgcattatgcttcttccaggcactgttaatttgttgtagactaaggacacctaacccagcaaacacttcaccatcaagaggatgaccaacaacttcactaataaagtttggaatacctttccaatgaggtggcaggttgtacacttccccagcttttgataaacactcccctttcatgttaatcatagaacgtaacccgttcagtttgtattgtgcataaccagggaacacaaccctttcaggataatctttataatcctggcatttcattggtgtagaaggaacatggttttcagcttcttcttttgttttataatagccattctttaactgttttgtccatttggcaaaagcttcaagttcagcttgttcttccggtgttgtttcattggaacgaccaatgtttttcgcttctgctgtataagatttttctgtgatttttccacctacccttccatgagctacagtaacaactgcaccatctgtatacactgtccactgtttaagttttccttttgaatctttaccatacagcgtttgatttgtttgttgcattagtcctcccatttaaaaactgaaattttcaatctgttacacacttcatccaaatctgcgtcgagtaacgttgtagatgttgccaacatataatcaatgcttgtgaaaccttgccctttggcatagtcaagcatatcttcatacatatcttcaagatcaccgtcatcaaaagtagctagaaaatcctcgtccccgctacgaacataaaatgcagtactcattcatcttcatcccaagattcaaaagcacaacaatcatcggtttctataataccgacacgtccacaggtattgcaagtgattttatccccgtagaataaataatttttatcaccctctgtgtttacagttatgtcattactaccacaagggcaagtcagccaaccaacaacaacgatatcttttttcataatccctccttaagcattcagttcgttgttgagttcgtaaatctcttcttgaagagaatcgatctcttcctccaaacgggagatctcttcttttagatataccatttcagattctttctctcctaactcattttcaaattttactttattcgcctcattttcataatggagttcagcgtaatcatcgcgcatttgttcaataagatgaatcagagacaagatgtaattatctcccgtttcatcacgccactcttcaccgtggcggagaacggtaattcgtccagtatcttcatctaaaattgtctcatatttacgatcatctgtataaatctgcattatttctccttattgaagtttaagtgaaccacgaagacgcttctcttgctgatcacgaatatattgtggaacctcgtgaattgaatcattaccgtgcctattttcaacaactaaagagataacttgataaccaaactcttcagcaagagctagataaggtttaagttctttctctgtggttgaagtgttagaaacaataatcttgttaagattagatgccatagcatcacgaacaatactctgacaccatgcgtgtgctttacctacattttctggcttccaatcgtaaacaccactttctgtgtaatgatattgatctgcctcacagataggccaataaccttcagaaataatttctgctactgtagatttaccagcacctgaaacgccacgtaaaatgataagttgtttcatttatcctccaaagaagttttcgattttttcacgtcgctcttgctgatttaaagcagcccattgagtcttcgtaaaattatttcgaatccattctaacaaagcgtaatattcttcgtcaacaatttgtttggcattttttggattatcccaaatcagatcccactttttatctccaccgcgcataagaaacttcttagtaagatagtatggtgacttaatctttaagagtaagttaaacggatagtttgtttcacgaactacaaacccttcgtgtttacaatctttagacatttcaacaacatctgaaaacttaaccatcggatgaacttcaggacgcttaaatttggtgacagaagcaattccatcaagagcaccttcaggtaacataaaacttgtcccatcagggttttgaattctggcaccaattaagtatgcacctggttcttcttcgacaatatgcggatcagaaggatcacagatttcaaaaaggaaagttgcttttgcactttctgtccatttgatgaagtgttctatgtcatcacactctgaaacaatatgattctttgcaatacttgcaaaatctgattcaaggcttcctgttgtcgatacgataagttgacctttatatacacctacagaggccataaaaccatttactttacgaacaacatctacaaattcatccgctggtagatctgtgccattctcaaaacgattaaaaatcttagtgaaaggccaaataacaacattgtcatcagcgtcaacaacgattccgcgacattctagaagacgagaatcaatgttccataggttatcccagaaaactttgttcttatacttaagaacagatagaccagaatactctccttctttatatgttttcttatgaactaaacctttttcaactaaatcgtcgcaattaaatttagccacattactctcctttgattattttgtgatggtctacagttacgatatctcgtttactcatcatagaaattatctcatcaaaatgtaagatttttccgtgtgcatcccaacccacatctaacattttaccataagcttcatcagggaaagatccgtgggaatgcccgtgtagcatgattgatccacgaccttgcttattccaggaggccatagggtaatggcttaagacgaagaacagcttctgatatttcacttcgtcataatacaccacttctccatactctgcaagcacttctcggtgtttgctgtaatcatggttcccaacacaataagtgatatccccttggaggcgggaagcaatcttacgggtatcttcttcagttccgaaacagaagtcacccaaatgccacatcttgacacctggactcgtagcgcatttattccatgcttcgatcagtgcttctgtcatgtggtccatatcttcccacggtcgatattcaggagcaaactctcgtatacgtttgtgcataaaatgcaaatcacttgtaataaacattagtataatccctcgctaaatagttcatggtcgtgaccattacgctcatggtcgatctggtcagcattttccgcgatgatataagcatccgcacgactccaccaattgtaatactgatcgataaagccttgattatctggtgtgcacaaagttttgttgattacacctgcttctttcaacacgtttaactgtgcatatagtacaggatttgcatgtcgaacacaaggaataattaactcttcaccattattcaaaatatacttatttgcagcacagacgataacacgttgcgcataatgaccctcaccaatccaggtaagaggttggtaacaaatattgttttcaataccactcattgtttcctaaccctcctctcttaagttatcctcgaaaaaactagtatctggaagtaaaagatcattacttgtgtcgggccaatcctcttcttctcggtagataaagtaaccttcgtcctcttcttgttccgaccaaaccgaatgatgcatgttctctccttaatagtgcacacgaatcattttaataccataacgcagcatggattcttttgcaagcatgaatttatccccagcggcgggattagaagtatgcacgaaaatggtaggtgaaccaaagcaaggtttaccaaacgccagaagttcttccaggtacaggaaaacatcatacccatcttggtctgactccatacctaaatcattgtcaaaagaccactcggttactcttcgatacagtttagcaggatcattgagaaaagccatagcttcttgtgacgttttaaaccaaattgcatcttcctgtccatagtcggctgggttacgcatatcatctatccaaactttcatataacctcctctaagctggcatgattaaaaaagaactctccacttcaaaatgccaatcctccacaagacctgattcccaatccttctcttcatggaaagagcaaatccaacggtacatacctggcggtgtattctcaacatcttctggcaacccgtaatccaaagctgtcaaaccgttctctgtaaaactaggatggagattaggagctttcaatacagaaaccctgcctccaacatctacagccacaatccactctgtcatgtatgggctgtcatattgaggctcatcagaacctacctcaacagcctctgtgcgtaagatgataagaggctgctctgtgattggggctttgacaatatacccgtgatcctcaaaaagatcgataacctcgaactcatcgccgttttcgacaccataactcttattcaaagagataaacttcgggttatcatcgtaagctttatttactttaattctcatttttcctccttcactttaacctcaaattctacaggcttaccctcaatgtaaaaacactgatactctgccttatcatcctcatcacgaggccaagttaccaaggagttatagcaatcttctggtgctttgaagatggttttagtctccacagtaacattcccattaagtgttgccaataccacccacccagctacagggatcatagtgcctccactttccacgttttacccttatcaaccaaggtctttgctacagcatactccttcccattaacaaggaaataataaacgataaaagatttcccgattgttactgtcttagtaacctctacacgtttaacaccttgcatgtattttgccttaccggaatagagtaaaatcattttgcattcctcttgttgttgataacatccatagcagtatatggtttattagtgccatgatactccagaatcattggagagccttcttgcactacttcaaagataccataaacagaactttcagcaaataccatttgcttcgtgccttcatcgtttacaacgagagaaaacttcttgcctgtcccgttgaggatctcgtatttcttgccagcagtgaataatccagagtaccactcattatctgttgcttttacacacttcaggaaagtcttgatcatttctttttgctcctctttttagatttctcatacaaacctaacacagccgcttcttttgcacaagtaggaactgaagtcatccctcttctttttgcttctggtagttgcaaagtccatattccccaccaataaatttggtctgccgtgagtggttcagccattggatctgcctcctgctcctcaagacgttgcaacgcttcttcaatcttctcgattggtgtgtcaaagacgaatgcctccgtatcaaatttatctttcttaggaactgatttggctactttgagaacctcgtttttcggtttcttagtaacgttctttggctttgataacttcttcggtgttttcgccacttactacctccatacgatctaaaaagtcattcacaaatctccagtaacgttgacctgttctaagatcttcatagataaccacaggatcaaacactttagatattccggcaggttttggaaattccactactgtatataaaccaccttttgctacacaagaataggttacgcctgtaattggatagttgctcatttctttacgtactccatgattggggtatggtcgccagtaagcgtaacacggctgtaggacacatcttgtgtcttcaatgtatcaatccactctaagaagtgttctttcgcttctgtgtagttctgtgtgcctttaacaacgtgtataccatctagtgttacacggaataccatttgaataacgtctttcatttcttacctcctttgttgtcaaagtagcttaccagaacatcgtgaaccacacacatagcaaaaatcagaacaattgttgccaggattgggttctcactaattagtgctatcatctttaaccacctccaattgcctttcgagtttgactttgtttgagaactgataatgacacaacttacattgcatgtcaacaatctgatcgtgatttaaccctacaattttaacttcctttgcaccatcccactccaaatactcaaagccatccaaatgattactcttgtccaacaggaatgctatctgcttccattcaatctgaatatcatttaaatgatatgctgcacagaagatatcctcatagtaaaagacgatcattgtcattgcttcgtcaagtacaactacctcttgtcttgtaaatctcattctagcctcctaaacgcgtctctgacgcactttttatatataagatgataaatcaccttacctagtaagtaaacttgctctacagcctcttatgaagcttatgttataggctatactattgctacctgtttaagcaaggtttttgcacacagaaaataatttttaataaaactcttgacttttgtgttcgaagtatgctaccctagaaatctattaacgagcgcagcgagttaaggttttaggttggtgatgtagtactctgtactcaagtactgtactccgtactagattaataattattaaatattaataataaataattattagatctaacaaacaggtacagtgtatcagaactggtacgtacagatcaacttctatcaattaaaaataaaataataaattattataaataatacttgatctatagattagtatgaagtacagtacgaaacatcttaacaagaatggaggtgtgcaatgattagtgagaatccgtgcaaatggcatcatgtgcctattaaagattgtatgtcttgtaatccacgttctatttataacattgcatcttatgatgatgacaatgtgttagacgatgatgaaggctgggaggatttagattggactggttatgaaaccaaaaaggataaaattattcctagttgacttaagatatccttcgtgctaaactagaagtgaggagatgccgatcactccccatttggggttcgaaggatatatgcaaaatagcttttattttaggtgccgtgcttgtaataggcatttgacaaaccactccagacgtgataaaaatggagtcatcaaggaatcagacctctgttctatttgcacaggtttggcttttgatgatagtcccgaaagggtttatcagcatcaatgtataacagacgttctcgtgtcaaacttggtagaggacgaacaactaacagattaggaggaacaatgtctctattagaaaaacacgtgtttgaagatggtaacggcaatgcagtttttcttttccatccagaaaaatacacatctgaaaacaatggtacaacttctattgtaatcactaaagatgttaaagttattgatttcttggctctgatgcgagagatggatcttgaaattaatacttttaacgcagaagctttggttgttgctcttctggaaaagaaagatagtgaagaagtagcagaatatgcttaaataactattgacaaacgtatccttcatatgttaggatacgttcatcaagtgtggtaacagggtcgttgacttttgttaagaggggcttgcactgcggtagtgttagagactacttcttcagaggttagctaccaaagaggaaaaggaatagtctcggctcaagaacttttacgctgaaagttgggcttggtcttagagaatgtagcggttctctacaatcgtcagcgtctctgttaccacatttatggccctgtagctcaatgggagagctgtcggctcataaccgataggtagctggatcgaaaccagccagggccaccaacgtctttatggtgtaatggatagcacaggagtcttctaaactcttagtcaaggttcgattccttgtaaagacaccagaacattttaacatgaattagctcaagtgatttgaacccactactgatcatggtggcagagaatgaggcaagtatgtcagacattataaacaaaggccacggttatattagaagacataaatgctcgaagagcaccgttcgtggagaacggggttggtggagtcaccattcatggtaaaatgttttaaaaaactattgacaactaacattattttatgttagattataagtatggaagggcaaatcgacgtggcgacgaaaacggtcttgaaaaccgccgagcttgaaagagccttgggagttcgactctccctccttccgccagattaggtagattggtgaaatggtagccacgacagtttgctaaactgtagtcggaaacggcgtgtaggttcgagtcctacatctaccgccaagttctttttaatatagcttactttagcagagtaaatcttcggcaagtggcggtaaccactttaccgataactcatagttagtggtgtgaacactggctattttaaaaagaatttaaatattagtatttaggtgagttaattccgtaggggtagcggggcagactgtaaatctgttatcattgcgattcgggtggttcgactccatcactcaccaccaaattaagatgagttggctgaatggtttaagcggcggactgttaatccgtgttcgaaagaacgatataggttcaaatcctatactcatcgccagaattatggacttgtagagttaaggtaaacccccagtcgccaagaggcttctggaattgcaggtatcgaatcctgccgagtcccagctttgctcctatagtataatggctattacaacggttttgtaatccgtggatctctgttcgattcagagtgggagcaccaacacaacattaagggcactgtgattgatcgtcgtatcctgtgcacaaggtctgttcgaaagacagtgttcttagtattgtgttgatcacacaaaaagagttacctgaaacttgaccggagtagggttggatggggcaaaagaagaagcggctctcccatcgacagcaacgaagaataatatttgactttggttttgtattattttaagttagcttaccgaacgtagggctagtcacccaacgggatactcgtcactgtcccactcaataaaactattgacaaccaatagtaaaatgtagtatagtaaagatgtagggcgttcttggtgtagcggtagcattccgtccttccaagtcggcggcacgagttcgatcctcgtagaacgctccaaattatttaataaagggttgccagaaaactttctcttttactcatggttttctccttctctcacacctcttctggttgcccttcattaaatgatttattggtttgtagtgtagtccggtagcacacgacactttgactgtcgtaggtttggttcaaatccagacagaccagccatataacaaaggtgagtcactacctcaagtgtgaagttaaaaacgaggagccgccgaacactttcttttgcggtgtacctttagaatgttatgacggaatttagctcagtttggtagagtgtacgctttgggagcgtattgtcgcaggttcgaatcctgcaattccgaccaattaaatgtttcgtagttcaatggtagaacccacgactgataatcgtgagatacaagttcgattcttgtcgaaacaaccagtttcccgttagacttacaggataagagttccacaatttattgtgacgctggttcgaatccagcacgggatacataatagcgggatagaggagtctggtcgtcctcgccagtttcatatgctggagatcattggttcaaatccaattcccgcctccaaatatcgcttgccagcggtatctttgaagaccttgcctggttccttctaagatggaggggtgcgactccttaacgcacaattataataaagcatttcaacttaacagtatttattagcctccttattggaggctttttgctatctattgaataaaacttgacttattattttttatatgttaagataaagtttaggaggattttattatgcctaaactaaaacgtggtcgtggaagaccaacagccgaaatgcaacagatttacgcaatggatgcggcgcaagcaagtgtaaaagaattatttgcagagcattatttagaagctatgcggtatattgttgaacttgttaatgataaggatgcagcaaaacctctccgcttccaagcagctaaagctattaaagagcaagtagaagaatggttagaagaacattatgaagctatggaagaagaaacccctgccgtgcagaatacagatgacgttcctaaaaagatcgtaatctaatccctctcctctcttggggctttgcccctcctccttgttatttttaacacccctctccgaaaggttaggggcttttttatttttaatgcttgcaattatatatcattttgtgataagatcagatatgaggaggataaaatatgcgcaattttgtagttaaaaatgattttaaccgttcttcttatcataaagataaaaagaatgattacacacgggcttggaacttggaggaagaactttatgatgacagagaagacttgggaagagatcctagcggaggctcaaccaatggaagtgaagaagatagttaacaacgccccttctcttcctaaaataaaattttatgaggaagtagaagataatgaatctaaagactaaaactgtattaagttttgttttaattgttgttcttattcttgccggaatgtttgcttataacaagatacgtgagtctggctacaaagatggtgttgcctatcaaacgcaagtatatcaagcagcccaagcaaaagcaaaacaagattttgatgttcttcaaaaaagagcagatgaagaaagagcattattaaatactcaaataaacaacttgtctaaaaacaatgcacaattaaaagcagatttagagaagaagaaacaaacgatcaatgaggatacaacgaattatgcaaaaactaattctggcagtatgtcttgctttgcccctaatgatgacgggttgttcatcatcaacaaaagtttccccagttcttattgatgagtgtaaggctgtagccatagaaaaggttaaaggtccagattcggacttgatggataaagtatcgacacctgtgccatacactaaaaatcaaattgcaaaaggggttagtagatctgaagttgttaacaaccaaactcaaaacaatgctctttgggagcaagatagacgaaaggttctaggtttacaaacatatattaaaacactgcaagaaaaaggtattattgctgaataaggagggaatgtggcaaagaaaaaggcagcaggtagtttagctggagtagatattgaagtaaaggctcaaccaggtaaacagactcttgcaatggatttaatgccagaagttatgatttatggtggtgccgctggatgtgtttctgctgaaacggaatatcttacaaaagatggttggaggcagattagtgaatattcgggagaggatatttaccaatacaatcctaagaataagcgtttagaattggtaacaccttattttgtagaatatgatttaaatggagataacctatacagaataacaaatggtgtaggattgttccaagaacttagtatggaacaccgttttgtattctataagaaaaagaaatcaaagaaacatttcgagattcttgtaggagatcttattgcattacagcaaataggaaaacccctgcaaggttatgtagaaaatccattcggtaaacgtgttccttttaacatacctggtaaaaagagcacttacttaaaaatacacgaggttatttcaacagatgataagaaatattgttttgagactccaagcagctatattgtctttagacgtggcgatcactgcttcgttactgggaatagcggcaagtctcgtctgctattgctgaaagctttaaaatacgcctacaaagaccctttgtttggtggaatacttttccgtaagaacaccactgctcaccgtaaaccaggtggtctgtttacagaagcaaaacgtttgtatcttcctttacaaccacacgtaaaagaaagtacaatggatatcatttttgaagccactggtggtggaaccctcaaatttgaccatttggaaaatgataacgtaacagcagaaacaaaccatcagggtacacagtattcaatggtaggttttgacgagttaacccacttcacacaatatgaaatgctctatcttctgggacgtatgcgttcagagtcagaaacaagtttcatgttgtgcacatgtaaccctgacgcagatagttgggttttgaattgggtgttaccttatcttgatgagggtggttatcctagagaagatatgtgtggtaaacaaaaatatttcatcattgttaacgatgaacctgtttttgctgacacacctgaagaactgaaagaaaaatatccagaaaactgtttcatggaaaaccctaatacaggggagacagttgttattgaaccacaaactttcgtatttattggtgggacaatatttgataacccagaactcattaggcttaaccctaattacttagcacagcttaaatcacaaacagcgattaaaagagcacagcttctggacggttgttggtttgcacgtattcagaaagaatctttctttcaacgtgaatggttacataaaatatcttataaagatgttcctaacaatcttaaactaatgcgagcatgggataaagctgtttcagttcctacagaaacttaccgttatccagactatacaacatctgtcaaaatgggtaaagaccaagatggtaatatctacatctttggcgactatgattatgatgctgtggatgagaaaagtaaaattttcggaaggtttcgaagactacctggggaaagggataacctgattctaaatcaatgtaagattgatggaccagaagttacagtagttcttcctaaagacccatctggtgctgggacaatagaatatacagagtctgcaaagaaacttattctagagggttttgttgttaaaccagatgctatgccaggcaacaagaaaaagcttcagcgttttatgccttttagtagtgcgtgtcaaaacggttttgtttatattgttgaagattctttccctaatgtggaaactttaacccacttttataaagaattggaatctttcaatggtgaaagatctacagccactattaaagatgacattcccgatgctgctgcctcttgttttaatactctgtcaaaagagaatactttcaaggcagtagctatccctacaacaacaaatgctcctacaggatacagtagaatgaacagcggatttcaccaaccgtatagtgtccgtaaaagataattgttgacaaaagtcactttaaagtgtattataactagataggtgaggttgtatataatacagccttgccttaacgattttatacctgactggaggaacaagtgtcaacaggaaaaagaacgtacactaaaaagtcagaatactgggacaaaggtgctgcaaataaagctgctctctctccaacaaaagaagcagagaaagagaaaacgttactcctgtcacctgaaataggaacgatcggattaaactcaatcaaagcatttacgaatttcatgcaaccctatgagactcgtttcccagaatgtattcgcacttttaaagagatgggtgaagaccctgatgtagctactgctcttgacgctacatatatctttgtagatagagcattctttgatttcaagataaaatacaatgtaaactcggcaaagtcaagaaaagctgctaagtttattgattacatgttacgcaatatgcaagcccctctacgtcaatatgttagatcacttttgacatataagcaatacgggtttgcattcgcagagaaagtttatgagttggatgaagatcctaaaagtccttactttgggtattggcgattgaccaaattggcttttagaccacaagacactcttcacatggctcaaccttttacatattcggcagacggacgttctattctatctgttaaccagaatatcaccaatacgatgttagctccaggtaatacaactttagaaacgggtattaaagaaattcctttcagtaaagttttatttgttggtagcaacattacagagaataacccattaggagttagtccgctgttagctgtatatcgtagctggcgtgaaaaatctcttattcaggaatttgaggttattggggtatctaaagatttaggcggtatgccagttcttaaggttccaagtgacattctaaacagggcatctttagatcctgcgggggatgaagcacaatctcttcgagttctccaagccaacatcgctaacctgcactctggtgagcaagcctacatggtgttgccttcagacgtttatgaaggcacagtgatgcgtcaatacgatcttgtattccaaggtgttgatggcacgggtaaacagtttgacactcaagcactaatcaaacaacgtaaactggatatttataaccgctttggtgcgggtgtgttgattatgggtgatggtgatgcaggaagttttgcgctttctgacaacaaacaaacactattgtctcattttattgagcgagatgtagatattgttgtagaagctataaactctcaactgatccctcaaacactacgactaaacaatatcttcctttctgatgaagatatgcctaagtttgtcagtggtgaaatgggtgatcctgatattgaagtaaatgctaaagctattcagcagttggtagcctctggtgcgatacctttaaccccagaagttattaacgagtttcttgaaaaaattggttttgaatatcgcatccctgatgatattgttgccaataaagagaaattctttgaattcatggataactatatgcctgacaaaacttcacgatcaggagatggtttagctacagcgggaactggaacgtctgatactgtttctgctctagatccttcagcacaaaacctgtcgaattaaaaatatttaatattttttaatttttctattgacaaaacaacaaatatcctgtagactaagatttatgggatatctgtttttaagaggtttcaaatggaactcaataaagatacactgtgggaactcttcaaaaccttcgctggttttaaagagaattctgaatcccaacaagattctataccatctcaaaaacctgaaactctagtcaaacaaaataaatttgatgaagaaaagatgcaggttattgaggtcttgtattgtccacctgaagaagacgatctccacggagagcgcatgtctgatttggaaatcaggaagatggttgacaacttcaatgagaatattaccaacattagtggtaatcttggtcacatgaagaacaccgataagttttctccaattaaagcttgggtaaatgaagtcgattgttacattggtgacgaactcgttgtggaaggaactcccctcgttaaaatccaattcaacgaccctgaattatatcaagctcgtaaagacggcgttcttaaaggtttgagtataggcgcaatgggcgttaaagtcaagaaggactaatcgtggcaaatacatatttaactaacgtagacttttctggaaaagctacggaagagtcactaggtgctcatattgcttacacttttgattttcaaggtggagcggcatctggttataataccccccttttatttaagtcagacggatctccagacataacttttgaaaagttagaagctctcactaaaatgggagaagatgttacagagttacgtaaaagctatattcaacaagtgatggatcgcatttctgaaaaagtgcgtgaaaaatttgaagctggttgggattgggtttacgttattgatgctgacttcgatgcgaacgttgcaattttctgttcagataacggtatgttctctgttggctttaaagttgacggactgaatgttgaagttgaagaggttgctaaacctgttgttcgtgttactgattatcaagttgttgatggtgatgtaatgatctccattgatttctttgaggacgttttagacgatgctttgagtaatctcgttaagagttccttgaaacaaagtcaagttaaagattatttagtgaaagctcacgctaaagctaatacaaactctgtggatgcagaggctaaccccgcaggtgataaatctgcaaacacaactggaatcaataaaggagaaacccctttggaaaatatcaacaaagaagaattcctgaaatctgctgaattccaagaactgatgaaagcacagatcgctgaagctgtagaaaaagcagccgcagatgcacgtgcagccgcagaacttgaagcacaggaaaaaatcgctaaggcagaacaggaagcagaagaacttcgtaaagctgaacaagctcgtatcgaagaagaatatacaactgttgttaaatcctattctttcgtagaagaagacaaagttgaagctctcgttaaatatctggtagacaataaagatatcgctgaaactatcgtcaaagcattcgaaaaagcacgtgcagaagtggacgcagttaagaaagaatttggaacagaacgtggtgttgacgtgatcaatactcaacctgtagctaaatcttcttctgaactgattagtcagaaagctgctgaacttaaaaaagcccagaaacaataatcttaggagattaaattaaatggctaaaggaattactttatctaactctcgccaggaattcggacacctggttctgggtggagtgtttagctctgaccttggacactgtgtacgtgaagttaacctggttaaaacagcaaccatgaaaattggttctatcctgaaagctgacaacactgaagctgctaaagctgaagctgccgatgctgctaaagttctgatttggactgatgctctgttcggtattgacgatgtagcagtaggtgacactttcaccgcagttgttggcgtacgtgatcttactctgaaccgctttgcagtatactacaaagatggctccctggtagatgacgctggcgtagcagcactggaaacacatgatctgaaactgaccgaaaaagtcgttttcacttcttaattttaataggagattaatataatgccagcagtaattttagatcaggttgtagatttcagccctatgatcgaacttcaggattcccctgatacactgattgccagcctgaatctgttcagtgttgactatcattcaactaccgctattgaaatcggtaaagaaaaagctgaagatgctctgatctccgctcgtgagcgtggtggtgagcgtaacttcctgaccatgaaaaatccagaactgaaagcgttccgcattccgttcttccctctggataaaaacatcaaagctcaagatattcaatctttccgtagctttgcaatggcaggaatcaatgactctctgcgcacagacgctgaagttgttaaccgctatatgtcccagattctgcgtgacgtagcaaaaaccaaagaaaaaatctttgcagaagcagttatgggtcgtgcctataacggcgtaggtggtgcagctaactctgcatacaactggtataccgaatggggtgctacccagaaatctgttgctgtagactttgcttctaccactgtttctccagcagccactatcgaacaagaagctcgtgcttacatcatcgatactaaacaagatggctctaccgctacccgtatcgtagctctgtgttctcgtgagtttttcgcatctctggttaactctccatttgttcgccaggcatatcagtatttccagggaactcctaaccttctgcgtgaccgccttagcggtaacatggatgttcaggtgttcgaatggaacggtgtaacttacattgaagatatccacggtaacatccctgctggtgaagcatatgttctgcctatgggtatcgaaggtatgttccaggcgcactacgctcctgcggatactccagaactggctaacacccaggctcgtgaactgtataccttcatgatcagccagcaccgcactattcagcttcagtctgaattctcgctgctcgcagttaacacccgtccagaactggtagttaaactgactacggcttaatagaactctgttaatattagaggctcgtccgtgatgggcgagccttttctgtttacaataagagtttacaatgaggagattgatatgtcaaacccagaattgaaacgttactttagttatcacgaaatgattcgtgatttcgaatcgctttcaccactgatcgatgctgataaaacattagtatctgcgccaccaatgtctttctatctgaaagatggtcgtattgcattaggtggaaacttcattcacttcctcacgcgtttgagagaagaaacaggtattcttgtgcatccttttgcaagtgaagaacacatgggttactatcttgtaagttacgaagactattcgcctgtaaaaatcaaagaagaagttttaaaagtagaagcggtagacactccagctaaaaaacgttcccttcgtaaaaaataaggtgggcttatgctgaatgcggtagagttggcaccactgatccgaattcttgtttataacccttctcaagaagtattgccagatgcgatgctgattcagatcatccaaacttggattgatattatagggaatgaagataaggataagtgtgcagtattgtggaacagcttgatttctgttttagagtatttatggaacaacgatgttcttaacaacagtactcaaacaggaggagctatgtcccgcagagaaaagatgggtgaagtcgaagttgaagttaaatttaacaacggtcaagtcacttataaatctccgtgggaagatatctatcataactatttaaatggtcttatggtgatccctgggtgcacggcaggacgaggagcaaccagcaaagttcttattggcggtgtggatgctcgtgagattgatcgagtaaacagcgatcctaactctgtaaatggtcttggtaatgttgcaagtgttgatcgtaatacacgcaacgttaattatttgcgaaattacggacctgtttctttttatcgtagggacaaataatggaaagtgagatcttaccaggtgacgatacagattgggaaaccattatcaaaaagatgatggaccttgaacaagttcaaatcgaggctggttttttaacaaacaaaaggcatcctgaatcagatctcactattcctgcaatagcagctattcaacaatatggtaatgaaacaaataacatacctgctcgcccttttataacagatggtgctgttatctcacagaacaatatcgctaaaaagatgaagcaggtgtttgcaaattacttactgaataatgtcgggttagctgtttttgagcctatagcgagagcctctaaagaaggaatagctcaagcgattgcaatgcaacgttatcgtcctttatctcctgtgacaattaagatacgacaagataaaggcaactattctaatcatatcttaatagatacggcacacatgataaatgcaatcgaaacaaaaatcacaaaaagcaagtctaaaaaataacttgcataaactttgtttttgatgtatactaaaaaggagatacaagtgttactagatcaatttactctccttgatctaactgaataccaaggtcgtagacgagtctacaaagaggcagttggttcagttattgctaacttagaaagtagtgtagaatatgaaccatttaccattgaagcggcaagcttacaaccgatatctggtaaaacactgaatgcactacctgaaggttacagatctaaggctcaatatagtttctggactaaaacagaaatgaaggggttacaacaaggaacagaacagttatcagatcaaatactgatagatggtaaatggtattctgtttattcccttaaagattggaccagaacatctttcttagtccatcatcactgtgttgcaatattagacgatcaaaacaactcctggtcttatggaacagaaggaggaaactttggctaatatttaccaacaaatagaagcatacgaaaatgccatctacttaaatataggtggcttccttcaagaattagtggggttgccagtctatgttatggataagccattcattaaaccggatactccttacctagcactacgtattatcacttccagcgattctggaggttggtcttaccgaagctctattcaaaatgatatgtattcctacgagatggataatacctacgagattgaacttgtagcctatcgtggaagacctaccactttgatgagctatgttctggctgctctccgtggtgcagaggaattaaaatacaaacatctctattctaaaggtcttggttttttaggagcctctaatatagctcaagccaatacaattgtagacggagataagactgaattaagagcgcgtatggttatgacgttcaacactcgtatgagtattgaagatattgctactacaccaatagaagcaatcaacatgcacatccgttcattcagagatagttacaatgatcctatccctttagatttaattttaaacagggtttatgcaattactttggttccaggcgaatactcgtcagtcaatcaaaatggatcattatttaacaaccctaccgaataaactcattggaattaagtttctaacaggagcataaatggcaacttttcgtgaaaaggtagcaaccgtaactttactgtatggtgctacatcaattcgtgaaacccagttcgatattcccctgatccttacaggtcagaacgtaactggcgaagcgattcaatattactcttcttccgatgcacttttggaagcaggttatggattaaatgatccagcgtatattatggcagtcaaactgtttaacggtttgttcccaccagatcaagttatggttggtaagcgtgaagttacaaactttactctaactccaatcgtagaagatagtgcaacttacacaattaccatcaaaaatggtaccaagaaaaaagaatttaaattcattgctgatgatactgcaactgcacaagagattgtagttggtctgactgaaatgatcaatgcagatcttgtttatggcccactgtttacagtagctaacaacggcgctgcaatgactttcactccagtagaaggtaagtttggttctattgacagcacaggtttcactcaagaaactgtctatgctaatgctattacggaagatattgctgctctgcatgatattgatagtagctggttctggaccctttcagattcccatgaaacagaagatgttctagctttggctgcatgggtagaagagaatgataaagtttacttcttctctagttctgaacctggaattaaaacgaaagcagaagataacgttctggaacgactgaatgacctcggttataataacacttgctttgctttgtggatgaccgatgcagattctgtattcccagaagcagcagttgttggtgcaatctgttctcgtcaacctggtttaactactcttcacggtaaaacactggtaggtgtagagatcgagaaactggatcagacttcggaaaacaatattgttcaacagaacggtaacatctatcgtaaagagcatggaactctgttctatcgtgacggattgatggttagcggtttctttgttgactatgttgttcatgctttgtggtttaaagctcgcacagaagaatcactgtttacactgtttaaacaacagtctatgctgggtggtggtgttcgtgctacttcaaacggtctggctttgattcgacaagctgttctggctaacccgatccaagtaggtatcctcaacggttccatcgctaatgaagttgttacttctgaagagactggtttgcgtgtcgatctgaaacctattgtttatattccttctcgtgccgatatgactgatgcgcaaatcaatgctcgtctggttgatgggatgaagattgaatatgtttacgctggcttcttccattacgttaaagttcaggtcaacgtcctgactaaccgtactgcaaactaatacggcgggggttaagcccccgttatcaaaataaagaggatctataatggataaaatgcttactggcgtaatggcctacgacccatctcaagttatcctttcattaggtggttgggaaccgtggggttttgcggctgatactaaaatcgttattgctaaatctaacgatattatcaacccttattcagggactgatggcgacgtttcactggctttgagtcgtaaccgtttgggaacactcacaatgtctttgcaacgcacatctccagctaacgaagtacttgcaacatatgcacaaacaatgtattctactcgtcaagtagcattcagtgtttacttggaagacccacgtggctattacattagcacgattggatggattcaaagtcagcctgaagatactattggcgaaatgattacagagaaccaatgggttattggtcttaaagatgcaagccttctgcgtaatgaagttggtgtaggtttgagcacccttaactcaatctctgctctgacaattcaataataaataaagggcagaaatgccctttttatcattagagaggaaaatatgtcacaagaacaagataacacaattcaaaaatatgctcgaccagaagaagtagttgagattccgttagatggaaacagatctgttactttccgtattatgaagtggagtccatctaaagtgtttgacaggattccagaattgggtagtgttctggttgttcctatgactatgtatagcacagcaacaatgtccgcagacgaagaccttgagtcacgtattgctatggcactgatccaactttttgcaggtttggaagaaaagaatttaactgtctttttgcgtaaaattttagatgaggtttatactcaagacggttataacgttgcagaaaattttgatgaattatttatggctcacccagaactagtgttagatcttacggctaaagttctggaggtaaactacggcccttttttcaaacgaggtttcggaaaactgttcacacagcttcaggcgatgacgagtttagcagcaaattaacacctgcgattgaacatgctatcgacacagcaacgaaaacccttactttgaagtggtatgaggttattctttgcaaagtcgttaaagatacctcggaaacactgaaaacattggataactacggtgtagattatcttttaaaactatatgagtatttaacatacgaagagtatgttgaagccatgtatgttaaagacacttcaataaagagaaaacatcaaaaccagacaaataaaatgtcagatttgtttaagaaacttgtttaatccaacacgaggaacatactttgttagaaattaacgcctccaaaattagtaacgtggttacgtttaaggtggacaagaacagtctcaaggaagcaaaagatgccgtgttgagtgttcagaagtttgcaaataaaatgcaacccactatgaacatgaccaagtttagacaacaaatgaaagagattgagcgtgaacttaagaaagctcaaactcaaagtcaaaaacctatgcgagcacctactcccgctggagcgggtgctcctgtaggcggatctggtagacctagaactcctaaaaccccgcaaggaagagaagaagaaaaagctcgtaaagctgctgaacgcgaagctaaagcagcagcacgtagggaagatttaggtaatcttcgtttgcagaactttaactacagagcaagagcatttagtaaagccagtcctggcgctatgcaagaagctagagacgttatgggtaaagctgtagagcaatacaaaaagggtgaaataactcttcaacgtatgaaccaagctcttgctcaccagttagatgccttacgcagatctcatcgtgaaaagaatgctgaaatagaagacgaggttcgcggtcgtcgccgtattcgtagagagctagaagcagaagctaaaatgcgtatacgtatgcgaaatcgtgaacttagagatatagaacgcaaccgtaagcgtgaattagctcaacaaaaacgtgatcgtgatcgtcgatatggacaattaaaagaaggtgcagcaggtcttaatccacgcatgattgcatcctctttaataggtgctgggctgtttgcaggtggttctgtagttggtaacacgttgatgaatactaacgaaagaattaaacttgtaagtcgtggtgctgaaaacgttcagacaaacgccaacgctattttggcaatgacagcttggggtgaacagaacggtgtagactctgcaaatattattaagtcaatagataatattaaagacgttcgtgaacgtcttggtaatacagttttagcctcaaaatggaatgagaaagaagggaagtggaaaggcggtgataatggcataaatgacattatgaacttgtttggatggaatccagaacagcttaaacctttacagaacgatcctttagcttttattcaggctactgttaatgaaggtgagcgtcgaggtatgaactctgctcaaatcgggcgacttcttgaaaaccttggtgatgaccttatgcactaccaacgtatgtttagtaaaaacggcgaagggtataatgaagtattgaaaatgcttcaaagaacaggtgcaacattaactcaagaacaaatagatgcttctaaagagtttactcgttttgctgcaacagttcagcttgtaggtcaaggtatgcagaaccacttcttagagggttttgtgaaagccttacctaaagatgattcttggttggataatgttaaagtgctagatcagtttgccaaagatttaggtgaagaactcggtaagacaacagttcaattaggaggttttgctaaagaattgggagatggtttcggatcttttaccaattggcttaaagaaacattcccagatacattcggagataacacagatcctaataaatctatggcacaaaaagcatacgaggcaacgcaaagtggagacagcaatcctgtagcagattggttgtacaatttaacaggtattgatacacaagatattggtcgtatgtggagaggagaacaaacaaggacacgtgcttttggatttggtaatcctcttgaagatttacgtgaatcagcctatacacctaacgtaagtttagctcgtaatcaacctgttgttgagaatacggtagcaataccaagtgatcttatcaaagttacgatcagcccttcttcagagtttggaaatattcttgatgcaagaattcaaaatagcggaaatagcattttccaacgtttgtctctttcaactctaagtggacaatctaacactggtggttaataaaatacctcgcttcggcggggttttttcgtttcccttgacacgaagtttctatatgtgttacaataatcaatatgggaagatcttgcatcttccttttggcattatcattactacgaggttatcatggcagcaatgactccacaacagtcggtgagagccgtctataaggcagaacaggaaatcaactctaccgagaataaaaatacctcggcatctactgtaaagggtgataatggtttctgcattttagcaagtgtttataatagttcaagtgatcaatacattcaaaactttaaagcaattactttcgattcggtccctgaagtaggtgtaactcgtgaggcagatgttacaagttttccagtagaatcaggatcggatgtaagtgaccacgttcaaataaaaaacaacagatttaaactttcaggtataattaccgaaacaccaattcggcttatgcgagatcaattatacagtgcaggtgtaaatggggcaaggatttctcaagcaatagaatatctagatcaaatatttgagtcaagacaaccaatagttcttttgacagaacacaggacttttgaaaatgttattctcaaaggctactcttatgattataaatctgaatttgctatgcaatttgatttagagtttgaacaaatccgtctcgtttctaaggccactactaatgctattgctgtaaaaacagcaccaaataaatcgactggtggtgatgtgaaaggtcaagttgcttcgaatggtcctaagtcagatattacagtaagaactgctgaagctactaataccccaacaaacaacggaggttaatagtgacaacttattctaaaacaacaaggtctacaagtaatacaggctacagtgcagtttatctagaggaccattctacttattttgcatggtatctgaaaactgaagagtatcctgatcaaacatatacagttacattggatggagttgattatgacattcgtttaaggtggaacactagggacgagtcttggcaatgtcagattggattatctggagatgatccaagtataagtttcaaagttacaaatggtttagatcttcttaaaccttataaatatcttgaaagtgtgccagatggtcaattgtatatagtagatacagttaagattaatggtcgtcctgggtatacaactacaggtcgagataaacgttttgtattggtttatattgataacaaacctaatcaggcgtaaggagataatatggcagaaagagagtatacaaaagctcctgcccctaatttaaacagggcatacaaattattaattggttctgccacaaacacaatacagaagagaactaagaactcggcatttaaatctaccgtagatttggataccaagttaggaacaacagaaaaatcctcttctaatttgtatttgttgcaagaccatcaaataaccttcagtattaagaaagataataacaaagatcctaaccaagcagagattgtagtttataacctttcggatgatactgttaactatataaaccgtggtatccgaaataacttggctgttgctttagcggtaggatacgaaggtgaagagttggttatggtcttcaaaggaactatccagtgggttagtgatacttttgactcggtagacaggaaaaccactttacattgtttagatggcggtattaacattgcagaagcaagaacaagccgcagttatccaaaaggaactaaaatcaaacgtgttgtgacagatttggtaaaggatttaggaactacagaaggtaatatacacgtagataatgatcaaaccttatcctcagcaacagctatgtgtggaaacacttcacattacctagaacatatttgtaaaagtattgatcacaatgtgtcaatacaagatggatctgtttatgtcactcctcgttcacaaatgtctagtgcacgtagcgcctacattagccctgaaactggtctgataggaagtccagaaccattccacaacgatataaaacctactaaaaaagttaccaagtcatctaagaaggcaaagaaacctacagatggtgttaaattcaaatgccaaatgaatggtgcaatattaccagaaaaaacaatctggttaaaaagccgagattatgatggtccatttaaagttgtttctgtttctcacaatggtgataaagagggtaaagagtgggttactgaagtggagtgtgtatccgtgtctgaaataatgactaaggagaaataatggatgcattaaattttgtcacagcaatgcgtggcttaatgacagaacaattagcagaagtccatacagccctgccagtccgtgtgactggcgttaattatggtgctaaaactgtcactttagaatctattgttaaaaacacacgatctagtgaagatgaaatagattaccctacttttgaagatgttccttttatggttaatgggggtgggacaggaagaatctcattccctattaaagctggcgatttaggaactgttatattttctgaaagagatccttctaatgcactgcaaactagtggagaaacctcttcatcatccacttttatgcagccttgtggattataccctatttgttttattcccaaaatagctacaggaacagattcaacagaagctgtagattctgaaaaggtagttatttctaataacaaaaacacgtacgcttctttcgaccctacaggtaatatttcaatatggaatagtcaagggatgaaaatagatattactacctccggtattactattacagatggcacagggactttggatctaaaaggtggtaatttaactttcaaaggcggcgtggcagatatcaatggtcttaaaatagatcagaacggtttgatgacagatggtaatggcatcggattccatactcacacgcacacggttcgtaacattcagagcggtagctcaagtgccgagtccttaaaaccaacaggagcctaacatgggaatcccttttgacttaaagcttggaccaaacaacgacctcatcatggatgatggggatttggtcctcactacaaccagaacagaaattgcagcacaaactcttgggataactctgaacacgtatcgtggggagtggtttttaaatactaacttcggtgttccttacttacaagagattattggtgttgccagaaagaaagatattgtagacagaatatttttagcagagattgccaaaaacgtttacatagatacaataaacagttataaatctgcttatgatatggatcaacgttattactcaatgacagttatggtcacagttggagcagatacagtaacatctatattcaatactcaaccttctgaagagtttatttaccctgaagctggtgaagacaatgcagcgatcatttgtgaagcttacagtattgttgagaattcgaatagactttatcgctttatcaactttgttggtttgccacgtgatacctactctacttggtggaatgaatggtctacagagtcagcagtggaaagaatcatggttaacgaaaaaggtgatgcattagctacaaacaataatttcggtataacagctatgacaggagtagaagagtaatggcagatttaactacgatcaaaatttctgatcttacacaaacaacctctgtgtctgatacagatttctttgtaacagatcaggctggaataacaaagaaaacttctttgaaagtgctgttgagtggtgcaggggtaactagaaaccgtttaaatgcacgtggaacagtaactagcaccttggcattagatattagttcggcagaatatttttcagcaactttatcttctgcaacgtgcacaattagttttactaatattccagtagcaacaaatgcagttttaaactttactttagctttgcgtcaaggaagtggtgcaaataaagtcgtatggccttcttctgtaaaatggagttttggtcgttccccagttttgagttatcgtcaaggtgcaacagacacttttgagtttatcagttatgataatggagcaacttggacaggtagcttagttttagcaggagttatttaatgtcaagagttaagcacaatattgacaacacgtttcagttgattgaagggttggttcagtttttggaaagaaatactgggcttaccatagatcctacggttcagcattacattatcaacccacaaaacgtattggcgaacaacagacactttattaactggacagcgcaggaagggcaaccaaacggtgacgctactaccgaaggtcaatctgtgcttatcactggttttgcttatgcatatttggctacaggggataaaaaatatcttgaatctgccgagaagtattggcaagcctacatagatcacttcttcgggggccaacctattcctgatcctccggctaaatatcgtcccaactggatcatcaatggtaaagaaccacgtttagcacattaccctctcacagatgatgggtatcctacgcacggtgggttcaaaggtagcatgatgacttggattaacggaaggactgttattcctaaaggtgcgccacactggggagaatacttagataaagcttggtttgctttcaatggtaatcttggttggaactctgttaacgcaacagtgtatgcaactaacccagacggttcaaccaactggaaagaatatggagatcagtgggacgttgaatggattatagaccgtctaggacgtaaagttgattgggatggtaacattttatctattggtcatagctttgcagaatatggaacagtacaacttaaaaatgcttctgtgaacggggactataaattcaactacgctacatgcaatcctgtagaacacggtggatatctgcttaagcgtaatgagatgtggcataaccgtcctgtaaacgttccggtagagttaggctatcaagataatgcttccgatgctgaaacgtggtggtgtgatgcaaactacttgatgtatcagatcacaggagagagaaaatactggctttgctggcaatcttctttattgttgtgtcaagactactcaaacatcgatatgtttgataaattcttccgtagatctacgacagcaataattccttttacagatggtatctcgtatgattactcatacccatctacagcaatacctaaatattctcgtgacgaattaggatacacagtaattcgccaagatgtttcagcacaaacaactctagaacaacaggcagtttggttcagagtggatcagaattcaaaacttcgtattgagtttcaaggtgtagatgatgcaggggaaggtgttcttttccgtccagagttagaattaagcaaaactaagagtgaaacagatacagttacatatcgttgtggcttacctcttggtgcagctaatatgactaagatggatatacctttatccagttttatgcgcactgaacctcctggaggcggtgtatatattattgctgaacctagaatcattgttgactggggaagcaatactgtgatacaatataaatatgcaactggtattgctgggacaaatagtgatcagatagtttctgctaatatggattcagatggtggttttactgttgggttttggttaacaccaactaaaacagccaatttaaaatctattacatatcgttcatacgcagatgattttaacatcactattacggattccgcaggttggagatggtgggccatgttagaaaaaacaaattctacatgggttactaaagctttaagtcctgctgatttcaaattaagcacttggcaacccaatcataacgacacagagacaaaaccttcgtcaataaacctgactgctgttgatcagatcaacattgcattggattctgaacctgcaaatggcttgacaggggcaatcgatttttattgtgttaacgatatcccatctttgtattcttcagccgctggtgatgattacacaatgtatttcagggttacagtttcatctgaaaatccttatacagcaaaacttggagattgtacaatactggactacaaacttgacagtttgaattatactccaggaatcattccattttccaatattagtgatcctaacacagcattatatgacggttggcgtggtattccttacccaggttatcaatacccatccttatattgttttaaagggagagatattgactgggttcgtatgaacaacagtatagactttttatatgattcacaaatgtggttttataataagtttgcccctgtaatgcctgggccaatggcacaagcttatgtttgggatcgttgggatgctcataaatatggaaacaaaaatgagttcacaatgtatcattggaacgataaagcttgggatggttatgaagcacgagcattcttctgtgcgtgtcatacggtatacgaactaaagcgacaaggagccgaagttcctgaaaaacttttaacagtttgtaaaaactggatcaactacctgaagtggttccaagataacaacgaaggaagaacaccaacaatattttatcccaacggagaagtggctgcgcctgtagatgactttacaagtcacatgtctgcgctctttatggcgggatgtgctataatggggatggctggatatgattcagaaatccctaacattaaaatagtagcagaccgctgttttgaacttattcaggaaaactatattgttcttggtcctaatcacgttatgaatggttgttggagtgctgctcctagaccagacagtgataacggagtcttctttggcttccacgctggagagttgttacgtggttttgggttgtatgctttatacaaaaaacttaatccccaaaatgcattacctgttttggattcgagcaatattcctgcacttactgttttgacaatggcaaacattagtgtggacgttaccgagtaaggggtaaaatgaaacaagctatatttactgtcacgcgagacaagagagtaaatgcgagttcatttaactacacgactgttgacggaacagcagtcgctggtagagattatattgcaaaatcgggaacacttgtgttccctgatgatgctgattctgctactattgtggttgaagtatttgaacgaccaaagaactcaatagatcttaacttctccctccaagtttcagggattagtcaaaataacatgatggttgaaacaaccatcaattgtattataactactatccaagaaaatactactccaataacttggactacaaaagacgttaaaatgttctctcctatgtattggacaatagattctcaagcaacggaaagttgttctattgtatctcatggagactcttttactgcaagatttgtaaacagaacaacagcaggtttggcaggggttatctggagtacagttgacaaatatgaccataaaggtgttgggtatttgcctcacacagatttaagttcagagaaactttggtttaaaatggaaattagtcaaaacatgccaggttttaaagaagaacctttggtgccgactttgactgtaactctcctggataaaagtgttcattatgtcagtttaggattctacgcttcagatatttcagaagatggtaaaacagcaacaataaagttagattttggtaatatcttttctggccctaataatgatattcctttggatatgagtgctgtagataatattttcttctctttgattacagcaaggtatgaagaaatagaagaggttgtacctattggcagtcaagaggcttggtttactttcactcttcttgaacctacctctggttatagtatgatgaaagtcagcaaccttgtccagcctgaacatgatattcgcatgtgcacatcttatgatgatatgtataacctgactccagagagagttatttataatacatatgcactaggttatcgtggaatgattaaccattacaacggaatgtctcactattatgagttctcatggaacggaacatcttgggctttaaatagatctgtcttcctgaatccagctacagaagcttggctaaatagtttccattctatagcgaacgagaagggttacacaataatgaactctttaagttttgagttgatgagcacagtttgtcctgttgaatgggtccagcatgattggaacgatgctcttgcagcaacagggtataagcctcctagttacgtgttgtctccaactattgacgaaggcatggaatatttgcaaaatgttattaacaaaatagcatctatttctcaagctaacaatattccagtcgtcattcaaattggtgaaccttggtggtggtataatacagcaagtaaaatgccttgcatatacgattacactaccaaactggcattcaacacagaaactggcttatttgcacaagatgcaggaacaatagataattataaaacaggaacgccgtttgacgaatattatgcgtttttgtctcgtaaactaggattaagagttacaaagtttgcaacagatactagagcatcttacccaggagctaaagtaacattgcttccgttcttaccatcgattatcggcaacggtttgatggagaaagttaactttccgtctgattactacattcctgaagcttttgatttttactgttcagagtgttacgactggcttctggaaggtaagatgatgaaagcatttgatgcaattaccataccacatgaaaaattaggttttgaatattctgatattcactatctttcaggttttgttccagatgctactcttgcgcctttgtatggcttcgatcctgaatcaaactaccgcacgtatctttggaaaatgattataggtaatatagtgttgaacgccaacaagtttaacggacttacacaatatatatgggcctatcctcaaataatgcacgattccattacggtagttaactctcaatcccaagttttctatatgggtaatgtgcctttgaattgttatttgcaagatatcaatcttaaacaagcaaatgttgagattgctaccataagtggaattacattagctactaaatctggagaagatttagtaacaacacaaaaattttatatataggagtaaaaatgtcaactacaattactaatttacccgaaacatcaaaagttaatgattctgattacctggttttagaccaacctgataagactgttaaaagcacagtttccaactttcttactgacactggggtggttttagccacccagttgaaagatacagatggtgctaccaagtatccagaacttcaaatgtcacgttggagagatgaaggtgatcctagaggatggggagcagtaggtgacggagcaacagacgatactaatgccataacacagcttcttgctgctatgcctgatggatggattgttgatgggcgtaatctcactttcaaggttacaacactaccagatataagcaagtttaaaaacgccgcttttgtttacgagcgtattgttggacaaccccttacttacgtatctgcgggtttcttcgatggaaatctgacaaaaattacggatacaccattttacaatgcttggacgcaagataagacgtttgtttatgacaatgttatatatgcaccatttatggctggcgaacgtcatggtgtacaaaacctccatgtagcgtgggttaaatcaggagatgatggacaaacttggtctatgccagaatggttaactccaattcatcctgattataatgcctcttcagcaaacaaagttaactatcattgtatgagtatgggtgtatgtggtaatcgcttatatgcagtgatcgaaacccgttacttatctaacatgcgattgaagaaagcagaactttggtcacgtccaatgccttattatagaaggccaactggaggcataacaattagttctgggtctactacagcgacaattgttttagaaaagcatggtcttaaagttggagatgctgttaacttttccaattcaggtgcaactggcgtatctggaaatatgactgttgcatctgtaattaacaaggatacatttactgttacattagcgagtgctgccacatctaatatagataatacaggaactacttggcattttggaacacgtttctgggatagcccttgggaaattacagaattaccagatgttgcctattctactaatgcagatttatgtgttacagaaacccatagttttacagttatagatgatgataattacacttttgctgttggttatcacaatggtgatgtttccccaagaagattaggtattttgtatttcaataatgcttactctgacccaagttcttttactcgtagaacaattagtcaagaatatgctgacaatgcagcagaaccctgcattaaatattatgatggaattttatatttaactactaggggtacttcaacttctgctgctggttctacattagcaatgagtaccgaccttggagaaaactggaattacttaagattccctaacaacgttcatcatacaaacttaccatttgcaaaagttggtaactacctttatatctttggtacagaacgttcattcggagaatgggaaggagaagaactagataatagatataaaggcacgtatcctcgaacgtttatgtgcaagattaatgtatcttcatggcctacatctttatccgatgttcaatggtttaatatcactgatcagatgtatcaagggcatattgttaattctgcatgtggtgttggttcggtatgtgttaaagatggttggttatattatatctttggaggcgaagatttcttatctccttggtctattggagataatagtaaaaaattatggtacaagcatgatggtcatccagccgatttatatagttatagactaaagattaccgaacatgattttgtatcacgtgatttcaaatatggagctacgccaaaccgtacgttgcctgtatctatgggtacagatggggtaaggcatgtctcagcccctgtaacttttgataatgatgtacaagtatactctttaacagttactggccttgagcatgatgggacgcaacaatctgccgttagaataaaattagacggtgattatggggttgttgcaaaaaatgtcccaataaaaaatccttctgaacagcgactaatcctatgtggaggagaaactccttacgttacggatggatcgctattacaactatatggttcaaaccatacgtatccaaacagagcagttttatatgccccaggaggagcatatacccaaaataatttcatgccgtatttagatggacaagttgcattaggcggtgcgtctaacagatggtcagaagtgtacgcatctacaggaaccattaatacttcggatggaacattaaaaactaaacctacagagattgaagatattttactgaaagcatgggaagatattcatgtaatctcttaccaatggcttagtgctgtcgcggagaaaggagattctgcgcgtattcattttggtgttatagctcaagatgtaagagatattctgattaattatggtttaatggatgaaaatagcactgattgtaagtatgcttttctgtgttatgatgaataccctgctatgtacgatagtgttgttacgggacaaaaagaaatccctttatttgatgatgaagggaatgttgtaattgatgaagaaggtaatccagtaacaatcgtagaagatgttgtagaaactatcgaaataattccagcaggatcgcgatggggtatccgcgctgaccaaatgttttttattgagatggcttatcaacgtaaaaagttaaaagctcttgaagaaagacttgcaaccctggaaagtaaataatacagcttaggtggtatttcaatctttatatctcacttagaggtactcatggctaaagagaaaaacggttttaaaaaatttattcgcggaatgttctgcacttaccccggcaacggggtaagctctacgaaagtctggaacgctgtaggcatgtctgttatgacaggcatgtttatctttttaggaatagaaaaagaaattcctgaatggatgggttgggcttttgttttcatgataaccccttctcgcctcatgaaaaatcttattgatttacgttggggcagatcacaatctactaaagaggatgactaatggacgaatatggtttgacagatgcgggatttgtaatcccgacttttgacgatgttttaaacaactacatgacagcagtaaaaaacacatttggtgcagatgcagccacttcggaagatactgtgatcgggcaactgtttagaataattgcatacacagattacacattgtgggaaggtatgcaaggtgtttataatactcaaacactggatggtgcagaaggtatttatcttgacgaaatcttttctaaacgcggtttctatcgagcaggggcagcagcaagtacaggttatgcatatgttaagagcaataacaaagcagcttggacttatgagctaggcacggatatttacttcaactctgacagtgatatgaactactatgttagcacaccaactatgttgaatgctaagattgcagcttatcaaatctctcgtgctaatgcaactgctacaggtgttccaaatattactttttatgcacaaagtgcggtggatggaggactaaacagtaaaacacttgcacctggttcttctacatttataacagatcttgaaacttttatcaaggcgaatttaacagaagctgatcgtagtcttgtattttctgattcaggtaacttatcaattggttttacttctttaaccagtgatactccagtggggctggtaactcctattaaattttatgctagtgttccggttggaaccaagtggagtgagattccggtagttgcagcagagaaaggatacaatcctgttggtgtggagtctattacagggatatcttctacctttacaggttatcttgacagtggtaacttctattcattttctcctggtcgggatgttgagacagacgcagaattccgctctcgtttcaatgacaacgttgatgaagctaacgcagggacacgagcagctattgtgaaagctctgctacttacagatggtgttactaaggtgaagatttatgataaccctacattacatgatcaagaacatgctccagctatgactttccagactatagtttatggtggcagtgcagaagaaattgcaaatgttatctataaaaccaaaccaatcaacactttgacacacggaacaactaacataacagttacaacagaagacggaggacaagaaattattcgcttctctcctggtgcttctgctatgtattccgtaaaacttgtttatcaaactgtcaacggaacaactttaagtggaacagaaaaacaaaacatcgtagaagctctacaaaacctgcaagcttactttgagttaggttcttcagtaacgaacgatcaaatcaaaggtgttatttatgcagcacttgcttttggacgcttgacttctcttcgtgtttatgttaaacttaatactgaggatgacagtaaatatacagagaataatatagttcctgcttataatgttgtcccttcttttgaccttgataacatttcttacgagtatggagtgtaaaaatggcagtgagtgttgaccatgtaacaacttgggccagtatcaatgaagatgttaaaaaccttctgattgaagattttaaatcttctcctaacattgtcaagctcctctacatcgtatccagtgaaaagcaaaagatagatcaggcaatgatctatcttgctaaacaccgcttgatctccacagccacaggcaaatacctagatatcttaggagaagaaatggggatcgaacgtaatggctctgatgatgaagagtatagaacaatattaaaaatcagggcttaccgcgtagcctcatcggggactcgtggtgacataattgatatcttcgcccgtttcacaggaacagagcgtgaaacgcttaatacttacgtaggtttgaataaaacctttgatgtgtttttctacaacctgtgtcttcaatctgatcaagctttagagcagttgctaagtgttttccctattattagtagctaccgtcttggagcaaaagcaggatcagcttttggttttagttcttattatgctaccaaaccgcctcatggtattggtggtttaggttccctgtacatggaatctactggggatgaaacaggacgcatgtgtacgcttctcaagcaaatagattaaggagtttaaatggcgaagccaatatattatcctgactgggctacacaaactgtaacgctcccaggaactttaaacacaaacaaaatcagacctaaagaaaccatccgcacagttggtatggattatggtcaaatcatgacttgcgaagaaatgaactggattcttaataatatcggtttatggattcgctatttggtggatgactttcttccaactttacctgatacttacttgcctttagttggaactaagattacaatggcaggtgatgctactggtgaggctacttggaatggtaataaagaagttactttatctatccaagttcaagataacagtcataatcacttgtcggcaaacattacagatgctactagttcaacagtaacaccaaacgtgttggtaaaacgtgatgcgggtggtgctatttatggtggtgatgtttatgttaacggtacttccacaacagatcctgcgacactgtttttcaaaaactttgcaggacaaactaatggtgagatttctgccgaataccaaagtggaggtcagctttatatttatcgtagaaatcctagcacaggtagtgtatcagcaggtgttcgtttatatgatgcaggttatgttctaatagacagtccaagatcaaacagtggacaagatacttctaacggaaatgctttagttcgcttagattatctgaattctcgtttgacttctcttcagaacacattgcagacgaatattaacactgttcaaaacaacctgaatagtgttaacagcaacctctcttcccgtataaacaatgtagaaagtaatcatcaaagtcagattacaaacaactacaactatgctaacggaacctttgtaagagatattcgttacactagccaaggcgtgtattatccaccagggaacgaagtttcttggacttatatctgttcttctggttatgttctttctggtattattgtccaggaaacagggcgtagttctgcggataacatcggtggggtttatttcaaacgcctccagcgcaacgttaacggaaactggtacgatatcggaggctaaatgatatttacaaattttaaaagatatattcccgaagatcccgaactaaaagaattggtagaagtagagaacattctttttcttcgttgcgatcaaggttacgattggtatgatttacgtagcacagaattcaataacgataaaatgaaagtcgtttttgacgatcaaaatcgtattgtgttttggaacactgatcctacattactttgccctgaagatctttctatagcacaagtggactttaatatagacacttttgaggatattagaaacaaggttctggatttagaaactttgactcttaaggataaagagtattcccgcgaagagttgatgacacaagctagtgcaaaaattcgctctttacaagaaacagcggtagcacttataacacctttacagtatgctaaagatttagaaatggctactgaagatgaattagcttatcttaaaaatcttcaagtttatgtggttaaactaaaccgtgttccgcttcaaaaagactatccttacactatagattggcctacattaccaacggaataagggatcattatggaatttcaagaagcatggggacttgcaaaggatgcaataatccctttaatcggagtcatctggttctttttcaaacaaaaaatggataaattcggctctgatcttgatgaaatggaggagaaaagtcgagagctagagaagaagttggtctttgttgaatcaacttatgcaactaaagccgaacttacccagatgctaaatcaaattaactctacattaatggcaaataataacactcttgagcaaaaaattgaaaagattatggacctcaagaatgcgactatccaaatgatgctagatgacatagttaaacgtacacagaataaggggtaattaatggcaacattcccaacgtatccagcaacgtctcttgaacagggcgtagatctggttattttctcgtccaatcaacttcatgatgttattaatggaagtgcgacagaaagtattgagacagaatcagggttgataccaaccctgagaaaagcccttgttgataactttttctttaaaagcccattggattgggcgcaaggcacaaatgaaacggtttttaaccaactacgttattttcagaatggggtattgagcggttattattatgctcctaatgctacattggtaaacccaatccctatgcaaggtactccagtaggagataacaactgggtattgtggggattgaagacagaacaattggcaacagaagtcacaccttgggtatattctggtgcaactggttatgaaacagtaatcagtcctccttacatctttgatagtgctattgttacgatcaatggtgttattcaggttctgggggaagctttccgtatagaagatagtaagatcatcttatctgaacctttgggacacgatcctgcaacaggactgccaaacaagcttttcgcttatattggtaaaatcgtagcttcagcagatacagatcctaatctagagaaccgtcttgttagtttagaaacaaaaacggaagaactaacagaaagcatggataaagtccctctgcaaactattgctcgtaaatatggtttgttagatgatgaggtggcttacgcaacagcaggtcaatcgttaacagggattaaagctctgtatgatccggtagcacagtcttcctacacattacctcctaacatcacaggaactttaacatctttgtctgtttctggagtaatgacttattctggagggtctgtagatctttctgcactagctgttgaacgtggacagtttgtccatttgcctacaagctttggtaataatgtaactctgacagctaaaaatcagacgattggacgtggtgctggtcgttatcgttgggctggaagtttaccaaaaagtattttggcctctgacacattagagacaagcggtggattaggtccaaacgcatgggttctaactaatacggaaggactgttaacccctcgtggtggaacatacaacgatttattcgatgttgtctacttgtcagaatttgctaacaatacaactacctataccacaccagaagcagctttccaggcggcactgttagcagcaaaagcttcgaaaagtaagattctcgatgcttacggttgcgatatgactttcacgacaagctcttttgatattcaaggtatcactttgcgcggtggtgtgttccgtggtcaacgcgactatcgtgtgcagaatgctacagtagaaggcacaactttccgtaactctcgtgttatgtattggggtggtgctgtgcgcatgttcgattgtttgtgggacggtgctcctcgcgcaggtcaagttggtagcttggtattccaaggcaacccaatatcaggtacttttgaaattgataattgtacttttaaaaacgggttatatggcatccttcaacaagggacaggggaaccagtaacacgcggtgtcttccgtaaccttaccttcatggacatgcaaggtgatgcgatagaactgaacgtcatcaataaacattatgatgatggttgtgtgattgagaatatttacctgtctaatatcgatgggactaacgctcctattcctctgtccaactggggtatcggtatcggtgtagctggtaaaggaccatatggttacggaatccctgatgatcaatattgcaagaatattacaattcgtaacgtttttgcaaaacgttgccgtcagattgtccacgtagaagttggtcgtaatatctctatcgaaaacattcatggcgatccagaccagaccgtatctgttgggacaggtttggcaactggcgcagttgtaatgtatggaagtaaagattttacgattgacggtgtttatggagagcctaaaacagacggtagcacacttgcaagtaatatccgtatgatttatttggagtggggaactaacgcagttctggacgaagagggtaatccggtagttccggcacagggtagaccttcaaacccatgctttaactattctgttcgtaacattcacaccaaaactgggcgtgtttttgcgggagtttccgctgggccaggttatgaaaacagagttagctttgaaaatattcgttgcgctgcattgcagttgttcggtatagcttcttggctttcaatgtctaacatcacctgtaatatcttcgattgtgttggtcaacctgaatctggtccagggacattttatgatggattcttccgtagagaaaaatctgttcttgaaatggttaacgtaaactgttacccagatggcaagacgatggttactggtcgtccacagtggagccgttgccgttactcggatattcatcgtgtcaactgtaatgttgaagctaatatgtataccaatatcgcaggtggtattggagctattgtagggacaacgggcaaagtttattacttagagcctaatcctagtcgaaacattgatggaatgcatttcccaacagggaaagagtttgacaaaggtgatatgatagtcaaggcggataatacgttcttccttgtaacaacaagtggggcatatattccagatatcccagctttcggtattcgagctacacaagcaggagataccttcctgacacagaacttgactcctaacgggacagcaacaaatgcttcttggttgtatcattaccctctgtcagcagggacacgtatccgtattcctggtgctggcgtaggtggagcagatttggacacagttattactcgtgcaccttatcaagataatgatacgtggactaacccagttaaaatagacattgcagatcccattgtaacgcctacaagtgctggagttagaattaaaaccatacctaatgattccagtaatgtttctgtaggtaatactgcggttattcgcccaacgccagtagtagatgtgccaacaacctaatggaatagagggggaatccccctcttcttccaatagaatggtctaatgataggagagataaatgaatttaacaagacctaatagtgcgatagccgatctggtagaagctacttatcgaaaacgtcgcagctttgaggcaggttttacattacgtaattcccgtgaagttttgctgttagcagcagaagggaattattaccaatggaaaggaacttttcctaaagtagttccagcaaactctacgccagccaccacaggtggtatttcttcccttgcatggcaaagtgttgggaccgctgatgatatagcaattatcaatgccaagtttacggcaatgcagcaacaaattgatgatctgtcggaaacaatacctgaagctggtaaatcggcttatcagatcgcacttgataatggttttgttggaacagaagcacaatggcttgcctctttgaaaggggatactggtgctcaacttaatattaaaggatcgttagcaagcactagtgaactaccatccacaggtaacgttgcaggggatggttatatcgtaggtgatgtaatctacgcttgggatggttctgtttggaaacttatttcttctcttgggccagaaggtaaatcagcttacgaggtatggttggcagatggtaatacaggatctgtttatgattttcttacctctataaaaggtgataaaggtgatgttggtcctacagggccacagggagcacctggtgttaacgccaacggttttgattatcgtggggatttgccttctacaagtaacttaccacaacctaactctgaaaacgtaagccaagcttattctatcaatggtaatctttatgtctctaacgggacagcttgggtcaacatgggtaatattgttggtcctcaaggtccacaaggtgaggcaggtaaagacggtcttgatggaacagatggagatgaagggaaatctgcatatcaaagttggctggatgctggtaatgaagggacagaagtagattttattgcctcacttaaaggtccaaaaggagacaagggtgatcaaggagagcgaggtccacaaggtgaactaggtccacaaggaccagtgggtgcaacaggatcaggcttagagattatcggggttctgaacagtgaagctgaacttcctcctactggagaagtaggcgatgcatataaaattaataatgatttgtatgtttgggttcaagatgctacggaatggatgaatgttggcagtcttggaggaatatcaattacagctaaaggtcatgttccgaacagtgaagctctccctgtttacaataactatggtgatgcttacttaactgaagacactagtaatctttacatctatacttacgatcaagacaccaattccgcatcttttgttgacatgggaagtattaaaggtgacaaaggtgaaaaaggggctaaaggagataagggtgatcctggaacaaacggaaccaacggtactgatggggccaacggtaaggacggcgcacagtggtttgtagcaacaactaatccagtcgcaggagacggtgttatcaatgattacgccttcaatactaacactggagcagtgtttaagaaaacagattcttctacgtggacacttataggaactcttcctagtataccagaagcccctcaagatggtttgacgtatggtcgttctgatggaaactggatcgaaatatcaggatcagatcctacagaagctataacaccgactagagttacagcaggtttcatggaacttgaaacaactactgccaactctggagcatcttggactccttctggaacttccaatatgtatgttgttacagtaactgacgctctgacagttggagcatggcctggtgtcactggctctacaaaacctaaagcgttttcagcaatgatttatttgattcaagatacaacgggacacacggttacactagatgcgtcttatggagcactaaatgatacagaaatagcaactactgctaacgcagtaacaattttgcaattaacgtatcctggtgtgggtgatatcgtggacatggttgttgtaacacgataacagaagccccgaaaggggctttctttttatggagggtttaaatgtttccaattccaatatttactattatgaccagcactggtgtcgttcctctgccagcaggtattgttaaaaaagtaatcactttagattacccagataatgctggtaattctaacagcagtttagcaattttgcttaatgatggtagattgtttactcaaggcgcaaacctttttggtgagattgcagatggaactcgtagtgcacgattcaataatttccacttagcttctactgtagtagcggatgtgtttaccgcagatcgttgttttgttattaaaactaacagtgggggatggcaatattcaggattgacagcaggattggtaggatctatagcagcaggtggtacggacgcatgtgtaactacttggaccagctttccatctgtaataacagggactatctctttagccaatcttaaagaggttaagggaggatataacaacactctctggttaatgaatagtggtgttctttatggatcaggtcaaaacacagtaggcagtttaggtgcaagtactactaacgaagtttctactcctcgtcagataacaagtgcagcagttgcttttgatgcaggttacaaccaatgctcttatgtcaacaatgtgggaaccttgcgtgtttgtggagctagtaaaggtttagcaggtaataataacacaacaacagcttttgtcaatgctaagatatccgctactgaaacagtgtatgtcaaagattacatcaatacagtttcccagacaatagttgtaggagatacctccggtggcacgggtacagtaaactacttatatgttagatctaatacagaaacaacctacactaaactggatacctttgcagcaggtttctcaacatggaagtttccaccaagccgccactcttttttcgttgggatcaataattccttgtgggctattggtaagaactacactgcaaacttaggtttggggtatgattctgcgagcggagatccactccaagtgggaaaaccagttaaacctgaaggagtgggttcttgggatataaacaagctcacaagcgttcatacgctgaatatggatgttactaaccaattaggttatcaaggaacttttttcgtttataatggggatatgtattattccggtatttggaaagatgggaaagcctcgtatctgttcaatagtggtctaaactataataaattcacaccaatagcaagctccgtgattacgggtgatattctggcaactggcttaactacagattctttaggaatttgtattgtaggtggaactaaacagttgacacattctgttagcccagaaggaggtaaacttttcaatattaaatacacttcttctgcccctgcaaacatgacaatatcatctactggtttaatgactttccatgcagaaggtggttttgatgcaggtatgacagccttaaacgctgaaggaacaaccttatcagatacctctggaggatatgcttcaacattgagcgtttacactcctagcttatctgcgatggatgtaggaacaacacaaacaatggtagcagaaataacgccaacaggggcagcaagcttacctggtatggttgttgagtatacaactacagatcctaatgttgctacagtagatcctacaactggtgtaataactggtgttggtgatggtggttgtagaattggttgcacagctacatatcaaggtgttgttaccgcttctgatagttcttatttaacggtgaatgctgttgcgggaaaggagttagctccatctccgagtagtagcttaacggttctaaacggatatttcaaccactcggcagatggggcaattacgttcccaattttatcgggtactgtcacaccagctaactttgtagttaaggtggatgacgttgtaataccttcaaataaagtaatatttagaaataaagctttctctacagtggatagttatccagcaggagaatatagactggctattgaatttgcaagtgcttcagtagtgaatagtgttgatgtgtctatggaagcaaatccaaatcttttagaattatggggcggcaacagaattggttattctacaagcccagcctcacaattcttaaaaggttgtgctaacttaagacgaataacttctgattgttttagtaacacatcttacaccggaacatctataagtggtatcttctctggctgtacaagtttgacagctatccctgaaggattattcagtgatgctttatttccttcactgacaacaatgtcaagcacgtttgaaggttgtacatctttaacatctattccttcagatttatttaagaatctatcaaaagttacaagatattcttacacctttaaagattgcacctctcttgcagaagttccagcaggaatgtttgataatattccaacgaaagtgacctctttaacagctacattccaaggttgtttagcacttacggattttaataaaatctttaatgacaacccagggttaactgtttgtggtaaacgtggagcattatcttctttctttagtggatgcacaaatcttacaggaacaggaacaacattaacaaatacattaggcggagtagctaatagttacctattcaggtattgcacaaaactttctgattataacaacattccttccaattataaataagaaaaggagccatttggctcctttcttttataaaaactctttataaatcaataagatcagaacggaatatcatcatcgaagtccattggaggttcttcttgattacttggagttggttctggttgtggttcaggtttcttaacttctttcttctcttctttcttaggctgttctgcggaaccacgaatggcagcagcaactttatcagacagagccagaactttacgagcagaatcaatcagatcttctacagatacagtcttaatagtatggtctttacaagcattgaggatagcgtgaccaacagatgccccaagatcataatcattaatatcaacgccacgagattcagcaatttccgatttcagcgtgacagttgcagattgaacaaccccagcgatatcgaaagcatcgcctttaacaccattacgaatcagttccagtgcaccatttactgcgtgaccagtttccagacctacagtatcacgttttttataggattgcttaggagcagcatcgttggaacctttattgccagaagatttgttagacttctgaacaccatcggtagacaatactgtaatacgagattttttagtattgtagtaagttttaccgcctttattatcaacgcgatcaatatcaatacttacttctacacctttttcaatagtgatccaattatcgccttctttgacttgcaggttttcataaccttctttcagttcaatgtcaccaagagaaatccaaacacctttctcatctggtttagcacctttctctttcagaacaagagaagctcggtgagttgaaacaatcgtttttccttcccaatggaaggttttaggttcagcgaatttatccagtttaacgtagtctacgataccagttgcataagttacggttttgcctttacgatcagtttcagtattaattacggacattattatctcctctacattacattaattttgcacagaaagagcggagtctttccatatcatcttgctctaacaggtatttacctttacctattccaactccaatttcaccattaggaaaatgaactatttgcactgggaaacctccgagtttaattgtggcagctttgccttcttcgtctataacgtttcggattgtatcttgcagtgaaatgaattctttgtttgtaacagtggtttcaattatttcagatgtttcgacacgagcagttagcttcttgtttccaccttgaataaccaaaatttgaaaataaaaagagttgtcaagacctacaacatttttctcaactagtgtcaaactggtatagtttccataaacagtttcaacagctatcttagaacgttcaatcattgaatgctatcctatcataaaatgtttaatattgtcaagctttaattaccaaggaatatcatcttcttccaatctggtatctacttgaggtggacgtggaaccttaacctctttcacaaaacgaagatatgggaaacgtgtagcaattttaataacatgtttggcatcttctctaacatctttgtgcaagaagcagatccctgtttccaaggttgtttcaaaatctttagaataataacagtccttcccatcaaatgcagcctggcagatggacagatcgaactcatttagaaaggttgtcattacgcttggttccataatcataaggttgcaaagctgaccatcacgttcaaactcaaaaacgtgtttaagaccagtaacaccttcataattgtcagaagcctctttgttccctagtttacgaatattggttcccattaaagcagatgcaattaatccttgtatttgttcttcagtccgatgtgcaggaagggatgtatagaaatccagatcacgtccagcaatatcaagaatacgccaatcacgaacagcaccgccagccaagacagaattaggatcagcgatctttaatatggtaagaatttctttggcaatattgatttgttttgatttagtcattgatacgctccacagttacttttacaacatcgtccatattaatctcatcccctaagacctcaataacaccttcctcataaagtcgagcacattcttcccacacttcagcttccgtcattccacctgcaatcttatttgcaagacctttaataacatcttcattttgttcatcaacaagaattgaaacattaaagctcactaatttacgcattgttttctccttatacttctaaacggaaagtttctttagatacaaaatcgtatccacctttttcaagccagtcattgtaaacctcatcggcttgagactctatcataaaataccgagtggtaacttcgtctccgacaatacgcacaattttatagcaaatcatgataccatttcccattaatcttcctccagatcaatttcattataacaatgtatgcagaaaccatcattgtgcatatgttgttcataagacatatctttaccacaagaccaacaacggatatccccatcgtcccattcacgttcttcttcaccttcgaattcatctggtaggtaaggcataccaagacaatctaaatcgtaatgcatatctcctcctataaaggggcagaagccccttataaaacaatatgttagatcagtgacaggacgcccaagaattacccacatcatatccggcagtaagctgaacattaagattgtaaaattctccagccttagtaacagctaaggcagcaagttcacctgcccgactataggctgtaaaccatccacctttaggagattcatgaatgttagcccaaatttgccctgtctctttttccttattatgcttccattcttcgactttagcaaggcattctttatcaattttcttttgttcttcaggatcgtctactttcttccaacctaatgattcaggtgaaaaccatttaaattctacaaggttacgagaaacttcaagctgggcttcatcgtgatatgcaatcatttgttgcacgaaatctttattcttccagtcatctttaaagaagtcaacacttagtccttcttcttcgatcatgtcgtcataaataaccattgcacgtttagcacagataaccccaccactttggaacagagagttaagaatcgcgtgagcagaacgagtaggaaccttacgaccgtcaatacccaaaacatattgtttaccagtcttaacccaaaaatcgtttaaacgttctttaagacgcgccaatgggaatgcagcttcccagaaagcatcaaacaccaattgacctgtaaacttatcgctaccaattgttttagcaaccttgtcggcttgtgcaccataggtaataccatacttaacagatttagcaggactacgttcaaatttacgtccgatagtttcagtgatacgttttgccatcattgtgtgaacatcattaggtttctctaataacagagcgttacaatattcgtgtggctccggctcgtaccgccaacagtagtgtgattcaatttttgcttccaaagagtcgaagtcgtagccgatctggaagtatttaggaacctctacaccaaacaagttacgcatctcccatccaaacaaagatgtgacacgaggaatattagctacagatctatgcttcatacgagaggttgcagcatcacatgtagcggctggggtaggaatacgcccatccgcccttactgcggctaagaaacctttatcgtattcttgatcttcttcatcttcttcccaatcagcaccgccacctaaaatagagttcctacgatgcttatacgttaagtattctacaatctgtgtagcataaggaaacttctcacccaaagcttgcaggttaggacaaatttctttttcctgacctttggtaaaacatgggttagtcaatactttaagaccgcgacctttaccttttgctatacgctcttgaatcttcctttccagggtttccggtgtgcactccagatgatcacaacgatcctgacaaaaattagaagatagagtttgctcaacgtaagctcgaatacctttctgaagttcttcctcgctctttttaatcttggtgccagatttaagagtcaagtctttatctttatattcagacggtacccaacctaatcctacaagccagtttttaatatgggttgtatcgttcaatgttgcagggatgttaggatcacacagaggctcatctgctgcaactggcagtttccactctttccccaacataactaaccaccaatcgccatccctctcttccaaatgaccatcatgtttcttagcaaaattgatcatatggttagttggctctaagttctttttaatttgcaacttaggtggaataaaagctttaagataaccttttgttgctggtttaggtggcaaaataggctcaacgagtaaacgaagacgctccatttctgcatccaaaaaagcaaggttctcttctgcttgtttcatgttaaaagcaaacccacggtgttcctggcgtgtaataatgtctgctacacgttgttcaagttcaaatggaccttcccatttatcataatcaccccattcttccataaggtaattatatacgctcgtattggctttgttgtcatagatacagtaataaagcatatccgcagcaaaagtcttaaatcgatcttcttctggaatctctttacggaaatctattttcacatcaccacctgcttttcgagaaagtgctgccaagctatgtcctgatttgccctcaatctttcgatctgggtttaacactttactcaaaatcaaggagtcaataagttttaccttatttttgccccacgtattatatttaacactgtaatctaatccataaaacagttttgtagccaaccagtcgtagttgataccgttgtgagccacagccatttcaaccagatattcaggcttgtctttaaaataaccttcatgattaataaaatctgggaaatcttttagttgaaaatgtgtgtaatcttgcgccacatactctttaagaacatatgtgtatttaccatctgactcttcataaggacgcccatcaaagatgtatttagggccatcgtggaaagctactatttctcctgtttcatggttctctaagacaatacagtgcatttgaaatgtgtctttgagacgataaggactagctaaataatcaatagtgtcattattcaacaatccgtttgcttcaatatcccatgtaaacttactcactattcctcctttctaatgttctccagaacccactgaagttcttttaaacttaaacttcttactcccgcagttttactagcttcagctttaagtaacgggtaagcctcaatgatacgcgttttaagatcagaagtcaaggcttttaaaaaataggtagatgcttcagataaagaatcctcttctgataacactttacctgcacttgctcccgctctcctaacggctatgtcgtagtctttactgttgcctaatacgaatagtcgattttctcctaaaacaacaggagaacgcttctcgttgcgtttaatccatatctggaatacacaaggaacatcccaaggttctccatgaagaataaaagatccttttggacattcttcttcgtaaagaagatgcatgtggggatttagtttgtgtgcaaaaaagattttttgaaatgtgcgaggcaagataaaacaaataccaccttcgttatccaacatttcagcacaatggttaaagaacttaatggcaagactagcattttttccaaacggaggattaccgacaaaagcagttacactaccaacagactcaacagattgagctaaaaaatctgcctcaatacaatcttcaaacttagggtcaatatcaaaagaagttatgtttttaaaacaagaagagaaagccccttctcccgcagatggttctacgtagttagcttcctctccaaaaatttctttgatcttatcacataagaaccccgcataagcggggttagtgtaatattgatcaagtgtgttcaacttgctcaatagtcctccttagttgttagcgaactcaatagtgaggtcaactttaccatcgtcagaaataaccatgtttttggtatttttaaagatgatatctactttaccttcacttacacgacagaatgcaacaccatctgcaactttatcgatataatatttgtaagaaagaatacccactttactacgaccagcaccttttgtgaaagaagggcttacatcgaaacggaaacctttagaagaaacaacacggtaagaacgtccagttggaagatgttcaataacagagacattattctcaacaacttttacagcaaactcttcaggatgatcctcaacaatcatatgtgggatggcaaatgccaacgcttgtttgtgtttaataacaccagcacccagagcaccagcagctttaacttttgcattcagatcgattgtcatacgcatttttacttctcctcttgtttggttgatgagacaagtataagtctcttccgtaaagttgtcaacaggtatttttaataaaagggccgaagcccttaatagttgctatccgtaggcaaattagcaggattgttgaaatactgctctttgtcatgcagagttgcagttctaatgtcatagtaaaactgccctgccggaccagtttctgagaactcacggttttttaggataaagcaatgagtcgtattgcgttctacagggtcttcagcggctttatctcgttccaaagccaaggtaataccagcacctttagccaagaaactactacccattgcatcgtcctctgttaagtgttcattgccaccattagccgatttcttaacgtgtgagatgacaataatagttatagcatactctttcatgatgcgcttcaaccatgttgctaactcttcctgggcttgaacatccataccagaaagcaaatcagaataagggtcgataacaagaattgttactccaaaatagatgatcatctccaaaactttttctttgatagactccacatctgctccacgatcatcacacacataaaaacgtggtgatccatcttctctttcgtaaaaatctaggattttttctttattctcttccaagatttgaaatttctcttccggtgttttcctgtgtagaggaatatgcaggaacgaggacaacaggttacgagaatatttcttataagttgcttccaaggacagaatacctagggtatgttctgggtgcgcaacaataatatgtttggtgatctcgttcaccatcaaagttttaccgatactggtctttgccaggataactgtaatctcttcctctactaaaccaccacccagcatgtttgcagctacacgcataaaaggaggcaaggtaatcatcttggattccaagcattctaatgcagcttcatacaagacattagaagcataaacacctgctggggtgtatagacgagcactccaaaaagcttttacgaaatcttttgcacgaccttcttccagatactgattggcatccttaagatccatctgcatacggtagactttgttacgaggcagcaccttaacaatattttcaaatgcctcattacctgctttgtcattatccatgcaaacaataatcttcttaaatttttcaaagaaaggatattgtgcctgaacttgtttatacatactggtttcaccagttgtgccactaactactgctggaagctcatatttgttgtccaagttttcagacagcatttgataagctgccagagcatcgtgttcaccacctgtaattaccacagtgtgagaacggtctgcaaaacgaatttgtccaaaaagatctacatctttacctacttgaccaataggtttactgaaatctttaggatgaatacgacgcttaaaaccaaccaattctttaccgatggtagtcggatataaacaactttctactaccatctgatccccttcctgacggtattcataacgaacaccatagaaagatgaaactttttctttaatgcctcgataaccacgtgggttggttgatgtttcttgaacaattttacgatgaatctgtttattaaattccgaacccacaatctcctcctcttcttctaaaacttcaccattttctcgtaaccattctacgctaggaatagtgtattcacacgcaaagcacttagcacccttatgctctccattagaatctaatccataaaccatcaggttattacgagagcgatccttgccatttttcatgcagcgcggacaacctgtatgcccttccttgctaagatcaacatcaaatccatatttagttataatgtgcgacactttgttctcctgttaaaatggttcgttagtctccatcatatattctgcttctagttcttccatgtgctttctaaattggaaagcaatttctgctacagttacatttaaatctttttcaaaaacttctgtagagccttcataaaaacgaataccgtcaattaaaagccctccgtggtaatcccaatcactttcacgagaaagcgggttaggctcttcataatagtaatccacctccacgactaaggctttcccgttacgagtggtgtattcaaaatcaaaagtgttaatcattatagctcctcaaataaaagtctacgacgctcattcaacacatcaatgtgataatgagtcctgacatacttagctaatgctaatcctttctccatgcaaacatcgggagcacttaataagtattccgtaatatctttccactcggaaggtgtttcagcaaagaataacaaatctttaaactcttgtgtatgataattctcacgaggagaacagatcaaaggtaaacccttagcacctgcctcaagaattttaagattgctttttgcattattaaacacgttatcaagcaatggcgcaagactgatttgatgaccatcgtaagattccatgtagttggcatatggtcttacaccttcataaacacaagttggtgctacattttctctgatcacagaccattcacgactacttaaaacttcagaatccctacgaaaaccacatattgtaagatctttaccaaaatcgggcaagatagccaaatcttgtttatgtgtttcacttccagcccagactaatggagttttggagtagcgatcacgggtcaacacaaattgaccttcatcgtaaggaagaccattagggattatgtgcacattatcattgtattgtgaaagttcaacttgcaaagcaggtgtcgtagttgtaacaagatcgctgtgctctaaaaaccattttaaatgttcacgaatacctgattcaaaaataccttctaacatgtgtccttttggaataactaaagagtcatccaaatccataaccattttaaagcctaggtttttaagggctaaaaagccctctttaccttttgttggcactccgttaaaaacgaaaacgttgtgtttaggttgtgaagagaactgccttgagtaaggcagcactaccctatggaaatcgcagacactataattgattccgttacgattgtcaagaattatttgtcccatacttcacctacaaactttcaataacctggcgtcgcaactcgtttgcatctgccagattataatgtgttcgaacatgttcagccaagaacaagccacgatcttcccgatagtttggattgcgaagaagcttaacaatttcgtaatgccattctgctttattctctgcgtaagcaacagcgcgagcatctacagggttaaaataaggtaataccttagaacaaacaattggaataccttttgctccagcttccaggattttgagattacttttacaattattaaaatcattatctaccaaaggagctatagcaatagcatgactttcgtaaacactcatgtaattatctaaatcttttacagcggctttatatttggcatttggtaaatttctgcgaatcttaatccactcttgtcccgtgatgctttgtgatgcttcatatcccgcaatagtaagaagttcatcatcgaaagtattagagactagtcgtaagtctggttcgtgactagcaccgccagcccatacaacaggggtaccggatgaacgatcatttgacaaagtgaattgtccgctatcaaaaggaagtgcatttcggatcacaacaacattcctatttaagtgacggatcttatatgccaaatattccgtagtcacaattaccacatcagcaagcttaaccatagctacaatagcatgagtgtttgactcgtatagacttgctaaataatgttctggattaagttggtaaaaatcatctaagtctacaacaaccttaacaccttgacgtttcaaagataaaacgtattctgcacctttagagtggatacggttaaacacaacaacatctttcttaggttgaatattattgttgttaaatggtataacaatacgatgatagtcacaaccgctgtgaggttttgcatcaatttttagtttagaccattttttatttgacatgtgctagtgcctcctcataggaaattcggattttcccatttttaatatcctctaaagatgctttatattcttcccagttaatcccaatagcagcctctttctcttcttttgtcaggttagcaaaaggcataggattgtttccaaaaacatcgtctgggtggatataagccatgatacgaagtggacaaggtgttgcctgaataccatgattcaaaccagcagcttgcaaacggtgtccccattcagcatcttcaaaaccataaccgtgagtgtaaggacggaaataacccatcttctcaacaacggcacgagaatacattgcaaattgacacattgcaagttcccagagaataacttctcctttgcttccaacaactttatctttgaaatactccggcataccaaagaaatcccatcctccagagacagcttgatctacaaagtatgtttcccatccctccatgactgggtagcaatcatcgtcaaaaataaaccaataatcataaccttcttcataaaactggtgcataagttcattcctggcataagctacacctttacgatctggatcgttgaatactcgaaaatctgcacgtggatctgttacaaggtagtctttaagtggacggacacctacagtgataacacccactccgattttaatattttccattttctctcctaaatagttttactgtgatcatgacagtgtaataaatgatgtatagaccgttgaggatctgtttgacctaatctgtaaatgtgaaacagatacattccccgcatcaatcctaacctctttcctttttcatgtaaagtgcgagagaaaattaagtcgaattggatagatttttcttcgaaaggaatttcattccacaatgattttctaaaaagcaaaaagaaacctgccagaggtgttccgaaaggaacttcttcaacatttactttatgatattctcttgcaatcttagcatattctatatggtttagaatatctggatcatcgttaatttggttagagaaaagttgataaccactgcctaacctgttacaagttgcacctattacatcaaaaggcgggtttgacataacaagctcttcaagcatagatggttgatcaggtaggaggaacattgtatcggtatctcttaaacacacccaactatcatctggaagaacggcaatggcttcattgatagccttgccgatatttcctgtcagatagggagtaatataataaatcattctcccctccgttatattaactgtcagctacaatcccacgtttaatcatttcttgttggatttggatcacacgatctcgtgcttccatatattctttaaaagattcttggagatggtcacgggctacgtcccgtagtttaatcagtttgtcgtttgtcacttcttgaagagagatctcgccagtttcattggtcccaagcgttttcatttacaacctccttaatagctactgcacagttcttacaaatacattgacctttgttcttagaaatttcaatgtaaggttcattttcgttttctccgcgtcgtgagtcgtatattactgtattgaagcagacaacgcaaatgtttttaataacgacatatttttgcactttctgtttagtgcgaaaattgacttcaatgacttctcccatcagtgaatctcccctaaaatgttgttttgagacattactgcggagcattctacagcatcatgagtccttgcaaaacgctcccacaacacagcatctactttaagaaccatacaaggataaatactgtcgttgatcatgtcaatgctatatttatctacatccttttcatctcccataaacaaagtagcgtatgcttctaaatgcttacgggtgtagtatacatcctcttcagtaagaccgacaaccaggtaacttgctacaacaacagtattatcttcttgcattttaactcccctttggtagatagaaaccatgcactttatctcgataaacaagacgcatatcacgttcccagtgtgttcttatattccgtttcttgaagtatagagcacctttagtaacatctaaaacagaccgcaattcaggaaaatgtttctctaaataaagtaaacgctccgctattgcttttgcttcctgccacttatctttctctgttacgttaaaagttttcgcatatgagaattgccctttctggaacaagactcctctgactgtgttagggaagtaggtatcatttcttctgttgattaccacattcccaacggcattcattccttttttacccagaccgcgaccttctgcgtaaattgcacaagctaatagaattttatcattatattgctttgtacatttgtgaactactttagcggtttttacgtttgcagcttcggctttcgccacaacaggtgtaaatgtaaaagcagttaaggatagtaacgcaactgttacaaagttttttatcagcaaattttgcctcctttttaagttaacgaatttctagtataacacgatagaggctttattgcaagagggggatttctccccctcaaaatcatttgttaattattacggacattcataccattcttttttaccaccgaaggccatcaccacatcacaaatatccagaccagctttacctacaccatatgctttcagcttccattccccatcttcacgaaccaaggaagccacgtggcagattgtgttgccagctacttcaggagccaggaagtcaaaatccagaatttccacattgcgctcggagtcgaagattttaagcataccttcagaagcatgaccaaaacgtttcagacctgtatcatcatcaatggtcagaacaaaggcaatctcttgtgcatcaggagagattttagccagagtaatatcaatctgctccatgctgccagttccatcacgaacatcgtcaccagcgaaggtagaacgttcaggatcaaacttgttagcatagcaaaccagatgacgtgcagacagcatttcaggattgccagcggcattgtgacgacaaaccagtgcacttacatccagatctagtttagaatcagatttccaagagaattccaggcgcagttctttcagagccggagcaactttcttcagggaaattttttcgctagagccttttttcagggaaattttatcagtcatcttttgtctcctctattatttaagtgtaataccagttacagtcaattctacttccaaaagcttagatgtgttttggattgatactaattgtgcatgatggtttagttctacagcagaataatcattttccccatcatctacttttaaataaacaatgatttcactaaggtctaaaccattttcgtcaaatgcattttcatagacgaaagtatctcctacatccaaatctttaatggtaaggcatcgtttatttactttttgctcatcaatttcgaagtttaacacttcttcctcctaatgttatctccggtttgtatatacgaagaattatagcattttcattttctttgtcaacccattcttcataatcaggccatacatgaatctctactctacttacaatatcttccattcgcacagtcccaatgaaatactctttgagactgcgcataatgaaagcttctctctcgcgccaataattttctatgacttgagaggcaagctcgtcgatcattttttagcacctactttaacaacccactctccgaactcttcagataagagtttgtcataaagctctgaatctgtcaagtctaaatctttaatgccaataaaaccaacattatcataagcatttgccagttctttcaggaagccaaacttctcattaccaacgccaaccatgaaccaataaataggtttattcttattctcttcgataagacgacgaacagcactaggatcaccattctcaccatccgtctggaagaatacaacaccaggggtaacgtcagcacctggttcagatacagctacaactttttcacgctctacagacactgtttcagttttaccaagcagacgattaaagaagcctttctttggagcctcctcttgtaccacttgtttagtggtaatatatttagtaacagtgccaaaatactcatcgtagatatccgccattacaggggcgtaatttgttccacctccgatacgaacattacgcatacatttaccaacataatcatcgtaaacatctgctgttgctggagtaagctcttgggaactcgtattgaaggcccacatatcaatttgttgattatcgtcgaacagcataccaaaaggaagcagtttacctacaaaatcactcactaccccactagaatatagaccatgcatactaccagaaatatctagagcacatgctacacgaagaacaatcttaccttcgttcaggttcttattctttttcagagagaaagcaaggttttcttgacgttttttcaggctgattttctcggacatattatttctccttcttaagtgtaatattggtaacttctaaatctacttccaccatatttgtatctggtgggatgcaatgagtatagcctcgttgtgctagtgatccattaatacagatcgcactgtttgtggaatttttaatgaacaccaagttacggtaggtatccaaccctgcgtcttcataggcatcataatacatgaatgtggcccctacgtcaagatcttcgaaagcaataggtaaatcctgacttttttcttcttgaatattgaatctaaacacgcatacctcctctaccaattttgaagcccaaatcgtaagcttccttagtgatcttttgtaactcacttataggaagtgttacaagaggatcatcttcttcaatttccatcttgtcatcttctgtttcaatgagagtattatgcactttgtgataagggttgtcaacacgtttaaacttattcttttctgtgctgaaaaaacaatctggatcttcttcaccatcaccccaaccttggttaggatctccgtcagattgttctgtagggatttcacctgtaaagtactcttccagcaccatagcgataccgtcccttggatttgaggaatgcatcaaatcacaaaccttaccccaatccatagcccattcgaaccgttcacgaacgccgttttcatcctcctttccagagaaaacacaaccataactatcatagttgccatacatctcttcaataacaacaccgtccttcaaaagaaagaggtagcaaggtgatccgtcgaaagaagtagaaagggcagctttgcccgattctttgcacaaaaagctaaaacaacccattacaaaccctccttcagattatcaagagctacagtggtttcacaagagtctccataagttttatgatgttccagaaaagcttcgggtccaccccagtcattatcttgtgtattccagccatcaataaaagcatcttcaatgattgtgatcagttcctgtcgagtcaacgtaatggtatcaggtttctgcgtagtttccacacggaaccctggttcttcataaaaacctttagttacaatggattctaactcttctgcatcacagaggaagtagccacaaagataacacccaccgtcatcatctttcattacttcataaacttcaccacttgttaacttgatgaaaagagtagggtctgttactgtaagttttaaaagaatacctgttggattatacatcttcttcctcctctaaaatatggaacccgtaattacaataatcctgaaaggtttcgtgtgcaagatcttctatatcctcttgagacatatcatcttcaatttcgatatccacaacctcattgcatccacaccaagcagtttcaatattcactcgtaatattttcattactcctcctcctcattgaagtcaatatctgcaaggagttcgaatttacggaagttacgacaaccttcataaatataacaatcacgacaaactgctagaacacttgggggatatatgcctcccatcggtgcgaatcgtttttcgtcatcataacggacaccaatgtcttcatcaattatatagatacggattctcatttaccaagccctcgtttcacagcagctaccatcccgtcttccagagattgaacttcattaatataatcaacacgagcagcacgggcttccgtattgatgcggttagtttcttccaacatcttaaccaagttttcctgatcgtgacgcagagtttcaatatccaacacttgacggttagccagtgctgctgcttcgatctgattctgtgtggcaagatcgctacccagtttaattgccaggttaaattcatcaagaacgttattctgcgtctctgctgctttcatttgacgtaagctctctatatacattgagaagttagcagagtaagcaggaataacattatttactatgttacgcgcagatcgcattaagcttgcagaaactttttgcataccttgtacacgcggtcccatttggacacacagtaggcgcaatgcttttaaatctgcaatacgaatctccagaagatccaaagtatctcggatcacttgtcgctgttctactgcatcttctggaagagcagccaaagcttgttcttctttttcataggttgctgttagaagctgcatatctcggttcaaacttgcagcatattgtccaatagcttgatgtagcttttcaagatataccaaggaatcttcttctttgcgaatatccatttgaaggttctttaccaactcttcaatacggttattaacattatcaaactccccaaacaggtcttctttcatacccataacttttttaatgagtttagtaatacccttgctttgtttaatagagtttggatcaagttgttttgcctgtttaatcaaagctgtgagtcgttcactcatctgatcgccttgattactacgttgatgttttaatacctcggcattcaaggaacgcaaggttgttcctgcctctgccccaatctcttcgatctcttgtcgggtcatagaaggcaaaactggaacttcttgcggtgccgctggtgcataaacaggactggcatctaacacgcttggagcgaatacagatttacttgcatctgttgttgcagcaaatacgctcatttcaggcttcttctgaccaccagtagctgcttttaaaaatggacttgtcattcttcattctcctcttctgcatctcttatatatggtgaaacaccgtactctttagctactttaacccaatcgtcccatttatacaaccataattttccttcggtcccttctttatctgatttcaaccacatattaggttgcttacctgggtacatgcgattaggtttacgattataacctctaacacatcttgtcgcaaacctatctaccagaacaagaacatatttatattcgtggttcaacggctctttggaagtggctttaggattagcccctaattctgctgccagtttttgccaatgagcaccgtgcctactaaacttacccatacaaccatcaatagcatgagcaatttcgtgcttcattgtatccacgatcatatctcttgtggagttcttatgcaagtgccaatttacaacaacaattttatctcggtagttgcaccaaccgaaagagttattcactttgtttctaacacaagctttatatcctgcttcacgtaacatgttgtagtaaacaggaaaatcttcttttatttcctgcatcacttcccaccacaagagttgcaagtctctctcggtatgcataacttacaccttaaaagcgaaatgcgtggtcgtggcttcaaaatcagggccagataaacttgcactgaaatctgaaatatttgtaattaaaaagcttttatgcatacctaacacagctacgctttcaatatcttctactaacatttcaatcatgttagaaacatggctgaacgtagagttttgttttttgatggtgtagaaagaaagattcccacctgctgtataagatacctcttcaaaatctttaatcgtatattgtgtgccatcagtaaagaaaatggtagctttattagtagcacgtttcttgttttttggtccttttttacgtttactgcgagtaggcaaaccgtttgggaacaccatagctacaaattcttcagcagaaacctccttaccgaaatcataaccataagaaacagcgtctataaactcgtcatcttcatttttaaaataatggaaatagggccaatttgaaagattatcaagcatcttatgctcgtccacagcagagaatgtatccctcaaagcgcgtgtgatttgcaaagcattaggcaaccttttaacacctacgatggaagtacgaatagaaattgtcattgtttttctccttattaacgtcgcttgctacgagatgaactctttttacttaaagggctattgtaagatttacgagttgtatagctactatttgttttaaaagtttgtctcggcttttcataagtttttatctcttgtttaggcttaccataaaaattagttttcggtttaggtgtattataatgcttattaataatcgttctgttatcgttataatccccactgctacgattactaccgccactcatcatatgacctaacaacatacctgtagcaaactcaccaacaccgctactactagaaccgccaccattgttgataatagttgtatctccgtcagatccttgttgagcgtattgttgaggaggttgttggtattgtgcaggatttgtttcatcctcgcaagctgttaaaaagatacaaccaattaaaatcagggctagttttttcatatttgctttcctcattttgactattaatacatctgtgtttgaaatctccagagaagcaataaagttgctctccatctcggtataaactcactttactgccgttgattacgcttgtcaatacaaaaattacaacaaacaaccctattgcaaaacaaatattttcaaacacaaccaacaagtatttcattttaaaaatacctcatcatcagtttcattatcccagaagaacaaatcccaaccattcggatcattccatttggctgctggagaagtccatatttgttcgatatcaatattcaaaacttcaccgtttcgttttgaaacagctttagttaattcccaacgagatacaggctctacttcccctgaaccactcccacaacaagctaccacgttaggaggcaaattaattggatctttggtcacgatcataacgcttaccccagggtaaacttttgaaagataatctaaaacgtaatccacatcaccagataaatcccaaacaagttcttgaatttcatcaaaattattcataagtctctcctataaaatagcctcccgaaggaggctcatctattaaacagcagcttcttctttttcagggaagataaagcttgcaataacaccaagagctaatgtgcctagaacaatcatcagacttacgttaggggaaatatcatgcgggaggaatgaccacttggcatgaagtgtttcaccgaacgggtgatacataagtttagcaccaacaaacaccagaaccacagcaacagctttctctaagtgaaccagatatttcacagctacacttaacacaaagaaaagtgcacgtaaaccaagaacagccatcagcattgcagaataaactagcagaggttcttgtgtcacaccgatcacagccggaactgaatcaaaagagaagacaatatctgtaagctcaataacaaacacacaaagaagagcaggagttgcatatttaataccattcttaatggtaatgaacttttcaccatccagtgcattgtgcacaggcagaactttacctactaaacgaacagcccaatgcttagagtaatcaatatcctcttcttcgtcaccacctttgatgatagccacggcagaccaagctacaatcaaaccgaacaacacttggaccgaccaatgaaggttaaacaaagcggtccctgctgcaacaaaaatacctcggaagacaatggctcctgcaatcccccaaagtaaaatcttatgttggagatgtgtgctcttaattccaaagcttgcaaaaattgccatgaacaccatcaggttatctacagaaagactcttttccaacacataaccacttaggaaaagcgcggcaaactctttaccatgttctacccaaatgaatgcgtaatatcctaaagctaaagcaatccaaaaaacagaccaaagcaaagcagatttaattccaatttctttattctctttatgaccaaagaaatcgataccaatagacaatgctaaaataccaaccaaaacaactacatcaataatggggaaaccaagttgcattattttctcctttctctttgcggggaaccactccccgcctcatgtgatacatcttactctattctaaaactttgtcaacacttattttgaagaacttgaggaaaagatcccacgtagtacagccatgataaatgccacacacaccacagtccagaaggtgacaggaacagtgatatctgtgtgacccatcatttcaacaacgtagttataagccagcagcagaagccatgctggaatcatactaatcagaaaagcaataacaaacacaataatcactgcaagaatacctgctaaaacgcccataatatttctcctcttaaagtttataaatagtcacatcgtgacctgtttttactaaagtttcttcaatcatcacttggatgatagcccaattacctccagcatgtccagcgccaatcataggtaagccgatcttacatttttggtcacggagaagcaaatcgttagccatagctattagtgcatcgtaaagtgcatcatagtccaactgacgacctttagcattgtatccgtaacggtattgcccgtatagattatataccaaagggtctgattgttcgtctggcacccctaaactaaaacaacctagtttactttgatcaccagccattgtgtctaagtctgctgcatatgcgtaaggaaatgctcgtttgatttgtggggcaatacctgcccccatattacacatacagttgcaacaatgagcaataacagttacttcacctgctttagcggcatcaataagattacctgttttcattttaagcattttttagctccttattacagaatgtgttgttttgtgtaacgatccaagaattcaaagttttcagcatactttgaaattcggttgtaaccttctcccaagcatccaaagaaaagttgctctacatagtaatgtggcaattggctaagaatgattttgaagtcttcatgattttggccaataagatacttaataggacgaacaagacactgtgcatcacgttcttcattaatcattttaacaaacgcttctggtgtattaatgtagttaaaattcagtttagcttcggtatctgcttgattacctccgtattttgcaaaatacaagaagtaaacatcatttttaacttgattttcatcaaggatctcaatcagtttgtcttcatgcgttccagtgatatttacatcatcaatgaatacaagcttcttatcaccccagaattctttgttgcagtagaatgtatccccatcaataagtttcttacgactagctttatccaagaaaccataatcgttgatatagctaactttacgatgaataatgtccagttctgctgaacgaccttgatcatattgtgattgcaacatattaaaataattaataaaatgatctgtcatcattgttgcagcattatgcacatggttataaggagaaggaatgataacaaattgttccccaatatgtttcattgccacttgagcaaaaaactgaagtgccaattctttacccatacgacgcgcagcttggttactaccaaatttcaattttgaataatcttggatatcaaaagtagcagtttccaggtcatcaaatttatttgcaaaaatttgagtttgattacgcatttacaatttctcctcttttaagtttctctagtaagtcgttagggttcttaatatgacagaagttaaatcctaagtcaacacattttccatcatattcttcactatcgcctacgtgcaacacttcgtgccctaacagagggatcggagaatacgtgagcgtgcgagcaaagaatcgcggatctggtttacaaagtaaagcttcatccgagaaatgggtgaactcaaaacaattccaactatcaaacttacaagcacgacgcaggatatcccctgatatgaagttggtattgctcttaatactcaaatcataacgccccgaaagatacagcaagtacatcggtagatccacagctacatgaggtggaaacttaaggaaccattgttcacactcgaaacgaagctttgcagacttcaaaggtgttatcccaagttcgtaaccaagtctttcccaggcatatgctgcacactcggctgttccctgaagtgcagcattgtccagttccttcttgatcttattgtaagctgctctcgcttctacttccgtaatatctccatattttgcgatagtccaggctcgcatgtctgcgtaattggagtttgctgtgatcagtgtgttccatacatcaaaagagatatgtttaatagtcatattaagcccaccatgcgtctaagttaagattactatccactaccacttgttctatgtggtagccttttatctgtatcccactgttcaagagcatatcatacgcttcattgaaacgcaacttatcttctgcggaatataagcgagcattataaaatcggtaatcaacttcttcagcattagaagaaatacggaagaagtttgtttctacttcgggatcatttgctgaagtcttaatgtgaacttctccgtaattttctttacttagatccatgaaaagaacacaggcaacatgtttaaacattcgttccagtttgtaacgaacaacattgaaacctgcattctcaagtttttctacacactgcaacattaaagtagtgtcgagatcgctttgatattttgttaacatacgatcacgttgagactttgtatcccgatgtaaatcaattgttgtgcatttggcaccaataatcttagctgctttcatcaactcttcagaactaacgttagataaagtaagatgaaaatgggctttccacacttttttagcagggacaccaaaagatttatccccactattcggcatgttgactactacactatgttgcattacttatctcctcacttaaaatggaagtctttgaagttcatctcctccgatatcaagtaatttagcaacatctcgatcagaaagcaactcttttctttgtaaaatatccacaagggttgcaagaatgtccttaacgtcccgatcactgttcttcaaaagttctcctgccgtccctactctatctcctacagcaaaatatgtaaccatgaaacctcctaagttaatctgattgccaaccacttgccgttttggtccataatctttgattatctgaccctctgaaaggttttgtagttggattgtttatttcatactttccgtctacaataatgtcaacaagatttttaatatacaaaggcacttcctcaaaagtatatcctgtatacaccattatatctttgcttgacccataaacgtctctaaccttttctataaggtttttaacattgtaaatattctgcggatctaatggctctcctcctaaaattgttaaaccttttacaaacggtcttgacaaatcttttaaaacttgctctacattttcgtgagtaaacggtttcccataagaataagaccaggctttttggttaaaacagccacgacaaccgtggctacaaccactaacccagagggagcacctaactccctcaccattaataagatctacaggttcatatcctgcaaaattcaaagatgtttctccctttgcaaaacttcctgcattttacctttgttgtaaggccgtgaattaggggcagaaagataccctgatacacgtctaactacagaaatagtttcttcttcatggttgccacaatcaggacactcaaaccctttagccgttgccttaaattctccatgaaaaccacacttaaagcattgatccacgggctgattaataccaaaatagtgaatatgttcataagcgtagtctactaaagtctccaaagcttctaagttattctttaagtttggtgtttcgacataacttatgttaccaccattactaatctgtgcaaaacctgcttcataatcccatttttcaaaaggatttgttaccaaccatacaggttgatgaaaagagttagtaagatagtctctttctaccaaacctgggtatttttcatttaaagctgttgcaaacttatagcacaaagattctgctggagttccatagagactaaacgccagcttagatcgttctttaaacacagcacacacatctttcatatgttgcagaatgcttttaccaagttcctttttatctttttcttctggataaaggatttccaaagcttcggcaagacctacataaccaatactaatagaagcataaccaccttcaaacaaaacaccaatttcatcattggcatttaaacgcgctaaagccccttccatgaaaagaatagggttttcagatgctttggtatgtctgatacggtttacacgtaacatgtgagcatcgtaggctatctccatatgtttattaaggaggtcggtgaaagattctcctttacttctcgcttccgcagcgatcagaggtaagttgatagaaactactccaaggttgaatcgtccatcgtatttttctccttgttcggtggcatagtacgacaaaaaggaacgacaacccatactcgtaacagtgccatctgctgatcccgtaacttctttgttcaaaggaacagaaataaaatctggataaatacgatcagcacaacatgccaaagcttgttgcttaaggtcatagttaggatcactaggtttcatgttaacaccttcttgtaaaaagaaaataactttagggaatacaggtgttacatgatctttgcctagaccgttactatgcactttaagatagttagctgtgatcattctgccaaaaacagaggtatccagacccatactgattgtaataaaaggagattgtccattaacactcattaaagtattaacctgatacaagagagtttgcatagcatcgtatacatcttgttcggtcatttctagggcttcttcccttgcataacaaccgtagcgacgtttggttatctccatgtttttaaggaaactagcttcaacataaggactaagacctttatcaatgtgcgcacacgtctgacctccatactgactggaggcaacagcttggatgatttgagttagcactgtggtagctaccccaatagattttggtttttctatctgtgcagcaccgatcttaaaaccattttctaacatatcttgataattaacaagacaacagtttgtaagaggagagagcagataatccaagtcgtgaatatgtccaaaaccttctgtatgccattctgacaagttttttggcagtatctgtgtcattgccatatgtttgcttaaaattcccgccaagagatccctgtgtgtgttaacgaggtgggaaggtttgtttgcattctctctagtgtatgtttctgaagtgcgatctaaaaaagaaaaaacatcttggtacaaatctttcattattaatccttattttgtgagtagaactattattctacctcttccaaccgaaaaaagctttgaggaaaatcaaaaaaggcgcaaagtgcgcctttaagttttatcgtttggagaggaattgtcttcccatgatcttaccgttctttacagcggtcccatcgtgtccattataatcccaagttccatcaatgttacgcaagaagctatcacgaacagtgtaggctttaccgttctctactttactttcttccacaatgattgccataacaagcttattttcaatttcggtagtaaccgattctttaataccctctgtaacttcacgatcatattggatataaactcgctcctcggtcacttgcacgtctaccacatttttaaatgtgtatgtctgctgtgtagtgtaaaggacacgaacaacactcttcttacctactggcggcttcttacgaggcttacggtaacgtggtttagggttgttagttggaagccaaccaacaatatcccgatcatatccaacatgaccccaagtgaaatgcgtagccgatccactatccgtagttccgtcacgaaagagaacttctacgtgaccaccacaagggcggtgtccaccattattatagttgtattttgccgtgcgcgggagaatgaagtattctttaatcgcccactcttccagattgtcgatattccaagtgaatactgttcccttagcaacatctgtttgaccattgttgaagcgaacctgcacgaaatcttctgaaggcataacacctgtgttcggcagatattcaaatgcagtatcttccgctacaaactgttcttcctcttgctcctcaatacttggcacaggcgcagcttcatcgtatttcgcagcaaacatatttttaaattcttgggccgtgacttctacaaggccgcgatcaccagtagcagcagagtgtgggcgtggtaaatccccaacttcaatatgcattgcatctaaacctgcttgacgatcaaagaagataaccttgcggaattgtttatctttatattgtggcagttcatacatacttgggtcgattgtcttcaaacgttcagcatcttctggcttccagaagcttttacctgttgcaaatctaaagtctaccagtagtttaacaacatctcctaatgataaactatctgcatctacgaaaacgtcttcgattcccaataaccctgatttcttaagaatcagatctaacatgtaacctcctgtggtttgttctgcgtctggataacgatcaacactggtgctggttacaccgtttatttcaccagtggaggcattgtaggaaatatatgggaaggtcatatcgttcattgcaaaatcacctgaacaggttggatcatcttctccctcccagccatacaccttcacaataccttcacacaatttgtcatacacaccagcgcgacgtgctgcttcagcaacttcctgtttacgggcaaatttattaatcatgattcctcctgttaattgccatagatgcacgaggttcggctatggctgttgcataaatatatggatgaccttgtggggacaatcttgttccgaatgaccctaattctaaaccattcatgtcttccacgtcaagccctatttctgtttctacaattcttgtttggactttgtagtaggtccagaagaagtatcgcatttcttcggcatactctttcacttcaccaaagctgggatagaactcaatcaactccagcttcaagaagatgttgaagtgagaatcatccaacacttcctctgtgcggtaacatggtgtcagggccatgtagggatgaccagcgataaactcgtagccatccttttccatttgcaagaatgattgctcggcactggcaacataaaacttcccattaggatgccccaaaggagcatcttctttgccaggtggcagtgtgaatgccaaaatatctgcatccactaaataaggaacatctaacatttcagcaaagcgtccataactctggatggcttcggcaatcacacctgtgttcatgaccttcctcctgtgcgaaacgcacgtttagtaatgtttgacataatgatcaaatcttgtaaagtcatatctgggaactgttgttctaaaactccctcgacagcacctataatatctgacaattcaacaagttgcattattttgcaatcctgctcaacagcatcaaaaagttcttctacttcctctttaatcttttctatgctgccataaggttgtttcttaatgtctgttatgtgataccccgccatttaacgatcctctctgatttgattaatcttacgagcaagggcagctataagcttatcttcttcggatacaggagccgtgctcttacctaaacgatgcatgtctaaaatctcttgaacagtccggttccattgcagacatttaatacaacgtgtatgtgcaacatacagaagatttcgttctgattcttcaagacctacccactcacccttcttatcataattggaagggaagtcatttgcaacaataacctgatcccactccaaaccttttgatttgtgggctgtagttaaagtaactttagccgttggagagttacggtgcatacgtaaagtgtatgcaatattattagctttaccagaaacaacaatgtttaaaagtcgttttgcatcaggatctgattctgcacactctacaaattcttcccaagaggtgtaagggagaactgtctcatgcttaactttgtccaaatcgcctctacgtaaagcattaacactatcaaccatagaaatgaaatctttggtatctacgttaataataatctcttctccgttagcgattcggtccatagcttcgagcaacagagtcaaattcttacggaaaataatggtgtaaggtttactataatctaccacatcagaatgaaaacttccagtgacagtatcataacctttgcctaccagcggatgcttcagaggtgaacgatcagaaaggatcgcattagcaatgtccgcaactttaggaccaaagcgaaaacaagctgtcagaggcaactcaaccccatatgtagccgtttgcttcatcatgttctggcttccacggaactgataaatactctgaaattcatcacccacaacaacaatacgtttagccgatttagcattgcgaaggatagacaggaatgcagggttaacatcctggaattcatctccaaaaataatatcgtatcctaagtcttctttgctcaattcaaagagtttcacataggtgtcatgagtcataatggtttctgatttaggatcgatacgctcacgccaaagttgcttcgcatatttaacaacttcgttaataagtttttgttcgttgatgttcttacgtttaagatctgacatatgcactttaggaaaatgtttatgtccaatatgttcatcgtcagaaaactcatatttagctaaagtttgttttaccattaacccgatcattgcacgagtcagtagcactttaccattcttatcaatcaagttctgaatcttgaattttttggcaatctcactaccagttccagctacgttaacatattgaccttctggacgagataatttgtgtcgaaggttttgtggaagacgctggtaacagattgaatgtagcgttcggcacataacgttaggcggcattttacgccgagcttcctctgccatacttttgttaaacgccaagtatagaatactatcatttgtgccattagccaacatatatagtgttgacgttttacctgatccagatttagcttgaattgtaacgaaacgattttctttatacccgctttcaatagcgtattgttcctcggtaggtgtaaaactcaattgtgtagacacgtatttctcctctcttaataaaaactcttgacaatcctcatcatttccttagctctgctggcataaggttcttttagattaggtggcaaatgtgcattaatgtaccccatttgtttttcccatgtccacttatctttaaatcttggcatggtgtctcctgctaaactgttttcttttcgtgtttgaataatccaattacatggaaaatgcacaccacctttacggaagggaatataatgtcccaatgtgaatgccttattgttctttaaacgtccagctaaattaagattaacaataagactacgaaacacgtagtattgataaagattgtcaacagtatatacagagtagtatgctctaagtgcattatctcgactaagattaccaacatccaaactacaccagtttaaattacttggatcgtagttgtgattatcaatccattcttctctttcctcaaattctgcattaacagcagactgccctgctgtagatacaaaaagagaatttgcatcaaagaacatactcactccccctttagtttacatcgtttagagcattaccaatctttaagataataacatcattaagagcttcttctccattaaggccagagaaagcaggagtaacgaaagttaccatataataatggtcttcttgtaggattgcgataacgccgtctagtttaacatctcctgtgaaacgaaaaactttcaacttttgttctaaaggaagatctccttcaacatttaaaaccatatctccgacaccaaacttttctgccccgatgtagatgtaagcttggtcctcttttttatgataatacaatgttgcttgtttgtcttgtagtgttgtgataccaaacacatctacatcaataatatttttcaaaaattctcctcccaaatccaataattgtctacataagtaggatgccttttgtcccactcttttctagcccaagctacggctgctaccaatacatctccatgacaaggttgaggtgagcagaagcaaactaaatctttcccttctaactctaataaatcttcaagagtgatcttaccacaacgaatttgctcccacaaccactctttatacctttgtatggttgatcctcgtggttcatcatcttttaacttaaaaggatttgcaaacttagaggcttttagtcccatatgtggcattgctctaccaatataaacagcaccctctgggattgttttgcctaaatggtaaaagtttaataccttcatattaacctaaacacatacgtgcgatcagaccctggatgagtttatctgcttcttcgcgatcatagtcggtatcttctataccaccatcttcgtcacgataaactttaccttccaggtacccagcatcgatcaaaccaataatcaaatcgaactgccagcaagagttaccgaaagggcgttttccactgaaactatcttcttcttcccaaagcgtagagagcagtcgtctgaaatattcacgcacagtaacagtgccaagatcatcgtcttcaaaaacaacatctaaagcatctggttcagctttctctacaacaggcacataacgttgaccattaataacaacatctacgattgtttctctcatttttcctcctttttgtattcaatgaacatatctgcatagtaagctttacgttcttcaaatttagcagggtttagcacaatgaacaacacctttctgttgtcttgtggttctttgactgtaatatataaatcttttgtgcaatagaaacctgtggctttgtaagcgtcaccccaattatccactccacgatctatacgatcaaacttacagttatactttttatcatccacctggtagacagcttcaccaccataccaagtgaagaattggctaccttccaccccaatcttgaaaccatcacgggcggctgtagcattggtggcaatcatcaacatcaggacacaaagtagccttttcatttagaattcctcttcagtcttctgtcggtttttgaagaatactacgtcatatacctctccgtaaccatcatttacacagaacataataaaacgatcatcttctgctgttggtgcgcgatgttcaagttcaaaactttcaataaaaccgcgtgaatttacgtagtagatttcatcctcaccagagaacatccaatccttgtctatcagatagaaagctaaactcacaggcgacaactcatccttcacagaatcattgtacagcatgtgggctgcaactgccaaacttaaagtcggattatacaacattacacctcctcgtcagactcatctgctttagagaatacaacattaaacgtttcaccgcaaccattatttacgaaatacatgataaagttttcatcttcgtctacagggccacggtattccagttcgtagctatacagagaactatcgcttgtggctccctgcggataccagaaatagatctcatcgaaagatttaacccacttcaaacctgtacgatcctcaaacactaatgaggaaggattgtcagcatctttgacagcttcttcataatcctggtggaacttgactgctgttgataatgtgctcattatgcctcctcgtaatgtttgcaaacaacgtgtctccacgtcttcttataatgttctcgcttcgtcatagcttcttgataagagggaatacgctgtaacagaagtctccattcacagtctacgcccatacgtccgtacaaagcataacgaacattgtttttcttgtcttgcatactccctccgatcagttaattaaactttttcccaagtaccaaaagcacaggaagggtagattccaacttgagggtttccgttatcatctttgaaagtaaaactgttgttgtctttatcaagaactgtagaataaatcttaccaacagtaacgcagttggaagcttgacccagttcagtgagagtaagacatttcattttctgtttctttgtagccatttataaaatctccttagtaagtgaatctttattctacacaaagagctttgcacatgtcaagtaactctttgtcagattagtcttaatgattggtgatgttgatgacaatcttagtttcaaccttagcccaacagtaatctgcttcattaaaacgactagtcacaatgtattctcctgcacgagaacctgttaagcacactgcacctgtatctgtagctaagtagtagtcccgttcttgttcacttacttctgaatcgtagtagtagaaaacagacataggttcaatttcagataaacggtataactttggaacaggggatttctcgataaactcaacagaagttttactcatttgttttctcctagatctaaactaattaagaagtcacgaaggatgatcatttgttctgtagacaatgataatacaccttctccataaatatcaccagaccattcagcagttagatctagtgtaccagtaccaggaaaccaatcaacagtgatctgattaccattagagtcaggtagtatttcactgactaacataacacactctcctattattgttcttgatcttacgatcatctaccgataagaacaagtacttaaatctctgttcttcgaacatctaacgatagagattaatctattacataatctatactcgctatcgctcgacccttcggggttagggtagcatattttttgaaaaaagtcaacacttattttttggtaagtagataaatcaattgttcacctgcttctggtgcatatagtgctttagtatcgaagtcaaagaagtgagtgactcctgttactttggatgcatgaatagataatcgtgcaagcttaagcagattatccatttccgcaatctttgcacgaaatactgcacgtgtagcgtcaaaagctgcatgtggcatgtatttacgatttagactactacgtttaaatttacgataatctgcaatgatcctgttacgttctttgttcaagtgctttaccagtgcagtatatacatgtggttctttgttagccattgttaatctcctcttcatatgttggtagtgcatggtatgcgatcacaggtgccaagtcaaaataaaaatgaccattgataacagctatcgtgccattgcgtgttttgttaacttcacagaatcccttcttgccgtttgccatgattacaagccactctccgataggaacatcctcggtaccagatactttaatccatccactcactttacttcccctttgtaatcggacactataccaggtcttacttttgccttaagatgtttcaactctgccataggagttgccacttgtataaggttaataatttcaacctcgtagatagtatactcataacccgcatacttcccgatggaatgcaggtatttgatagcatgttcaggtgaatctgcttcaacataccccaaatcttttgtagtgcggccttcacagtcgccttctgtagttacgtgataaagtgtcataaaacctccttcttgttggctgcttcaatcatagcgttaagagtctccataccgctttcaactgcttgagcaatctcttggaacacagacttcttaaagatgtataaagaccctgcctgtaagcgttgcacacaacataaaatcgcttggtgatccatcaggaagtcgccgtaggctgaatcaatcttacctgtaattgggttctctcgtgaacgaggatcgtattctaatgtgatatgcgttacaccaggtaaagtaacaaactgacaacggatgttgacacgtggtgcaattgacacgctaaacaggctgtttgacatttaaacctcctcgtagtaaggcaaagctttaatcaattgttctgaagtaccattctctatccacgtagccccgttgtcaagagaaacataccctttcttatcgataaatttacggagacagccagtgaacttgtttttgtagatcatttcttctttcctttctttaatttgttgtgacctttacccttataaagcttgtgattacgagcagacgggttattttggttctccagtcggctaacaggtgtattccaaaggtttcctgctacaaaagatgctgccacaagttcttccaggtatacaaaatccaaagcaggtatctttgtttccctcatctcgcgttctacattagacaacacgccttcttccttactatcttctttttcaattacagaccaaccctcttcctgccaagcttcccctctgaaccaagtttccatgttataaccttgttcgtcgagaataacaccatctcgcatctcaaaccattcgccaccacaaaaatggcggtgctcaacacgtctaccttccttcattgcttctttagcttcgagccaagtcagtttgatgttttggatgttttgcatttgttttctccttttgtttggtaggagttgatcttaacaagattaaaaagtatgtcaatacttgatctgaaattattttcaggtatcatgtatgaacattaacaagagaggtagatgatgaacattactttagcaactaagaatatttctgaaacaattaacggttttggtgttattgtagccttgcacggtaacaacgagaaatggttggcttcttttgaagaggatcgtcaacacaatatcattttagacgctcctataaaagttatgcatatccttggtgaaaacaaagtgctcacttcctcccgttcaaaggaacaaattacaaacgaattagtaaaactgcttgacaatgttcttaacatgttcgataatgcacctatcgacacaaaacgtgtcttaatgtgaaaggagaatataatggcttaccctgattacattgacgaacgtgctatgggtttcttccgtaacttcttggttggtcgttctcacggagacaacggttccagttataaaacaagctgggatagtcaatgtggcgctaaggctaccaaaactttgaaaatgccaggtcgtccgttgtgcgcgtattgtggtaatgaagccttagctcttcaacctggtattgaacatggtgattatactattaaaggctacacttgtgtctgcaaaggtgcaatggacgaggcggattgggtgaaagaaaaagcagagatggaggaacgtcataaacgagaagcttatgaaatggaaaaacgtatgcctgttccagatttgcaagttaagaaaaatattgttgcgaaaatgatggaaaaagtccagaaagcagagacggaagaagacctaaatcgtgcactggaaaacttacgtaattttaaagaagaaaaagagttgcgtgagattatgtggtaaggtatactatttccatcaattaagagaggagaaccaaatgtattattcacaagacgaagtagcaaacattaaactggcagtgggcgatcttattgtgtcacctaactactattgggataacacagatttggttgaagtagtaacccatgttggagttgaaggtattgtgctctacacactaggtggaggtgttgttggggaaatggaacgttatacgacaacgaagaaactggtaagctcttatcacatgtttttacaccaaggttcggaagagtatacagctttcttgttgaaattagatgcagatcgggagaaggcacgatgaaaattgtacacgatgaaattcaaatagaagaaagtgacctgatggatttggatgcagctttggggaaggtaatctatgcaggaattaaagccttccgtgagaaggcaaacaatagcacgtttgtcatgatccccactaaactgatgcgtgttttgtatccaaatagaagtgcgccgtatacagatgaagaagaggagacaggtagaagagagtggttaaatattttagaaaagatggagaatgcttttattgatagtggtaatccagaaatcgtgtatgctgaagatcaaaggaaggcacggttagagggccgtcttttattcgctagttattttgataatctttggagctaaatatgtctgaattcttcacaatggctttcttagggatctatctgattattagtgctgttggcttaatcatgtctctaatagaggaaatgggaattaagtggaattgtgcattcggtatagctcttatgctcactccagtttggatttacatttgcaaatcggttgaactaattggttagtggaggtaatatgtttagtaaagaaatgagagaggtaatcgctactctggtagttgatcatggtattgaagttgagcgtcacgtttggaaagatgagcctcctttctttgatttggcatcacgggctaaaagtcacatgtatctccttgaagatgataaggattttattctgcgtatgcgttatgatcgagagtttagaattcctcttgacacagatcctgatgatgtagtattgtggttggcagagcatttcgcatttaacgctctacatggaagaagttttggtaatgaacgttgggataccatttgtcgtaaacataatattgaaccagaatacgggagtatgtaatgttaagcatcaaacctaaaatgattactgaagatcaaaaagagtacatttataaatgtggtcgggtgtggaaagaatacactaaaggtaatgaagttattgtagttacggaacatgctatttctttatcagatctttttggtgattatttgcaagtcattaaaattggtattgacagaggtttggtgcaggtgttaacattatcccaagttgaagcagaacacttagacaaaatcattgtcgagttctaagaggagaaagaatatgatctctttagaatcaatagcttttaagaaagggtataccgcagggttcaagtttggtatgtttaataaagtaaatccatactgtccaatgacacacaaaaaggaattcgaagaatgggaagatggattttctaaaggctaccaggcaaagggttggttgtaaggagagaatatgattttaaacttcatcatcaacttgtgtttgacattgggactactctgtgcaatagtatcccctctggttggtgaatattgttctgaactggcgatgtttatagttcttggtgcggctattgctaatatgtttgtcgctgcgatttgtatgttgtgggaataggagggaagtttatgaaaaaattaatcttagccacattgctggctaccgtaagcttcaccacttacgctcaaaaatttgtagcagttaaaacggatattggtaaagatgttgtgatcacaggcaacaaattttactatacacctgggaatggtgttctagaagagtgccaagatgttgaggcatatacaggaaaagaagataacacggaacgtcctttttattcgattatagccacttgcaaaaatgaaatagtagctattaaacaatacaaagatgcccctggaggagaatacttattagtcaagaacattaagagtgaaaaaactgcaaagtttacagtaattattttaaaaggagaaacgttctaatgaaatacactatttttggagatgtagctgttgtaaataaggaatatggtgttgaagctaataaacttcctgctggagtttgggttgtcaactgtgatccgcacggtaactactctttagtgcgtggcgaaagtttctctcttccgaacactctttatggggaaactaaagaccgcgccgcacatgttattaaaacatttgctcgtcgtagtaaagaaggtaaaaatactggggtgttactgacaggcacaaaaggcagtggtaagacgatgttagctaaactaattagcatgtccctaatgtccacagaaggtttaggtattccaaccattttggttacacagccttacacagatgctggattcttagaatttatgagtaaaattacagatcgtgctgttgttttatttgacgaatttgataaagtgtacgctaagaaagaagatcaggaagcactgttgaccttgttggatggaacaggaagtgggaataaactttacatcctcactaaaaatagtggctatatctcggaatattttgtaaaccgtcctagccgtatttattacagtttcaattacgataaactgtctagtgaaactatgttagattacttggataagaatttggtaaataaaaagcacgtagataacttccaacgtttatgggatgttagcacagagttgtctttcgatgttattcaaggcattgtagaagaattgaatttctatccaaaaatgacttttaaagaatgtcttgaaatgatgggtatttctttaggcaacgatgctaaatggaatgtggcttctatcgtagctaatggcaaaacgctgaaggtgaattggatcaataactggcacgacttcacccctactaagtttttgtcgggtgcttgttccctaaacatctatctacaaagcttgaaagatgatgaagtggaagcaatggaaaccaacagttatgttatcctagatgaagatggtgatccacatattgatctatgtgcaacggcggatggtctaacttgtgatctgattgaaggtggtaagattcttgtgatgagcactacaccaggaaacactttgcgagtggtgctggagcctgtaacacaacgttccactacactgggtagcgtgttctgatacagcacaaatagctaaacccgcttcggcgggttttgttatattgatttcagacttatagggagagaggatagacaaagatggcgaagacgttagaacagtatataggagaatgtaaaccaatagcggaagctaaaggatatgagattatagggattgtagagccatttaaaggtgtgcacacgaagatgatcaacttctgccctaatcatggggagtggagaacatccacatttgccaattttaaacgtggtaagtctggttgccctgggtgcaaaaatgagaaggcaagacaagacaacagtaaaaacctagattattacctttcggaatgtaagcctattgctgaagctaagggaatcaagattttaggcattaatggagagtttataggtgtacatacaaagatgatcaacctttgtcctgagcacggggaatggcgaacattaacatttcataatcttaagggtggtagtggttgtcctaaatgcggtaacaaaagatctaggaattctaaaatactcccagacgatcagcacatacaagacttcattaatacaggaaagtttaaagagggtacaatcttcactaaaacagataaaaaacgaggccgcgattctttatggtgtgtagagtgtcctgcctgctctcacgatgagtatgtgcaagctggggtgtgtgatggtaagttttatgtcgcagggaatgaccttaaacaagggaagattccttgccgttgtgcaactaactgtcattacacagaagcacagattacctatagggtaaaaaaggcagtagaaaggaaagggtatatctgggtaggttggatcgggaaaccgtctgtaagattaggtaagtttaaatatggatgtaagaaacatggggtacaaataggacgtgccagtggtttgttaaatcatggtactggttgtccgcaatgtgctaaccagacacaacaacaatgttacattaaccacatccatgatgaacaaggtattctctgtgctttgaaatttggaattgccaataatagtgatcgccgtatcaaaaaacaaaatagtcataatgtgtttactatgaaacaggtccaagtgtggcacttccctactgtgaagcaatgcaaagatgcagagaagcgttgtaagcgtgtccttcacacggaagcagtgagcaaatatgctatgccagatggctacacagagacagtagagttatcttgcatggcctcaatacaaaacatttataaactttatggtggaacattacaggaggaaacatgttagttgacgttcaaattatgcgcaacgaaagaatggacttctttgaagcagtagagaaacatctgatcagatgggactatgaatttgttcctgctggatgtggaccagtagagcatttagcggaagacgacgatgtatacatgatcattcgtcaagtgtaccagacagaccagtgtgaagaaactcccgaactgattttgtttgagtgtaaagatcttgcaaaatattttgactatggcggaaaagagggtcataatctctccagatacaataaacgtctacttatcttagactacatgcggaacaacaaacacaaactcatcgacgcagacgcagtttatggctactggtggatggattaacaaaggagaaactatggcacgtttagcagataaccctgtattctaccccgttcttgatctttatgatgaattgacatatgttgtggagcggtataattacaatgaagacctcttggagacaaaccttaaagtagttctgatgaaagcctatcagcaagggcaacgtgaaattttggagagtatgaaaaatgcgaataactgatgattatgtattcttcttttcacataaagatgtttttagtaattggtatattgcaccctttacagaaaccgaaccaggttacaatcagacatttaattgtgtcgaacaatacatgatgtggcgtaaagctttgctctttaacgatcacaacaccgcacaagctattctgactcatagcttaaaacgagaagatgagaagatacaagcttattacaaacgtatgggtagggcagtagcaggtttcgataacaaaatatgggaagagaatcgtgagcgtattgttatgcgaggtttatgcttgaagtatgtacagaatccagacttgtatgccgatttacgtctatatcaatacaaaacatttgttgaagcaagtccttacgataaggtatacggaattggaatggggatgtatgaaccaggggtgctaaaccctgccacctggaaagggcagaatcttttaggcaaatatcataacaaactgatcgaaatacttttcccagacaaaataccgcaaagacgatatttgtgatattttaacttttttcatttttagaacaaaggtgtcactttgtagcacagaaataaggctcctacagcaccgtagagagcctgttattttgtcctatacaaacccttatctttttcagtttgcatcactaggattcgatctaagtgggttcctgaaggtttaccaataagattaaaggttatctcaaattcccactacctattatctcaaaaatccctcaaattatttaaactttttaagaatttacaaaagtgaaagttgaaaaccaaaatttaaagtttaggaaaattatcttaaaatgttagatacaaaacaaaactcaaaagtcaaggaaaattttaaaaattttgcgcgcccacagtatttaaagtttttttgcttttacaaaaatgaaagtacaaaagcaaaatttaaagtttacaaaaatttatgcagatgggaatgagaagagttctcatatggaaatgcaaatgataatgattcgcatttaggtttataaatgagattgattcttatttgataaggtaaatgataatcattctcatttagagaatgacgcgcaggggcggtgtttgtctcgcgctcccgtgtcccctcgccatgtaataagaataacagatccagccaggaaagcaagcgattattttatctttacatttctttacaaatatatagcgcccagcctaccggcgatcaaccttccaaccagcgccctggtatgttagccccgcctttacgccgtggggtggcgcttcctcttctgtatgtaaaacagtataagcccgatccctgggcttgtcaagattattttttgttttcttgccaggaaaggacacctaaccaaaaatgcatatcgccccgcgcccctggtgggatcttgctttccccgccgccactgcaagcccataaataaccatcagcaaacggatcaaaatggtctatctcttccaccttatgatcgcccaggttgagaacggtttcaacctttaagcccgttgcgcttgctacctggtgcaccgtgccgccttgccagcccaatgagtgcataaggtgtaatgtagtatttgtcatggtgtcgccctttctttgttgtgcgccctggttggcgcggtagaaagatgatagccctttcttttatatatagcaagcaaaaagaaaataaaaaagattgaaaaagtgattgacgttcgccaggtggcggcataatatttaccacgtagggcggcaatggtgccgctcattatttggagttaagatcatggcaacattgcacattgtggcgaaagctggacaaatcaacgtaatagtaaacggttttactgagttcagtcatccccaggatgatcatgaaacggttttatctttcattgattcactgttagaaatgggagtaattacagaagatcagcatactgcaaaatgcaagcgcgttaagcagattgtaggaatagaataaaagtcttgacaacaagccacaacctgataagatgtatcacatagggcggcggaatggtccagccgctcacaacagaagagagattataatcatggcatcatatagcgcaacaatgatcgtagctggcaccactggtaaacctatgagcggtggcggatctttcgcaaatatcaacattgacgggcgtttatccctggacgcagcgatcaccgtggcgcgggaaacatttaagaaagaatgtaaattcaataaacaagattatctcggtttcgctattgaaaaaaccgcgcgttttgttgattataaaagcccaaaaatggttgatactacactaaaagcgcaagatgtagcgtttttgctttaaggcttgacattaacgaataatttgttaatatgttacataaagcgggaatagttcccgctatttgtaaggtggtagaatgttttacatcaaattaaaaggtcacgtgatcgcgttcaaagataacgctttttacagattagcaaaatatgcgttaatacatccccactatgtttatataagggcgcgtgatgaaataaatatctttgatcaaacaacatgcgagaacatcgagatccgcaaggttggcgtacgtgattatcgtacatctttctacccttgcaaggattcagcaagtctttttaaagtatgccaattgttgaaaaaaggtggttaatatgggccgcgaatatgtgatccagtcttgggtaaaacatgaagcagatgatccgcgcatcattcccgatcatcttatcgatgaatccacgggatatagcggtgagcaaataggtaacagattagcacgtagtaacggcaacgtaaaagcgcgttatgtgcgccctggctggctggcaaatggtaacgctgatttatccagtgcggaagatgcgagcgacggcgcgaaagataatcctttgtacaaagttgatccggcttttcgtgtcctggatgaataccccagcaagatagcggcgcttgatgaagcattagaaagtaagcgcataacctggaccgcttacaacatggcaaaaaacgtacttgatggtaaattgattcaagccgaaagaaaattagccaaaattgcagccatagcccaggaggaagacgaggagacaacggaagaggaagagtacgaagagatcccgccgttgttgtgtattgatgcttttcctgattatcagccgacagaggaagaaaaaaggatcgcactagaaaactttgaaaatagtctttgacatatcgccgccactggtataatatttaccacgtagggcggcaatggtgccgctcatagtgaaattatgcaagaggtttacaatgattaataaagaaaatagcttgacggttggaacgattaacgctatcattttcgccgttccattttgggttgtagtagcggctattattttctaaaaatattcttgacaacgttttttaatctgataagatgtatcacatagggcggcggaatacttccccgccaaaacaaaaagggtaacacaatgagcaagcaaatcaatactatcatgtttaatctggtatctttccgcgatgatatgaaaaatttaccacgtgaaacggttgatattcatgtttcagcttatcgcgcccttattgatatgttaccgctaaaacgtgatcaacatgccgctaatatgatgcttaatgctatgcttaaaaagatgattcaaacggatcttactctggcgtatgagtatcaagggcgcttatatgctacttacaacaaggcggtacctggtctgggaagtaccgaagagttgcacggcttaaacttggatcagaacacttgggatagtatgcgccgcgttatggtatgggccgaaagcggtaaaatttacgaataaaaacggttgacactgtttaaaattccggtatagtttaccacatagggcgggaagtggtttcccgccaacaatgaaaaaggttatcatcatggctattaatattaatgtttcctcttatgctaccctggctaacacggctaaaattgaattatccagcattgaggcggtgcatattagcgcccgtcgctggtttcaacagtcctacggtaacacatatttttctttaatggttgacgttgagatcggcggtaaactgatcgaggtggttaacgttccgtttcaatatggctatggtgatcattttgataccgtcgccctggaagaatttagcaaggttatcaaccttgagggcaaggaattttcacgcggcgcgtatctttcccgtttttgccgtgacaatgggatcactgtatacagtcatgcaagcgatgttaaacgtaaaaaagatctataaaaagcattgacagcacgaataaaaagagtaaactgtattacatagagagcgggaacacttcccgcctcactgaaaaagagagaaaaatcatggctaaatctaaaatgtacaacggtcacaaaaacaaaactcattggaatgtaagcctgtggattaataacgatgagggattgtatcggtttgcattgggattgatcaatgagtgcggtaataaagatcaggcggctgatttaatgtgctaccgtttgaaacaggatggaatcactacaacgccagacggctttaagtatagtaaaactgcaatccgcgccgctatggttggaatgtaaaggagacataaaaatgaaacatcgttcgacctatctcacaaaacgttttagcttagatcataaattgggctattacggaagaaatagaaaataatttgacaacgtttaaaattagtgtaagatgtatcacatagggcgggaagtggtttcccgccaacaacagagagattaaagattatggctatcaatattgttcgtgtatccggcaccgttggcagttcccaggttgtagcagttgtaacaaacaaaaagattaatgatgtatgtgagatcttgaataagtgggctattgctaattttggagaatatgcgagcgtcgagtacatcgaatcctaccaggtgccaaccatcagcctaaccgatctcaacattgatcgcctgttatgcctggatgaattaatctgaaaaagattgttgacaccggaaagaaaaagagtaaactgtattacgtagggcggcaatggtgccgctcacaacagaagagagattatcacgatggctaatatccgcacactgttaaaaaatgcaagtcaagttttattttcagatgacgagtatttcaataaagacattacaggcgtgaaaaatttaaaagacgttaaggatgtaataggtattcgcggatctttacgtaagggcgattactacggtaacaaggtgcaatataaactgtcaaaagattatgattttactttgacaattatcaactaagggatcacaaaatgaaaacttgccaatgtggtaaaaagtctatctctggtttaaaacgtggcgttgctctttgtcaataccactataacgctcaaacgtggggtaagcagtgggcggatcaggtggaagaggcaaagaaagaaaatataaaagtagttgcaaagaaataaaaatagagtaaactgtattacatcaaggcggcggaatggtccaccgcctaacaaagagaagaggaaaatatcatgatcactttcgctacccgtgaagccgctcgcaacgttgcacgtaaagttaacgccgccaacttgggcgctacgcttaaagcccctgtaaaagatgaatcaggaaaatggatcttccctggtctgcgtcatgctgacaagttaggtactttaagccttaaaaaataatcgttgacttttcgttatagcgccttataatgggcgctatagagaagagaaaccactattaacaaggaaacatcatgattacttttgctattgtcgccgttgttgctggtcaggtttacgtaaacgagacatttactacagaagacaaggccgcaggagatataaccgccgtttacaatgagtgcaaggcagtagaaaggatgttatcgccttgtatgctaatgagtgaacgtcaggatgggataacagtatttactaacattgaaacagggtaccaaatggtagtaacaaaataaagcttgacacggatttaattttcagtaaactgttacacgtagggcgggaatagttcccgctaaaaagagagaaagaccatgaaagcacaaaatgcaattaaagagtacatccttgccgctatcgattttaatgattatggtattacaaccgaaaaagagaagatcgcggaattgatgcgccgttttaattccgagtactggtaccctgataaccaatcacgttttaattatagtattgttaaagcacttgcatcatggttacaaggtttgccatcagatattaatatcgctttcgaatattgggaaattgatcgcttgttaacatcctggggatacattaaagagaatagcagcgatgataaaatccaacgagaaagggaaaattattggctttatattgcaggcgtgatccttgcttgctcttatgaatgataaaccttgacaattttacaaaacagtttaaattaataatatagcggcaatggtgccgctcatataaagaggaaacaaaatgaatacatctaatcgcgcagaaaaaattcaatcttccaagatccgcaaggcctggaatgaggaagtgatccgcaaaggcgacaagcgcaataaaacaaagcgcgggaagagtgacaaatataattggatggatttagagaattaacataacaa

(The sequence listing continues in the following parts.)

The invention claimed is:

1. A method for manufacturing a bacteriophage cocktail comprising at least two bacteriophage strains for the prevention of an opportunistic bacterial infection caused by pathogenic bacterial cells in livestock, the method comprising:
   a) characterizing at least two bacteriophage strains based on:
      (i) an absence of a gene encoding an integrase;
      (ii) an absence of a 16s rRNA gene marker;
      (iii) an absence of a gene encoding a human toxin;
      (iv) an absence of an antibiotic resistance gene;
      (v) a burst size greater than 10 against said pathogenic bacterial cells;
      (vi) stability at pH 4;
      (vii) stability at a temperature between 4° C. and room temperature (RT); and
      (viii) an absence of cross-resistance by said pathogenic bacterial cells against at least two bacteriophage strains by:
         providing a first and a second bacteriophage strain that infect the Pathogenic bacteria, the second bacteriophage strain being different from the first bacteriophage strain;
         culturing the first bacteriophage strain in the presence of said pathogenic bacteria at a Multiplicity of Infection (MOI) of at least about 1 until said bacteria develop resistance to the first bacteriophage strain, thereby producing a Bacteriophage Insensitive Mutant (BIM) pathogenic bacterial strain;
         challenging the BIM pathogenic bacterial strain with the second bacteriophage strain; and
         determining the absence of cross-resistance when the second bacteriophage strain still inhibits the growth of the BIM pathogenic bacterial strain; and
   b) selecting at least two bacteriophage strains characterized based on each of (i)-(viii) in step a), and combining to form the cocktail.

2. The method of claim 1, wherein the opportunistic bacterial infection caused by the pathogenic bacterial cells is selected from the group consisting of: *Salmonella enterica, Listeria monocytogenes, Escherichia coli, Campylobacter jejuni, Staphylococcus aureus* and *Clostridium perfringens*.

3. The method of claim 1, comprising selecting at least three bacteriophage strains.

4. The method of claim 1, comprising selecting at least four bacteriophage strains.

5. The method of claim 1, comprising selecting at least five bacteriophage strains.

6. The method of claim 1, wherein the at least two bacteriophage strains are further characterized in that they have different host ranges against at least two different pathogenic bacteria causing opportunistic bacterial infections.

7. The method of claim 1, wherein the at least two bacteriophage strains are further characterized in that they have complementary host ranges against at least two different pathogenic bacteria causing infections.

8. The method of claim 1, wherein the opportunistic bacterial infection is caused by an extra-intestinal pathogenic Escherichia coli (ExPEC) or an Avian Pathogenic *E. coli* (APEC).

9. The method of claim 1, wherein the at least two bacteriophage strains comprise a sequence selected from the group consisting of: SEQ ID NO: 1, 2, 3, 4, 5, 6, 7, 8, 9, 10, 11, 12, 13, 14, 15, 16, 17, 18, 19, 20, 21, 22, 23, 24, 25, 26, 27 and 28.

10. The method of claim 1, wherein the at least two bacteriophage strains are defined by the deposits filed at the International Canadian Depository Authority (IDAC) on Sep. 7, 2018 and bearing numbers #: 070918-02; 070918-03; 070918-04; 070918-05 and 070918-06.

11. The method of claim 1, wherein the bacteriophages have complementary host ranges against at least two different bacterial strains selected from the group consisting of: Avian Pathogenic Escherichia coli (APEC)-A, APEC-B, APEC-C, APEC-D, APEC-E and APEC-F.

12. The method of claim 1, wherein the livestock is poultry or pigs.

13. A formulation comprising a bacteriophage cocktail comprising at least two bacteriophage strains for the prevention of an opportunistic bacterial infection caused by pathogenic bacterial cells in livestock, in admixture with a food, a feed, or a food- or feed-acceptable carrier, wherein at least one of the bacteriophage strains comprises a sequence selected from the group consisting of: SEQ ID NO: 1, 2, 3, 4, 5, 6, 7, 8, 9, 10, 11, 12, 13, 14, 15, 16, 17, 18, 19, 20, 21, 22, 23, 24, 25, 26, 27 and 28, wherein the cocktail is in the form of a powder, and wherein the carrier is a food- or a feed-compatible excipient.

14. The formulation of claim 13, wherein the at least two bacteriophage strains comprise a sequence selected from the group consisting of: SEQ ID NO: 1, 2, 3, 4, 5, 6, 7, 8, 9, 10, 11, 12, 13, 14, 15, 16, 17, 18, 19, 20, 21, 22, 23, 24, 25, 26, 27 and 28.

15. The formulation of claim 13, being a food or a feed for livestock, wherein said livestock is poultry or pigs.

16. A formulation comprising a bacteriophage cocktail comprising at least two bacteriophage strains for the prevention of an opportunistic bacterial infection caused by pathogenic bacterial cells in livestock, in admixture with a food, a feed, or a food- or feed-acceptable carrier, wherein at least one of the bacteriophage strains is selected from the deposits filed at the International Canadian Depository Authority (IDAC) on Sep. 7, 2018 and bearing numbers #: 070918-02; 070918-03; 070918-04; 070918-05 and 070918-06, wherein the cocktail is in the form of a powder, and wherein the carrier is a food- or a feed-compatible excipient.

17. The formulation of claim 16, wherein the at least two bacteriophage strains are selected from the deposits filed at the International Canadian Depository Authority (IDAC) on Sep. 7, 2018 and bearing numbers #: 070918-02; 070918-03; 070918-04; 070918-05 and 070918-06.

18. The formulation of claim 16, being a food or a feed for livestock, wherein said livestock is poultry or pigs.

* * * * *